United States Patent 10,358,497 (METHODS OF TREATING CARDIOVASCULAR DISEASE WITH AN ASGR INHIBITOR) - sequence listing, part 2

SEQ ID NO: 3410 - protein, 11 aa, Artificial Sequence
  Description of Artificial Sequence: Synthetic peptide
QGDSLRNYYVS

SEQ ID NO: 3411 - DNA, 33 bp, Artificial Sequence
  Description of Artificial Sequence: Synthetic oligonucleotide
caaggagacagcctcagaaactattatgcaagc

SEQ ID NO: 3412 - protein, 11 aa, Artificial Sequence
  Description of Artificial Sequence: Synthetic peptide
QGDSLRNYYAS

SEQ ID NO: 3413 - DNA, 33 bp, Artificial Sequence
  Description of Artificial Sequence: Synthetic oligonucleotide
tctggaaataaattggggaataaatatgtttgc

SEQ ID NO: 3414 - protein, 11 aa, Artificial Sequence
  Description of Artificial Sequence: Synthetic peptide
SGNKLGNKYVC

SEQ ID NO: 3415 - DNA, 42 bp, Artificial Sequence
  Description of Artificial Sequence: Synthetic oligonucleotide
actggaaccagcagtgatgttggacgttttaaccttgtctcc

SEQ ID NO: 3416 - protein, 14 aa, Artificial Sequence
  Description of Artificial Sequence: Synthetic peptide
TGTSSDVGRFNLVS

SEQ ID NO: 3417 - DNA, 33 bp, Artificial Sequence; identical to SEQ ID NO: 3401
  Description of Artificial Sequence: Synthetic oligonucleotide

SEQ ID NO: 3418 - protein, 11 aa, Artificial Sequence
  Description of Artificial Sequence: Synthetic peptide
SGDKLGDKYAC

SEQ ID NO: 3419 - DNA, 42 bp, Artificial Sequence; identical to SEQ ID NO: 3415
  Description of Artificial Sequence: Synthetic oligonucleotide

SEQ ID NO: 3420 - protein, 14 aa, Artificial Sequence
  Description of Artificial Sequence: Synthetic peptide
TGTSSDVGRFNLVS

SEQ ID NO: 3421 - DNA, 33 bp, Artificial Sequence
  Description of Artificial Sequence: Synthetic oligonucleotide
caaggagacagtctcagaaactattatgcaagc

SEQ ID NO: 3422 - protein, 11 aa, Artificial Sequence
  Description of Artificial Sequence: Synthetic peptide
QGDSLRNYYAS

SEQ ID NO: 3423 - DNA, 33 bp, Artificial Sequence; identical to SEQ ID NO: 739
  Description of Artificial Sequence: Synthetic oligonucleotide

SEQ ID NO: 3424 - protein, 11 aa, Artificial Sequence
  Description of Artificial Sequence: Synthetic peptide
SGDKLGDKYVC

SEQ ID NO: 3425 - DNA, 42 bp, Artificial Sequence
  Description of Artificial Sequence: Synthetic oligonucleotide
actgggagcagctccaacttcgggacagattatgatgtacac

SEQ ID NO: 3426 - protein, 14 aa, Artificial Sequence
  Description of Artificial Sequence: Synthetic peptide
TGSSSNFGTDYDVH

SEQ ID NO: 3427 - DNA, 33 bp, Artificial Sequence
  Description of Artificial Sequence: Synthetic oligonucleotide
tctggagatagattgggggataaatatgcttgc

SEQ ID NO: 3428 - protein, 11 aa, Artificial Sequence
  Description of Artificial Sequence: Synthetic peptide
SGDRLGDKYAC

SEQ ID NO: 3429 - DNA, 33 bp, Artificial Sequence; identical to SEQ ID NO: 697
  Description of Artificial Sequence: Synthetic oligonucleotide

SEQ ID NO: 3430 - protein, 11 aa, Artificial Sequence
  Description of Artificial Sequence: Synthetic peptide
SGDKLGEKYAC

SEQ ID NO: 3431 - DNA, 33 bp, Artificial Sequence
  Description of Artificial Sequence: Synthetic oligonucleotide
tctggagataaattgggggataaatatgttagc

SEQ ID NO: 3432 - protein, 11 aa, Artificial Sequence
  Description of Artificial Sequence: Synthetic peptide
SGDKLGDKYVS

SEQ ID NO: 3433 - DNA, 33 bp, Artificial Sequence; identical to SEQ ID NO: 693
  Description of Artificial Sequence: Synthetic oligonucleotide

SEQ ID NO: 3434 - protein, 11 aa, Artificial Sequence
  Description of Artificial Sequence: Synthetic peptide
SGDKLGDKYAC

SEQ ID NO: 3435 - DNA, 39 bp, Artificial Sequence
  Description of Artificial Sequence: Synthetic oligonucleotide
tctggaagcagctccaacatcggaagtaatattgtgacc

SEQ ID NO: 3436 - protein, 13 aa, Artificial Sequence
  Description of Artificial Sequence: Synthetic peptide
SGSSSNIGSNIVT

SEQ ID NO: 3437 - DNA, 42 bp, Artificial Sequence
  Description of Artificial Sequence: Synthetic oligonucleotide
actgggagcagctccaacatcggggcaggttttgaagtacac

SEQ ID NO: 3438 - protein, 14 aa, Artificial Sequence
  Description of Artificial Sequence: Synthetic peptide
TGSSSNIGAGFEVH

SEQ ID NO: 3439 - DNA, 39 bp, Artificial Sequence; identical to SEQ ID NO: 3435
  Description of Artificial Sequence: Synthetic oligonucleotide

SEQ ID NO: 3440 - protein, 13 aa, Artificial Sequence
  Description of Artificial Sequence: Synthetic peptide
SGSSSNIGSNIVT

SEQ ID NO: 3441 - DNA, 33 bp, Artificial Sequence; identical to SEQ ID NO: 3277
  Description of Artificial Sequence: Synthetic oligonucleotide

SEQ ID NO: 3442 - protein, 11 aa, Artificial Sequence
  Description of Artificial Sequence: Synthetic peptide
SGDKLGDKYVS

SEQ ID NO: 3443 - DNA, 42 bp, Artificial Sequence; identical to SEQ ID NO: 183
  Description of Artificial Sequence: Synthetic oligonucleotide

SEQ ID NO: 3444 - protein, 14 aa, Artificial Sequence
  Description of Artificial Sequence: Synthetic peptide
TGTSSDVGGYNYVS

SEQ ID NO: 3445 - DNA, 33 bp, Artificial Sequence
  Description of Artificial Sequence: Synthetic oligonucleotide
tctggaactaaattgggggataaatatgtttgc

SEQ ID NO: 3446 - protein, 11 aa, Artificial Sequence
  Description of Artificial Sequence: Synthetic peptide
SGTKLGDKYVC

SEQ ID NO: 3447 - DNA, 39 bp, Artificial Sequence
  Description of Artificial Sequence: Synthetic oligonucleotide
tctggaagcaactccaacatcggaaataatattgtcacc

SEQ ID NO: 3448 - protein, 13 aa, Artificial Sequence
  Description of Artificial Sequence: Synthetic peptide
SGSNSNIGNNIVT

SEQ ID NO: 3449 - DNA, 39 bp, Artificial Sequence
  Description of Artificial Sequence: Synthetic oligonucleotide
tctggaagcagctccaacatcggaagtcatattgttacc

SEQ ID NO: 3450 - protein, 13 aa, Artificial Sequence
  Description of Artificial Sequence: Synthetic peptide
SGSSSNIGSHIVT

SEQ ID NO: 3451 - DNA, 39 bp, Artificial Sequence
  Description of Artificial Sequence: Synthetic oligonucleotide
tctggaagcagctccaacatcggaagtaatattgttacc

SEQ ID NO: 3452 - protein, 13 aa, Artificial Sequence
  Description of Artificial Sequence: Synthetic peptide
SGSSSNIGSNIVT

SEQ ID NO: 3453 - DNA, 33 bp, Artificial Sequence
  Description of Artificial Sequence: Synthetic oligonucleotide
tctggagataaactgggggaaaaatatgcttgc

SEQ ID NO: 3454 - protein, 11 aa, Artificial Sequence
  Description of Artificial Sequence: Synthetic peptide
SGDKLGEKYAC

SEQ ID NO: 3455 - DNA, 33 bp, Artificial Sequence
  Description of Artificial Sequence: Synthetic oligonucleotide
tctggagagaaattgggggaaaaatttgcttgc

SEQ ID NO: 3456 - protein, 11 aa, Artificial Sequence
  Description of Artificial Sequence: Synthetic peptide
SGEKLGEKFAC

SEQ ID NO: 3457 - DNA, 33 bp, Artificial Sequence; identical to SEQ ID NO: 3453
  Description of Artificial Sequence: Synthetic oligonucleotide

SEQ ID NO: 3458 - protein, 11 aa, Artificial Sequence
  Description of Artificial Sequence: Synthetic peptide
SGDKLGEKYAC

SEQ ID NO: 3459 - DNA, 33 bp, Artificial Sequence; identical to SEQ ID NO: 701
  Description of Artificial Sequence: Synthetic oligonucleotide

SEQ ID NO: 3460 - protein, 11 aa, Artificial Sequence
  Description of Artificial Sequence: Synthetic peptide
SGDKLGNKYAC

SEQ ID NO: 3461 - DNA, 39 bp, Artificial Sequence
  Description of Artificial Sequence: Synthetic oligonucleotide
tctggaagcagctccaacattgggaataattatgtatcc

SEQ ID NO: 3462 - protein, 13 aa, Artificial Sequence
  Description of Artificial Sequence: Synthetic peptide
SGSSSNIGNNYVS

SEQ ID NO: 3463 - DNA, 33 bp, Artificial Sequence
  Description of Artificial Sequence: Synthetic oligonucleotide
tctggagataaattgggggataaatatacttgc

SEQ ID NO: 3464 - protein, 11 aa, Artificial Sequence
  Description of Artificial Sequence: Synthetic peptide
SGDKLGDKYTC

SEQ ID NO: 3465 - DNA, 33 bp, Artificial Sequence; identical to SEQ ID NO: 693
  Description of Artificial Sequence: Synthetic oligonucleotide

SEQ ID NO: 3466 - protein, 11 aa, Artificial Sequence
  Description of Artificial Sequence: Synthetic peptide
SGDKLGDKYAC

SEQ ID NO: 3467 - DNA, 33 bp, Artificial Sequence; identical to SEQ ID NO: 743
  Description of Artificial Sequence: Synthetic oligonucleotide

SEQ ID NO: 3468 - protein, 11 aa, Artificial Sequence
  Description of Artificial Sequence: Synthetic peptide
SGDKLGNKYAC

SEQ ID NO: 3469 - DNA, 33 bp, Artificial Sequence; identical to SEQ ID NO: 191
  Description of Artificial Sequence: Synthetic oligonucleotide

SEQ ID NO: 3470 - protein, 11 aa, Artificial Sequence
  Description of Artificial Sequence: Synthetic peptide
SGDKLGDKYAS

SEQ ID NO: 3471 - DNA, 33 bp, Artificial Sequence
  Description of Artificial Sequence: Synthetic oligonucleotide
tctggagataaattgggggataaatatgcttct

SEQ ID NO: 3472 - protein, 11 aa, Artificial Sequence
  Description of Artificial Sequence: Synthetic peptide
SGDKLGDKYAS

SEQ ID NO: 3473 - DNA, 33 bp, Artificial Sequence; identical to SEQ ID NO: 693
  Description of Artificial Sequence: Synthetic oligonucleotide

SEQ ID NO: 3474 - protein, 11 aa, Artificial Sequence
  Description of Artificial Sequence: Synthetic peptide
SGDKLGDKYAC

SEQ ID NO: 3475 - DNA, 33 bp, Artificial Sequence; identical to SEQ ID NO: 3453
  Description of Artificial Sequence: Synthetic oligonucleotide

SEQ ID NO: 3476 - protein, 11 aa, Artificial Sequence
  Description of Artificial Sequence: Synthetic peptide
SGDKLGEKYAC

SEQ ID NO: 3477 - DNA, 33 bp, Artificial Sequence
  Description of Artificial Sequence: Synthetic oligonucleotide
tctggaaataaattgggggataaatatgcttct

SEQ ID NO: 3478 - protein, 11 aa, Artificial Sequence
  Description of Artificial Sequence: Synthetic peptide
SGNKLGDKYAS

SEQ ID NO: 3479 - DNA, 33 bp, Artificial Sequence; identical to SEQ ID NO: 701
  Description of Artificial Sequence: Synthetic oligonucleotide

SEQ ID NO: 3480 - protein, 11 aa, Artificial Sequence
  Description of Artificial Sequence: Synthetic peptide
SGDKLGNKYAC

SEQ ID NO: 3481 - DNA, 33 bp, Artificial Sequence; identical to SEQ ID NO: 697
  Description of Artificial Sequence: Synthetic oligonucleotide

SEQ ID NO: 3482 - protein, 11 aa, Artificial Sequence
  Description of Artificial Sequence: Synthetic peptide
SGDKLGEKYAC

SEQ ID NO: 3483 - DNA, 33 bp, Artificial Sequence; identical to SEQ ID NO: 701
  Description of Artificial Sequence: Synthetic oligonucleotide

SEQ ID NO: 3484 - protein, 11 aa, Artificial Sequence
  Description of Artificial Sequence: Synthetic peptide
SGDKLGNKYAC

SEQ ID NO: 3485 - DNA, 33 bp, Artificial Sequence
  Description of Artificial Sequence: Synthetic oligonucleotide
tctggagatagattggggaataaatatgcttcc

SEQ ID NO: 3486 - protein, 11 aa, Artificial Sequence
  Description of Artificial Sequence: Synthetic peptide
SGDRLGNKYAS

SEQ ID NO: 3487 - DNA, 33 bp, Artificial Sequence; identical to SEQ ID NO: 701
  Description of Artificial Sequence: Synthetic oligonucleotide

SEQ ID NO: 3488 - protein, 11 aa, Artificial Sequence
  Description of Artificial Sequence: Synthetic peptide
SGDKLGNKYAC

SEQ ID NO: 3489 - DNA, 33 bp, Artificial Sequence; identical to SEQ ID NO: 701
  Description of Artificial Sequence: Synthetic oligonucleotide

SEQ ID NO: 3490 - protein, 11 aa, Artificial Sequence
  Description of Artificial Sequence: Synthetic peptide
SGDKLGNKYAC

SEQ ID NO: 3491 - DNA, 33 bp, Artificial Sequence
  Description of Artificial Sequence: Synthetic oligonucleotide
tctggagataaattggggaataaatatacttgc

SEQ ID NO: 3492 - protein, 11 aa, Artificial Sequence
  Description of Artificial Sequence: Synthetic peptide
SGDKLGNKYTC

SEQ ID NO: 3493 - DNA, 39 bp, Artificial Sequence
  Description of Artificial Sequence: Synthetic oligonucleotide
acccgcagcaatggcagcattgtcagcaactatgtgcag

SEQ ID NO: 3494 - protein, 13 aa, Artificial Sequence
  Description of Artificial Sequence: Synthetic peptide
TRSNGSIVSNYVQ

SEQ ID NO: 3495 - DNA, 39 bp, Artificial Sequence; identical to SEQ ID NO: 3493
  Description of Artificial Sequence: Synthetic oligonucleotide

SEQ ID NO: 3496 - protein, 13 aa, Artificial Sequence
  Description of Artificial Sequence: Synthetic peptide
TRSNGSIVSNYVQ

SEQ ID NO: 3497 - DNA, 33 bp, Artificial Sequence
  Description of Artificial Sequence: Synthetic oligonucleotide
tctggagataaattggggaataaatatgattac

SEQ ID NO: 3498 - protein, 11 aa, Artificial Sequence
  Description of Artificial Sequence: Synthetic peptide
SGDKLGNKYDY

SEQ ID NO: 3499 - DNA, 33 bp, Artificial Sequence; identical to SEQ ID NO: 701
  Description of Artificial Sequence: Synthetic oligonucleotide

SEQ ID NO: 3500 - protein, 11 aa, Artificial Sequence
  Description of Artificial Sequence: Synthetic peptide
SGDKLGNKYAC

SEQ ID NO: 3501 - DNA, 33 bp, Artificial Sequence
  Description of Artificial Sequence: Synthetic oligonucleotide
tctggagataaattggggtataaatatgcttgg

SEQ ID NO: 3502 - protein, 11 aa, Artificial Sequence
  Description of Artificial Sequence: Synthetic peptide
SGDKLGYKYAW

SEQ ID NO: 3503 - DNA, 33 bp, Artificial Sequence; identical to SEQ ID NO: 693
  Description of Artificial Sequence: Synthetic oligonucleotide

SEQ ID NO: 3504 - protein, 11 aa, Artificial Sequence
  Description of Artificial Sequence: Synthetic peptide
SGDKLGDKYAC

SEQ ID NO: 3505 - DNA, 33 bp, Artificial Sequence; identical to SEQ ID NO: 3497
  Description of Artificial Sequence: Synthetic oligonucleotide

SEQ ID NO: 3506 - protein, 11 aa, Artificial Sequence
  Description of Artificial Sequence: Synthetic peptide
SGDKLGNKYDY

SEQ ID NO: 3507 - DNA, 33 bp, Artificial Sequence
  Description of Artificial Sequence: Synthetic oligonucleotide
tctggagataaattgggggataaatatgcttgg

SEQ ID NO: 3508 - protein, 11 aa, Artificial Sequence
  Description of Artificial Sequence: Synthetic peptide
SGDKLGDKYAW

SEQ ID NO: 3509 - DNA, 33 bp, Artificial Sequence; identical to SEQ ID NO: 163
  Description of Artificial Sequence: Synthetic oligonucleotide

SEQ ID NO: 3510 - protein, 11 aa, Artificial Sequence
  Description of Artificial Sequence: Synthetic peptide
SGDKLGDKYAY

SEQ ID NO: 3511 - DNA, 33 bp, Artificial Sequence; identical to SEQ ID NO: 3507
  Description of Artificial Sequence: Synthetic oligonucleotide

SEQ ID NO: 3512 - protein, 11 aa, Artificial Sequence
  Description of Artificial Sequence: Synthetic peptide
SGDKLGDKYAW

SEQ ID NO: 3513 - DNA, 33 bp, Artificial Sequence; identical to SEQ ID NO: 701
  Description of Artificial Sequence: Synthetic oligonucleotide

SEQ ID NO: 3514 - protein, 11 aa, Artificial Sequence
  Description of Artificial Sequence: Synthetic peptide
SGDKLGNKYAC

SEQ ID NO: 3515 - DNA, 42 bp, Artificial Sequence
  Description of Artificial Sequence: Synthetic oligonucleotide
ggcttgagctctggctcagtctctactagttactaccccagc

SEQ ID NO: 3516 - protein, 14 aa, Artificial Sequence
  Description of Artificial Sequence: Synthetic peptide
GLSSGSVSTSYYPS

SEQ ID NO: 3517 - DNA, 33 bp, Artificial Sequence; identical to SEQ ID NO: 701
  Description of Artificial Sequence: Synthetic oligonucleotide

SEQ ID NO: 3518 - protein, 11 aa, Artificial Sequence
  Description of Artificial Sequence: Synthetic peptide
SGDKLGNKYAC

SEQ ID NO: 3519 - DNA, 33 bp, Artificial Sequence
  Description of Artificial Sequence: Synthetic oligonucleotide
tctggagatagattggggactaaatttgcttgc

SEQ ID NO: 3520 - protein, 11 aa, Artificial Sequence
  Description of Artificial Sequence: Synthetic peptide
SGDRLGTKFAC

SEQ ID NO: 3521 - DNA, 33 bp, Artificial Sequence; identical to SEQ ID NO: 89
  Description of Artificial Sequence: Synthetic oligonucleotide

SEQ ID NO: 3522 - protein, 11 aa, Artificial Sequence
  Description of Artificial Sequence: Synthetic peptide
SGDKLGNKYVC

SEQ ID NO: 3523 - DNA, 33 bp, Artificial Sequence; identical to SEQ ID NO: 3427
  Description of Artificial Sequence: Synthetic oligonucleotide

SEQ ID NO: 3524 - protein, 11 aa, Artificial Sequence
  Description of Artificial Sequence: Synthetic peptide
SGDRLGDKYAC

SEQ ID NO: 3525 - DNA, 42 bp, Artificial Sequence
  Description of Artificial Sequence: Synthetic oligonucleotide
gcttccagcactgaaacagtcaccagtggttcttatccgaac

SEQ ID NO: 3526 - protein, 14 aa, Artificial Sequence
  Description of Artificial Sequence: Synthetic peptide
ASSTETVTSGSYPN

SEQ ID NO: 3527 - DNA, 33 bp, Artificial Sequence
  Description of Artificial Sequence: Synthetic oligonucleotide
tcaggagataaattggggaataaatatgtttcc

SEQ ID NO: 3528 - protein, 11 aa, Artificial Sequence
  Description of Artificial Sequence: Synthetic peptide
SGDKLGNKYVS

SEQ ID NO: 3529 - DNA, 33 bp, Artificial Sequence; identical to SEQ ID NO: 693
  Description of Artificial Sequence: Synthetic oligonucleotide

SEQ ID NO: 3530 - protein, 11 aa, Artificial Sequence
  Description of Artificial Sequence: Synthetic peptide
SGDKLGDKYAC

SEQ ID NO: 3531 - DNA, 42 bp, Artificial Sequence
  Description of Artificial Sequence: Synthetic oligonucleotide
gcttccagcactggagcagtcaccagtggttactttccaaac

SEQ ID NO: 3532 - protein, 14 aa, Artificial Sequence
  Description of Artificial Sequence: Synthetic peptide
ASSTGAVTSGYFPN

SEQ ID NO: 3533 - DNA, 33 bp, Artificial Sequence; identical to SEQ ID NO: 3527
  Description of Artificial Sequence: Synthetic oligonucleotide

SEQ ID NO: 3534 - protein, 11 aa, Artificial Sequence
  Description of Artificial Sequence: Synthetic peptide
SGDKLGNKYVS

SEQ ID NO: 3535 - DNA, 33 bp, Artificial Sequence; identical to SEQ ID NO: 3299
  Description of Artificial Sequence: Synthetic oligonucleotide

SEQ ID NO: 3536 - protein, 11 aa, Artificial Sequence
  Description of Artificial Sequence: Synthetic peptide
SGDKLGNKYVC

SEQ ID NO: 3537 - DNA, 33 bp, Artificial Sequence; identical to SEQ ID NO: 3519
  Description of Artificial Sequence: Synthetic oligonucleotide

SEQ ID NO: 3538 - protein, 11 aa, Artificial Sequence
  Description of Artificial Sequence: Synthetic peptide
SGDRLGTKFAC

SEQ ID NO: 3539 - DNA, 33 bp, Artificial Sequence; identical to SEQ ID NO: 3313
  Description of Artificial Sequence: Synthetic oligonucleotide

SEQ ID NO: 3540 - protein, 11 aa, Artificial Sequence
  Description of Artificial Sequence: Synthetic peptide
SGDKLGNKYVS

SEQ ID NO: 3541 - DNA, 33 bp, Artificial Sequence
  Description of Artificial Sequence: Synthetic oligonucleotide
tctggaaataaattggggaatagatatgcttgc

SEQ ID NO: 3542 - protein, 11 aa, Artificial Sequence
  Description of Artificial Sequence: Synthetic peptide
SGNKLGNRYAC

SEQ ID NO: 3543 - DNA, 33 bp, Artificial Sequence; identical to SEQ ID NO: 739
  Description of Artificial Sequence: Synthetic oligonucleotide

SEQ ID NO: 3544 - protein, 11 aa, Artificial Sequence
  Description of Artificial Sequence: Synthetic peptide
SGDKLGDKYVC

SEQ ID NO: 3545 - DNA, 33 bp, Artificial Sequence; identical to SEQ ID NO: 693
  Description of Artificial Sequence: Synthetic oligonucleotide

SEQ ID NO: 3546 - protein, 11 aa, Artificial Sequence
  Description of Artificial Sequence: Synthetic peptide
SGDKLGDKYAC

SEQ ID NO: 3547 - DNA, 33 bp, Artificial Sequence; identical to SEQ ID NO: 709
  Description of Artificial Sequence: Synthetic oligonucleotide

SEQ ID NO: 3548 - protein, 11 aa, Artificial Sequence
  Description of Artificial Sequence: Synthetic peptide
SGDKLGEKYAC

SEQ ID NO: 3549 - DNA, 33 bp, Artificial Sequence; identical to SEQ ID NO: 3401
  Description of Artificial Sequence: Synthetic oligonucleotide

SEQ ID NO: 3550 - protein, 11 aa, Artificial Sequence
  Description of Artificial Sequence: Synthetic peptide
SGDKLGDKYAC

SEQ ID NO: 3551 - DNA, 42 bp, Artificial Sequence
  Description of Artificial Sequence: Synthetic oligonucleotide
ggcttgagctctggctcagtctctactactttctaccccagc

SEQ ID NO: 3552 - protein, 14 aa, Artificial Sequence
  Description of Artificial Sequence: Synthetic peptide
GLSSGSVSTTFYPS

SEQ ID NO: 3553 - DNA, 33 bp, Artificial Sequence; identical to SEQ ID NO: 3271
  Description of Artificial Sequence: Synthetic oligonucleotide

SEQ ID NO: 3554 - protein, 11 aa, Artificial Sequence
  Description of Artificial Sequence: Synthetic peptide
SGDKLGDKFAC

SEQ ID NO: 3555 - DNA, 33 bp, Artificial Sequence; identical to SEQ ID NO: 693
  Description of Artificial Sequence: Synthetic oligonucleotide

SEQ ID NO: 3556 - protein, 11 aa, Artificial Sequence
  Description of Artificial Sequence: Synthetic peptide
SGDKLGDKYAC

SEQ ID NO: 3557 - DNA, 33 bp, Artificial Sequence
  Description of Artificial Sequence: Synthetic oligonucleotide
tctggagataaattggggcataaatttgtttgc

SEQ ID NO: 3558 - protein, 11 aa, Artificial Sequence
  Description of Artificial Sequence: Synthetic peptide
SGDKLGHKFVC

SEQ ID NO: 3559 - DNA, 33 bp, Artificial Sequence
  Description of Artificial Sequence: Synthetic oligonucleotide
tctggagataaaatgggggaaaaatatgcttgc

SEQ ID NO: 3560 - protein, 11 aa, Artificial Sequence
  Description of Artificial Sequence: Synthetic peptide
SGDKMGEKYAC

SEQ ID NO: 3561 - DNA, 42 bp, Artificial Sequence
  Description of Artificial Sequence: Synthetic oligonucleotide
gcttccagcactggagcagtcaccagtggttcctatccaaac

SEQ ID NO: 3562 - protein, 14 aa, Artificial Sequence
  Description of Artificial Sequence: Synthetic peptide
ASSTGAVTSGSYPN

SEQ ID NO: 3563 - DNA, 39 bp, Artificial Sequence
  Description of Artificial Sequence: Synthetic oligonucleotide
tctggaagcagctccaacattgggagtaattatgtttcc

SEQ ID NO: 3564 - protein, 13 aa, Artificial Sequence
  Description of Artificial Sequence: Synthetic peptide
SGSSSNIGSNYVS

SEQ ID NO: 3565 - DNA, 33 bp, Artificial Sequence
  Description of Artificial Sequence: Synthetic oligonucleotide
tctggagataaattgggggatagatttgcttac

SEQ ID NO: 3566 - protein, 11 aa, Artificial Sequence
  Description of Artificial Sequence: Synthetic peptide
SGDKLGDRFAY

SEQ ID NO: 3567 - DNA, 33 bp, Artificial Sequence
  Description of Artificial Sequence: Synthetic oligonucleotide
caaggagacaaactcagaacctattatgcaagc

SEQ ID NO: 3568 - protein, 11 aa, Artificial Sequence
  Description of Artificial Sequence: Synthetic peptide
QGDKLRTYYAS

SEQ ID NO: 3569 - DNA, 39 bp, Artificial Sequence
  Description of Artificial Sequence: Synthetic oligonucleotide
tctggaagcagctccaacattggaaataattatgtatcc

SEQ ID NO: 3570 - protein, 13 aa, Artificial Sequence
  Description of Artificial Sequence: Synthetic peptide
SGSSSNIGNNYVS

SEQ ID NO: 3571 - DNA, 39 bp, Artificial Sequence; identical to SEQ ID NO: 3461
  Description of Artificial Sequence: Synthetic oligonucleotide

SEQ ID NO: 3572 - protein, 13 aa, Artificial Sequence
  Description of Artificial Sequence: Synthetic peptide
SGSSSNIGNNYVS

SEQ ID NO: 3573 - DNA, 33 bp, Artificial Sequence
  Description of Artificial Sequence: Synthetic oligonucleotide
caaggagacaccctcagaccctattatgtaagc

SEQ ID NO: 3574 - protein, 11 aa, Artificial Sequence
  Description of Artificial Sequence: Synthetic peptide
QGDTLRPYYVS

SEQ ID NO: 3575 - DNA, 39 bp, Artificial Sequence
  Description of Artificial Sequence: Synthetic oligonucleotide
tctggaggcagctccaacattgggaataattatgtatcc

SEQ ID NO: 3576 - protein, 13 aa, Artificial Sequence
  Description of Artificial Sequence: Synthetic peptide
SGGSSNIGNNYVS

SEQ ID NO: 3577 - DNA, 39 bp, Artificial Sequence; identical to SEQ ID NO: 3563
  Description of Artificial Sequence: Synthetic oligonucleotide

SEQ ID NO: 3578 - protein, 13 aa, Artificial Sequence
  Description of Artificial Sequence: Synthetic peptide
SGSSSNIGSNYVS

SEQ ID NO: 3579 - DNA, 39 bp, Artificial Sequence
  Description of Artificial Sequence: Synthetic oligonucleotide
tctggaagcagctccaacattgggaatcattatgtctcc

SEQ ID NO: 3580 - protein, 13 aa, Artificial Sequence
  Description of Artificial Sequence: Synthetic peptide
SGSSSNIGNHYVS

SEQ ID NO: 3581 - DNA, 33 bp, Artificial Sequence; identical to SEQ ID NO: 3565
  Description of Artificial Sequence: Synthetic oligonucleotide

SEQ ID NO: 3582 - protein, 11 aa, Artificial Sequence
  Description of Artificial Sequence: Synthetic peptide
SGDKLGDRFAY

SEQ ID NO: 3583 - DNA, 33 bp, Artificial Sequence
  Description of Artificial Sequence: Synthetic oligonucleotide
caaggagacagcctcagaccctattatgcaagc

SEQ ID NO: 3584 - protein, 11 aa, Artificial Sequence
  Description of Artificial Sequence: Synthetic peptide
QGDSLRPYYAS

SEQ ID NO: 3585 - DNA, 39 bp, Artificial Sequence; identical to SEQ ID NO: 3563
  Description of Artificial Sequence: Synthetic oligonucleotide

SEQ ID NO: 3586 - protein, 13 aa, Artificial Sequence
  Description of Artificial Sequence: Synthetic peptide
SGSSSNIGSNYVS

SEQ ID NO: 3587 - DNA, 42 bp, Artificial Sequence
  Description of Artificial Sequence: Synthetic oligonucleotide
gtttttagcactggagcagtcaccagtggttcctttccaaac

SEQ ID NO: 3588 - protein, 14 aa, Artificial Sequence
  Description of Artificial Sequence: Synthetic peptide
VFSTGAVTSGSFPN

SEQ ID NO: 3589 - DNA, 39 bp, Artificial Sequence
  Description of Artificial Sequence: Synthetic oligonucleotide
tctggaagcagctccaaccttggaaataattttgtatcc

SEQ ID NO: 3590 - protein, 13 aa, Artificial Sequence
  Description of Artificial Sequence: Synthetic peptide
SGSSSNLGNNFVS

SEQ ID NO: 3591 - DNA, 42 bp, Artificial Sequence
  Description of Artificial Sequence: Synthetic oligonucleotide
gttcttagcactggagcagtcaccagtggttcctttccaaac

SEQ ID NO: 3592 - protein, 14 aa, Artificial Sequence
  Description of Artificial Sequence: Synthetic peptide
VLSTGAVTSGSFPN

SEQ ID NO: 3593 - DNA, 33 bp, Artificial Sequence
  Description of Artificial Sequence: Synthetic oligonucleotide
caaggagacaccctcagaccctattatgcaagt

SEQ ID NO: 3594 - protein, 11 aa, Artificial Sequence
  Description of Artificial Sequence: Synthetic peptide
QGDTLRPYYAS

SEQ ID NO: 3595 - DNA, 33 bp, Artificial Sequence; identical to SEQ ID NO: 3583
  Description of Artificial Sequence: Synthetic oligonucleotide

SEQ ID NO: 3596 - protein, 11 aa, Artificial Sequence
  Description of Artificial Sequence: Synthetic peptide
QGDSLRPYYAS

SEQ ID NO: 3597 - DNA, 39 bp, Artificial Sequence
  Description of Artificial Sequence: Synthetic oligonucleotide
tctggaagcagctccaacatcgggaataattatgtatcc

SEQ ID NO: 3598 - protein, 13 aa, Artificial Sequence
  Description of Artificial Sequence: Synthetic peptide
SGSSSNIGNNYVS

SEQ ID NO: 3599 - DNA, 42 bp, Artificial Sequence
  Description of Artificial Sequence: Synthetic oligonucleotide
accttacgcagtggcatcaatgttggtacctacaggatatac

SEQ ID NO: 3600 - protein, 14 aa, Artificial Sequence
  Description of Artificial Sequence: Synthetic peptide
TLRSGINVGTYRIY

SEQ ID NO: 3601 - DNA, 42 bp, Artificial Sequence
  Description of Artificial Sequence: Synthetic oligonucleotide
gcttccagcactggagcagtcaccagtgcttactatccaaac

SEQ ID NO: 3602 - protein, 14 aa, Artificial Sequence
  Description of Artificial Sequence: Synthetic peptide
ASSTGAVTSAYYPN

SEQ ID NO: 3603 - DNA, 39 bp, Artificial Sequence; identical to SEQ ID NO: 3461
  Description of Artificial Sequence: Synthetic oligonucleotide

SEQ ID NO: 3604 - protein, 13 aa, Artificial Sequence
  Description of Artificial Sequence: Synthetic peptide
SGSSSNIGNNYVS

SEQ ID NO: 3605 - DNA, 42 bp, Artificial Sequence
  Description of Artificial Sequence: Synthetic oligonucleotide
gctttcagcactggatcagtcaccagtggttcctatccaaac

SEQ ID NO: 3606 - protein, 14 aa, Artificial Sequence
  Description of Artificial Sequence: Synthetic peptide
AFSTGSVTSGSYPN

SEQ ID NO: 3607 - DNA, 39 bp, Artificial Sequence; identical to SEQ ID NO: 153
  Description of Artificial Sequence: Synthetic oligonucleotide

SEQ ID NO: 3608 - protein, 13 aa, Artificial Sequence
  Description of Artificial Sequence: Synthetic peptide
SGSSSNIGSNTVN

SEQ ID NO: 3609 - DNA, 42 bp, Artificial Sequence
  Description of Artificial Sequence: Synthetic oligonucleotide
gcttccagcactggagcagtcaccagtggtaactatccacag

SEQ ID NO: 3610 - protein, 14 aa, Artificial Sequence
  Description of Artificial Sequence: Synthetic peptide
ASSTGAVTSGNYPQ

SEQ ID NO: 3611 - DNA, 42 bp, Artificial Sequence
  Description of Artificial Sequence: Synthetic oligonucleotide
gctttcagcactggaacagtcaccagtggtttctatccaaac

SEQ ID NO: 3612 - protein, 14 aa, Artificial Sequence
  Description of Artificial Sequence: Synthetic peptide
AFSTGTVTSGFYPN

SEQ ID NO: 3613 - DNA, 33 bp, Artificial Sequence
  Description of Artificial Sequence: Synthetic oligonucleotide
caaggagacagcctcagaagctattatgcaaac

SEQ ID NO: 3614 - protein, 11 aa, Artificial Sequence
  Description of Artificial Sequence: Synthetic peptide
QGDSLRSYYAN

SEQ ID NO: 3615 - DNA, 33 bp, Artificial Sequence
  Description of Artificial Sequence: Synthetic oligonucleotide
tctggagataaattgggggatagatttgcttgc

SEQ ID NO: 3616 - protein, 11 aa, Artificial Sequence
  Description of Artificial Sequence: Synthetic peptide
SGDKLGDRFAC

SEQ ID NO: 3617 - DNA, 39 bp, Artificial Sequence
  Description of Artificial Sequence: Synthetic oligonucleotide
ttcggaggcagctccaacattgggaataattatgtatcc

SEQ ID NO: 3618 - protein, 13 aa, Artificial Sequence
  Description of Artificial Sequence: Synthetic peptide
FGGSSNIGNNYVS

SEQ ID NO: 3619 - DNA, 42 bp, Artificial Sequence
  Description of Artificial Sequence: Synthetic oligonucleotide
gcttccagcactggagcagtcaccagtggtaactatccaaac

SEQ ID NO: 3620 - protein, 14 aa, Artificial Sequence
  Description of Artificial Sequence: Synthetic peptide
ASSTGAVTSGNYPN

SEQ ID NO: 3621 - DNA, 39 bp, Artificial Sequence; identical to SEQ ID NO: 3461
  Description of Artificial Sequence: Synthetic oligonucleotide

SEQ ID NO: 3622 - protein, 13 aa, Artificial Sequence
  Description of Artificial Sequence: Synthetic peptide
SGSSSNIGNNYVS

SEQ ID NO: 3623 - DNA, 42 bp, Artificial Sequence
  Description of Artificial Sequence: Synthetic oligonucleotide
gcttccagcactggagcagtcaccagtggttcctttccaagc

SEQ ID NO: 3624 - protein, 14 aa, Artificial Sequence
  Description of Artificial Sequence: Synthetic peptide
ASSTGAVTSGSFPS

SEQ ID NO: 3625 - DNA, 39 bp, Artificial Sequence; identical to SEQ ID NO: 3461
  Description of Artificial Sequence: Synthetic oligonucleotide

SEQ ID NO: 3626 - protein, 13 aa, Artificial Sequence
  Description of Artificial Sequence: Synthetic peptide
SGSSSNIGNNYVS

SEQ ID NO: 3627 - DNA, 33 bp, Artificial Sequence
  Description of Artificial Sequence: Synthetic oligonucleotide
tctggagataaattggggtatagatctgtttgc

SEQ ID NO: 3628 - protein, 11 aa, Artificial Sequence
  Description of Artificial Sequence: Synthetic peptide
SGDKLGYRSVC

SEQ ID NO: 3629 - DNA, 39 bp, Artificial Sequence
  Description of Artificial Sequence: Synthetic oligonucleotide
tctggaagcagctccaacatcggaagtcatactgtaaac

SEQ ID NO: 3630 - protein, 13 aa, Artificial Sequence
  Description of Artificial Sequence: Synthetic peptide
SGSSSNIGSHTVN

SEQ ID NO: 3631 - DNA, 33 bp, Artificial Sequence
  Description of Artificial Sequence: Synthetic oligonucleotide
tcaggagataaattggggaataaatatgcttac

SEQ ID NO: 3632 - protein, 11 aa, Artificial Sequence
  Description of Artificial Sequence: Synthetic peptide
SGDKLGNKYAY

SEQ ID NO: 3633 - DNA, 39 bp, Artificial Sequence; identical to SEQ ID NO: 3575
  Description of Artificial Sequence: Synthetic oligonucleotide

SEQ ID NO: 3634 - protein, 13 aa, Artificial Sequence
  Description of Artificial Sequence: Synthetic peptide
SGGSSNIGNNYVS

SEQ ID NO: 3635 - DNA, 42 bp, Artificial Sequence; identical to SEQ ID NO: 3601
  Description of Artificial Sequence: Synthetic oligonucleotide

SEQ ID NO: 3636 - protein, 14 aa, Artificial Sequence
  Description of Artificial Sequence: Synthetic peptide
ASSTGAVTSAYYPN

SEQ ID NO: 3637 - DNA, 39 bp, Artificial Sequence
  Description of Artificial Sequence: Synthetic oligonucleotide
tctggaagcagctccaacattgggaataaatatgtatcc

SEQ ID NO: 3638 - protein, 13 aa, Artificial Sequence
  Description of Artificial Sequence: Synthetic peptide
SGSSSNIGNKYVS

SEQ ID NO: 3639 - DNA, 39 bp, Artificial Sequence; identical to SEQ ID NO: 153
  Description of Artificial Sequence: Synthetic oligonucleotide

SEQ ID NO: 3640 - protein, 13 aa, Artificial Sequence
  Description of Artificial Sequence: Synthetic peptide
SGSSSNIGSNTVN

SEQ ID NO: 3641 - DNA, 42 bp, Artificial Sequence; identical to SEQ ID NO: 3605
  Description of Artificial Sequence: Synthetic oligonucleotide

SEQ ID NO: 3642 - protein, 14 aa, Artificial Sequence
  Description of Artificial Sequence: Synthetic peptide
AFSTGSVTSGSYPN

SEQ ID NO: 3643 - DNA, 42 bp, Artificial Sequence; identical to SEQ ID NO: 3601
  Description of Artificial Sequence: Synthetic oligonucleotide

SEQ ID NO: 3644 - protein, 14 aa, Artificial Sequence
  Description of Artificial Sequence: Synthetic peptide
ASSTGAVTSAYYPN

SEQ ID NO: 3645 - DNA, 39 bp, Artificial Sequence
  Description of Artificial Sequence: Synthetic oligonucleotide
tctggaagcagctccaacatcgggaataattatatatcc

SEQ ID NO: 3646 - protein, 13 aa, Artificial Sequence
  Description of Artificial Sequence: Synthetic peptide
SGSSSNIGNNYIS

SEQ ID NO: 3647 - DNA, 42 bp, Artificial Sequence; identical to SEQ ID NO: 3591
  Description of Artificial Sequence: Synthetic oligonucleotide

SEQ ID NO: 3648 - protein, 14 aa, Artificial Sequence
  Description of Artificial Sequence: Synthetic peptide
VLSTGAVTSGSFPN

SEQ ID NO: 3649 - DNA, 39 bp, Artificial Sequence; identical to SEQ ID NO: 3461
  Description of Artificial Sequence: Synthetic oligonucleotide

SEQ ID NO: 3650 - protein, 13 aa, Artificial Sequence
  Description of Artificial Sequence: Synthetic peptide
SGSSSNIGNNYVS

SEQ ID NO: 3651 - DNA, 39 bp, Artificial Sequence; identical to SEQ ID NO: 153
  Description of Artificial Sequence: Synthetic oligonucleotide

SEQ ID NO: 3652 - protein, 13 aa, Artificial Sequence
  Description of Artificial Sequence: Synthetic peptide
SGSSSNIGSNTVN

SEQ ID NO: 3653 - DNA, 42 bp, Artificial Sequence
  Description of Artificial Sequence: Synthetic oligonucleotide
gcttccaacactggagcagtcaccagtggttcctatccaaac

SEQ ID NO: 3654 - protein, 14 aa, Artificial Sequence
  Description of Artificial Sequence: Synthetic peptide
ASNTGAVTSGSYPN

SEQ ID NO: 3655 - DNA, 39 bp, Artificial Sequence; identical to SEQ ID NO: 3589
  Description of Artificial Sequence: Synthetic oligonucleotide

SEQ ID NO: 3656 - protein, 13 aa, Artificial Sequence
  Description of Artificial Sequence: Synthetic peptide
SGSSSNLGNNFVS

SEQ ID NO: 3657 - DNA, 42 bp, Artificial Sequence
  Description of Artificial Sequence: Synthetic oligonucleotide
gcttccaacactggagcagtcaccagtggttcctatccaaat

SEQ ID NO: 3658 - protein, 14 aa, Artificial Sequence
  Description of Artificial Sequence: Synthetic peptide
ASNTGAVTSGSYPN

SEQ ID NO: 3659 - DNA, 42 bp, Artificial Sequence
  Description of Artificial Sequence: Synthetic oligonucleotide
gcttccagcactggagcagtcaccagtggttactatccaaac

SEQ ID NO: 3660 - protein, 14 aa, Artificial Sequence
  Description of Artificial Sequence: Synthetic peptide
ASSTGAVTSGYYPN

SEQ ID NO: 3661 - DNA, 33 bp, Artificial Sequence; identical to SEQ ID NO: 3615
  Description of Artificial Sequence: Synthetic oligonucleotide

SEQ ID NO: 3662 - protein, 11 aa, Artificial Sequence
  Description of Artificial Sequence: Synthetic peptide
SGDKLGDRFAC

SEQ ID NO: 3663 - DNA, 33 bp, Artificial Sequence
  Description of Artificial Sequence: Synthetic oligonucleotide
gggggaaacaacattggaagaaaaaatgtgcac

SEQ ID NO: 3664 - protein, 11 aa, Artificial Sequence
  Description of Artificial Sequence: Synthetic peptide
GGNNIGRKNVH

SEQ ID NO: 3665 - DNA, 33 bp, Artificial Sequence; identical to SEQ ID NO: 3615
  Description of Artificial Sequence: Synthetic oligonucleotide

SEQ ID NO: 3666 - protein, 11 aa, Artificial Sequence
  Description of Artificial Sequence: Synthetic peptide
SGDKLGDRFAC

SEQ ID NO: 3667 - DNA, 33 bp, Artificial Sequence; identical to SEQ ID NO: 3663
  Description of Artificial Sequence: Synthetic oligonucleotide

SEQ ID NO: 3668 - protein, 11 aa, Artificial Sequence
  Description of Artificial Sequence: Synthetic peptide
GGNNIGRKNVH

SEQ ID NO: 3669 - DNA, 33 bp, Artificial Sequence; identical to SEQ ID NO: 3663
  Description of Artificial Sequence: Synthetic oligonucleotide

SEQ ID NO: 3670 - protein, 11 aa, Artificial Sequence
  Description of Artificial Sequence: Synthetic peptide
GGNNIGRKNVH

SEQ ID NO: 3671 - DNA, 39 bp, Artificial Sequence
  Description of Artificial Sequence: Synthetic oligonucleotide
tctggaagcagctccaacattgggagtaattttttatcc

SEQ ID NO: 3672 - protein, 13 aa, Artificial Sequence
  Description of Artificial Sequence: Synthetic peptide
SGSSSNIGSNFLS

SEQ ID NO: 3673 - DNA, 33 bp, Artificial Sequence; identical to SEQ ID NO: 3663
  Description of Artificial Sequence: Synthetic oligonucleotide

SEQ ID NO: 3674 - protein, 11 aa, Artificial Sequence
  Description of Artificial Sequence: Synthetic peptide
GGNNIGRKNVH

SEQ ID NO: 3675 - DNA, 42 bp, Artificial Sequence
  Description of Artificial Sequence: Synthetic oligonucleotide
gctttcagcactggagcagtcaccagtggtaattatccaaac

SEQ ID NO: 3676 - protein, 14 aa, Artificial Sequence
  Description of Artificial Sequence: Synthetic peptide
AFSTGAVTSGNYPN

SEQ ID NO: 3677 - DNA, 42 bp, Artificial Sequence; identical to SEQ ID NO: 183
  Description of Artificial Sequence: Synthetic oligonucleotide

SEQ ID NO: 3678 - protein, 14 aa, Artificial Sequence
  Description of Artificial Sequence: Synthetic peptide
TGTSSDVGGYNYVS

SEQ ID NO: 3679 - DNA, 42 bp, Artificial Sequence
  Description of Artificial Sequence: Synthetic oligonucleotide
actggaaccagcagtgacgttggtggttataattatgtctcc

SEQ ID NO: 3680 - protein, 14 aa, Artificial Sequence
  Description of Artificial Sequence: Synthetic peptide
TGTSSDVGGYNYVS

SEQ ID NO: 3681 - DNA, 42 bp, Artificial Sequence; identical to SEQ ID NO: 183
  Description of Artificial Sequence: Synthetic oligonucleotide

SEQ ID NO: 3682 - protein, 14 aa, Artificial Sequence
  Description of Artificial Sequence: Synthetic peptide
TGTSSDVGGYNYVS

SEQ ID NO: 3683 - DNA, 42 bp, Artificial Sequence
  Description of Artificial Sequence: Synthetic oligonucleotide
actggaaccagtagtgacgttggtagttataactatgtctcc

SEQ ID NO: 3684 - protein, 14 aa, Artificial Sequence
  Description of Artificial Sequence: Synthetic peptide
TGTSSDVGSYNYVS

SEQ ID NO: 3685 - DNA, 33 bp, Artificial Sequence
  Description of Artificial Sequence: Synthetic oligonucleotide
gggggaaacaacattggacgtagaaatgtgcac

SEQ ID NO: 3686 - protein, 11 aa, Artificial Sequence
  Description of Artificial Sequence: Synthetic peptide
GGNNIGRRNVH

SEQ ID NO: 3687 - DNA, 33 bp, Artificial Sequence
  Description of Artificial Sequence: Synthetic oligonucleotide
tctggagatgcattgccaaagcaatatgcttat

SEQ ID NO: 3688 - protein, 11 aa, Artificial Sequence
  Description of Artificial Sequence: Synthetic peptide
SGDALPKQYAY

SEQ ID NO: 3689 - DNA, 42 bp, Artificial Sequence; identical to SEQ ID NO: 183
  Description of Artificial Sequence: Synthetic oligonucleotide

SEQ ID NO: 3690 - protein, 14 aa, Artificial Sequence
  Description of Artificial Sequence: Synthetic peptide
TGTSSDVGGYNYVS

SEQ ID NO: 3691 - DNA, 42 bp, Artificial Sequence
  Description of Artificial Sequence: Synthetic oligonucleotide
gctttcagcactggagcagtcaccagtggtaactatccaagt

SEQ ID NO: 3692 - protein, 14 aa, Artificial Sequence
  Description of Artificial Sequence: Synthetic peptide
AFSTGAVTSGNYPS

SEQ ID NO: 3693 - DNA, 42 bp, Artificial Sequence
  Description of Artificial Sequence: Synthetic oligonucleotide
ggttccagcactggatcagtcaccagtggttactttccaaac

SEQ ID NO: 3694 - protein, 14 aa, Artificial Sequence
  Description of Artificial Sequence: Synthetic peptide
GSSTGSVTSGYFPN

SEQ ID NO: 3695 - DNA, 42 bp, Artificial Sequence; identical to SEQ ID NO: 3619
  Description of Artificial Sequence: Synthetic oligonucleotide

SEQ ID NO: 3696 - protein, 14 aa, Artificial Sequence
  Description of Artificial Sequence: Synthetic peptide
ASSTGAVTSGNYPN

SEQ ID NO: 3697 - DNA, 42 bp, Artificial Sequence; identical to SEQ ID NO: 183
  Description of Artificial Sequence: Synthetic oligonucleotide

SEQ ID NO: 3698 - protein, 14 aa, Artificial Sequence
  Description of Artificial Sequence: Synthetic peptide
TGTSSDVGGYNYVS

SEQ ID NO: 3699 - DNA, 42 bp, Artificial Sequence; identical to SEQ ID NO: 183
  Description of Artificial Sequence: Synthetic oligonucleotide

SEQ ID NO: 3700 - protein, 14 aa, Artificial Sequence
  Description of Artificial Sequence: Synthetic peptide
TGTSSDVGGYNYVS

SEQ ID NO: 3701 - DNA, 42 bp, Artificial Sequence
  Description of Artificial Sequence: Synthetic oligonucleotide
actggaaccagtagtgacgttggtggttataactatgtctcc

SEQ ID NO: 3702 - protein, 14 aa, Artificial Sequence
  Description of Artificial Sequence: Synthetic peptide
TGTSSDVGGYNYVS

SEQ ID NO: 3703 - DNA, 42 bp, Artificial Sequence; identical to SEQ ID NO: 3679
  Description of Artificial Sequence: Synthetic oligonucleotide

SEQ ID NO: 3704 - protein, 14 aa, Artificial Sequence
  Description of Artificial Sequence: Synthetic peptide
TGTSSDVGGYNYVS

SEQ ID NO: 3705 - DNA, 42 bp, Artificial Sequence; identical to SEQ ID NO: 3659
  Description of Artificial Sequence: Synthetic oligonucleotide

SEQ ID NO: 3706 - protein, 14 aa, Artificial Sequence
  Description of Artificial Sequence: Synthetic peptide
ASSTGAVTSGYYPN

SEQ ID NO: 3707 - DNA, 42 bp, Artificial Sequence; identical to SEQ ID NO: 3659
  Description of Artificial Sequence: Synthetic oligonucleotide

SEQ ID NO: 3708 - protein, 14 aa, Artificial Sequence
  Description of Artificial Sequence: Synthetic peptide
ASSTGAVTSGYYPN

SEQ ID NO: 3709 - DNA, 42 bp, Artificial Sequence; identical to SEQ ID NO: 183
  Description of Artificial Sequence: Synthetic oligonucleotide

SEQ ID NO: 3710 - protein, 14 aa, Artificial Sequence
  Description of Artificial Sequence: Synthetic peptide
TGTSSDVGGYNYVS

SEQ ID NO: 3711 - DNA, 42 bp, Artificial Sequence; identical to SEQ ID NO: 183
  Description of Artificial Sequence: Synthetic oligonucleotide

SEQ ID NO: 3712 - protein, 14 aa, Artificial Sequence
  Description of Artificial Sequence: Synthetic peptide
TGTSSDVGGYNYVS

SEQ ID NO: 3713 - DNA, 42 bp, Artificial Sequence; identical to SEQ ID NO: 3693
  Description of Artificial Sequence: Synthetic oligonucleotide

SEQ ID NO: 3714 - protein, 14 aa, Artificial Sequence
  Description of Artificial Sequence: Synthetic peptide
GSSTGSVTSGYFPN

SEQ ID NO: 3715 - DNA, 42 bp, Artificial Sequence; identical to SEQ ID NO: 183
  Description of Artificial Sequence: Synthetic oligonucleotide

SEQ ID NO: 3716 - protein, 14 aa, Artificial Sequence
  Description of Artificial Sequence: Synthetic peptide
TGTSSDVGGYNYVS

SEQ ID NO: 3717 - DNA, 42 bp, Artificial Sequence; identical to SEQ ID NO: 3659
  Description of Artificial Sequence: Synthetic oligonucleotide

SEQ ID NO: 3718 - protein, 14 aa, Artificial Sequence
  Description of Artificial Sequence: Synthetic peptide
ASSTGAVTSGYYPN

SEQ ID NO: 3719 - DNA, 39 bp, Artificial Sequence; identical to SEQ ID NO: 3461
  Description of Artificial Sequence: Synthetic oligonucleotide

SEQ ID NO: 3720 - protein, 13 aa, Artificial Sequence
  Description of Artificial Sequence: Synthetic peptide
SGSSSNIGNNYVS

SEQ ID NO: 3721 - DNA, 42 bp, Artificial Sequence
  Description of Artificial Sequence: Synthetic oligonucleotide
gcttccagcactggagcagtcaccagtggctactatccaaac

SEQ ID NO: 3722 - protein, 14 aa, Artificial Sequence
  Description of Artificial Sequence: Synthetic peptide
ASSTGAVTSGYYPN

SEQ ID NO: 3723 - DNA, 42 bp, Artificial Sequence
  Description of Artificial Sequence: Synthetic oligonucleotide
gcttccagcactgaagccgtcaccagtggtaactatccaagc

SEQ ID NO: 3724 - protein, 14 aa, Artificial Sequence
  Description of Artificial Sequence: Synthetic peptide
ASSTEAVTSGNYPS

SEQ ID NO: 3725 - DNA, 33 bp, Artificial Sequence; identical to SEQ ID NO: 3271
  Description of Artificial Sequence: Synthetic oligonucleotide

SEQ ID NO: 3726 - protein, 11 aa, Artificial Sequence
  Description of Artificial Sequence: Synthetic peptide
SGDKLGDKFAC

SEQ ID NO: 3727 - DNA, 42 bp, Artificial Sequence
  Description of Artificial Sequence: Synthetic oligonucleotide
actggaaccagcagtgacattggtggttataactatgtctcc

SEQ ID NO: 3728 - protein, 14 aa, Artificial Sequence
  Description of Artificial Sequence: Synthetic peptide
TGTSSDIGGYNYVS

SEQ ID NO: 3729 - DNA, 42 bp, Artificial Sequence; identical to SEQ ID NO: 3659
  Description of Artificial Sequence: Synthetic oligonucleotide

SEQ ID NO: 3730 - protein, 14 aa, Artificial Sequence
  Description of Artificial Sequence: Synthetic peptide
ASSTGAVTSGYYPN

SEQ ID NO: 3731 - DNA, 42 bp, Artificial Sequence; identical to SEQ ID NO: 3679
  Description of Artificial Sequence: Synthetic oligonucleotide

SEQ ID NO: 3732 - protein, 14 aa, Artificial Sequence
  Description of Artificial Sequence: Synthetic peptide
TGTSSDVGGYNYVS

SEQ ID NO: 3733 - DNA, 42 bp, Artificial Sequence; identical to SEQ ID NO: 3659
  Description of Artificial Sequence: Synthetic oligonucleotide

SEQ ID NO: 3734 - protein, 14 aa, Artificial Sequence
  Description of Artificial Sequence: Synthetic peptide
ASSTGAVTSGYYPN

SEQ ID NO: 3735 - DNA, 42 bp, Artificial Sequence; identical to SEQ ID NO: 3721
  Description of Artificial Sequence: Synthetic oligonucleotide

SEQ ID NO: 3736 - protein, 14 aa, Artificial Sequence
  Description of Artificial Sequence: Synthetic peptide
ASSTGAVTSGYYPN

SEQ ID NO: 3737 - DNA, 33 bp, Artificial Sequence
  Description of Artificial Sequence: Synthetic oligonucleotide
gggggagacaacattagaagaagaaatgtgcac

SEQ ID NO: 3738 - protein, 11 aa, Artificial Sequence
  Description of Artificial Sequence: Synthetic peptide
GGDNIRRRNVH

SEQ ID NO: 3739 - DNA, 42 bp, Artificial Sequence; identical to SEQ ID NO: 183
  Description of Artificial Sequence: Synthetic oligonucleotide

SEQ ID NO: 3740 - protein, 14 aa, Artificial Sequence
  Description of Artificial Sequence: Synthetic peptide
TGTSSDVGGYNYVS

SEQ ID NO: 3741 - DNA, 33 bp, Artificial Sequence; identical to SEQ ID NO: 3687
  Description of Artificial Sequence: Synthetic oligonucleotide

SEQ ID NO: 3742 - protein, 11 aa, Artificial Sequence
  Description of Artificial Sequence: Synthetic peptide
SGDALPKQYAY

SEQ ID NO: 3743 - DNA, 33 bp, Artificial Sequence
  Description of Artificial Sequence: Synthetic oligonucleotide
tctggagatgcattgccaaaacaatatgcttat

SEQ ID NO: 3744 - protein, 11 aa, Artificial Sequence
  Description of Artificial Sequence: Synthetic peptide
SGDALPKQYAY

SEQ ID NO: 3745 - DNA, 39 bp, Artificial Sequence; identical to SEQ ID NO: 3461
  Description of Artificial Sequence: Synthetic oligonucleotide

SEQ ID NO: 3746 - protein, 13 aa, Artificial Sequence
  Description of Artificial Sequence: Synthetic peptide
SGSSSNIGNNYVS

SEQ ID NO: 3747 - DNA, 33 bp, Artificial Sequence
  Description of Artificial Sequence: Synthetic oligonucleotide
tctagagatgtattgccgaagcaatatgcttat

SEQ ID NO: 3748 - protein, 11 aa, Artificial Sequence
  Description of Artificial Sequence: Synthetic peptide
SRDVLPKQYAY

SEQ ID NO: 3749 - DNA, 42 bp, Artificial Sequence; identical to SEQ ID NO: 3679
  Description of Artificial Sequence: Synthetic oligonucleotide

SEQ ID NO: 3750 - protein, 14 aa, Artificial Sequence
  Description of Artificial Sequence: Synthetic peptide
TGTSSDVGGYNYVS

SEQ ID NO: 3751 - DNA, 42 bp, Artificial Sequence; identical to SEQ ID NO: 183
  Description of Artificial Sequence: Synthetic oligonucleotide

SEQ ID NO: 3752 - protein, 14 aa, Artificial Sequence
  Description of Artificial Sequence: Synthetic peptide
TGTSSDVGGYNYVS

SEQ ID NO: 3753 - DNA, 42 bp, Artificial Sequence; identical to SEQ ID NO: 183
  Description of Artificial Sequence: Synthetic oligonucleotide

SEQ ID NO: 3754 - protein, 14 aa, Artificial Sequence
  Description of Artificial Sequence: Synthetic peptide
TGTSSDVGGYNYVS

SEQ ID NO: 3755 - DNA, 33 bp, Artificial Sequence
  Description of Artificial Sequence: Synthetic oligonucleotide
tctggagataatttgggggttaaatatacttac

SEQ ID NO: 3756 - protein, 11 aa, Artificial Sequence
  Description of Artificial Sequence: Synthetic peptide
SGDNLGVKYTY

SEQ ID NO: 3757 - DNA, 42 bp, Artificial Sequence
  Description of Artificial Sequence: Synthetic oligonucleotide
actgggagcagctccaacatcggggcaggttatgatgtacac

SEQ ID NO: 3758 - protein, 14 aa, Artificial Sequence
  Description of Artificial Sequence: Synthetic peptide
TGSSSNIGAGYDVH

SEQ ID NO: 3759 - DNA, 33 bp, Artificial Sequence; identical to SEQ ID NO: 701
  Description of Artificial Sequence: Synthetic oligonucleotide

SEQ ID NO: 3760 - protein, 11 aa, Artificial Sequence
  Description of Artificial Sequence: Synthetic peptide
SGDKLGNKYAC

SEQ ID NO: 3761 - DNA, 33 bp, Artificial Sequence
  Description of Artificial Sequence: Synthetic oligonucleotide
tctggagataatttggggaatagatatgcttgc

SEQ ID NO: 3762 - protein, 11 aa, Artificial Sequence
  Description of Artificial Sequence: Synthetic peptide
SGDNLGNRYAC

SEQ ID NO: 3763 - DNA, 33 bp, Artificial Sequence
  Description of Artificial Sequence: Synthetic oligonucleotide
tctggagatacattggggggtaaatatgcttgg

SEQ ID NO: 3764 - protein, 11 aa, Artificial Sequence
  Description of Artificial Sequence: Synthetic peptide
SGDTLGGKYAW

SEQ ID NO: 3765 - DNA, 33 bp, Artificial Sequence
  Description of Artificial Sequence: Synthetic oligonucleotide
tctggagatgcattgccaaggcattatgtttat

SEQ ID NO: 3766 - protein, 11 aa, Artificial Sequence
  Description of Artificial Sequence: Synthetic peptide
SGDALPRHYVY

SEQ ID NO: 3767 - DNA, 42 bp, Artificial Sequence; identical to SEQ ID NO: 3757
  Description of Artificial Sequence: Synthetic oligonucleotide

SEQ ID NO: 3768 - protein, 14 aa, Artificial Sequence
  Description of Artificial Sequence: Synthetic peptide
TGSSSNIGAGYDVH

SEQ ID NO: 3769 - DNA, 33 bp, Artificial Sequence; identical to SEQ ID NO: 3763
  Description of Artificial Sequence: Synthetic oligonucleotide

SEQ ID NO: 3770 - protein, 11 aa, Artificial Sequence
  Description of Artificial Sequence: Synthetic peptide
SGDTLGGKYAW

SEQ ID NO: 3771 - DNA, 42 bp, Artificial Sequence; identical to SEQ ID NO: 3757
  Description of Artificial Sequence: Synthetic oligonucleotide

SEQ ID NO: 3772 - protein, 14 aa, Artificial Sequence
  Description of Artificial Sequence: Synthetic peptide
TGSSSNIGAGYDVH

SEQ ID NO: 3773 - DNA, 33 bp, Artificial Sequence; identical to SEQ ID NO: 697
  Description of Artificial Sequence: Synthetic oligonucleotide

SEQ ID NO: 3774 - protein, 11 aa, Artificial Sequence
  Description of Artificial Sequence: Synthetic peptide
SGDKLGEKYAC

SEQ ID NO: 3775 - DNA, 42 bp, Artificial Sequence; identical to SEQ ID NO: 3757
  Description of Artificial Sequence: Synthetic oligonucleotide

SEQ ID NO: 3776 - protein, 14 aa, Artificial Sequence
  Description of Artificial Sequence: Synthetic peptide
TGSSSNIGAGYDVH

SEQ ID NO: 3777 - DNA, 33 bp, Artificial Sequence; identical to SEQ ID NO: 3389
  Description of Artificial Sequence: Synthetic oligonucleotide

SEQ ID NO: 3778 - protein, 11 aa, Artificial Sequence
  Description of Artificial Sequence: Synthetic peptide
SGDKLGDKYVC

SEQ ID NO: 3779 - DNA, 33 bp, Artificial Sequence
  Description of Artificial Sequence: Synthetic oligonucleotide
tctggagatgcattgccaaaaaaatatgcttat

SEQ ID NO: 3780 - protein, 11 aa, Artificial Sequence
  Description of Artificial Sequence: Synthetic peptide
SGDALPKKYAY

SEQ ID NO: 3781 - DNA, 33 bp, Artificial Sequence; identical to SEQ ID NO: 293
  Description of Artificial Sequence: Synthetic oligonucleotide

SEQ ID NO: 3782 - protein, 11 aa, Artificial Sequence
  Description of Artificial Sequence: Synthetic peptide
RASQGINNYLA

SEQ ID NO: 3783 - DNA, 33 bp, Artificial Sequence; identical to SEQ ID NO: 909
  Description of Artificial Sequence: Synthetic oligonucleotide

SEQ ID NO: 3784 - protein, 11 aa, Artificial Sequence
  Description of Artificial Sequence: Synthetic peptide
RASQGIRNDLG

SEQ ID NO: 3785 - DNA, 33 bp, Artificial Sequence; identical to SEQ ID NO: 2199
  Description of Artificial Sequence: Synthetic oligonucleotide

SEQ ID NO: 3786 - protein, 11 aa, Artificial Sequence
  Description of Artificial Sequence: Synthetic peptide
RASQGISHYLA

SEQ ID NO: 3787 - DNA, 48 bp, Artificial Sequence; identical to SEQ ID NO: 1069
  Description of Artificial Sequence: Synthetic oligonucleotide

SEQ ID NO: 3788 - protein, 16 aa, Artificial Sequence
  Description of Artificial Sequence: Synthetic peptide
RSSQSLVYSDGNTYLN

SEQ ID NO: 3789 - DNA, 33 bp, Artificial Sequence
  Description of Artificial Sequence: Synthetic oligonucleotide
agggccagtcagagtgttagcaacgacttagcc

SEQ ID NO: 3790 - protein, 11 aa, Artificial Sequence
  Description of Artificial Sequence: Synthetic peptide
RASQSVSNDLA

SEQ ID NO: 3791 - DNA, 33 bp, Artificial Sequence
  Description of Artificial Sequence: Synthetic oligonucleotide
cgggcaagtcagagcattaccagctatttaaat

SEQ ID NO: 3792 - protein, 11 aa, Artificial Sequence
  Description of Artificial Sequence: Synthetic peptide
RASQSITSYLN

SEQ ID NO: 3793 - DNA, 33 bp, Artificial Sequence
  Description of Artificial Sequence: Synthetic oligonucleotide
cgtgcgagtcagggtattagcagctacttagcc

SEQ ID NO: 3794 - protein, 11 aa, Artificial Sequence
  Description of Artificial Sequence: Synthetic peptide
RASQGISSYLA

SEQ ID NO: 3795 - DNA, 33 bp, Artificial Sequence; identical to SEQ ID NO: 173
  Description of Artificial Sequence: Synthetic oligonucleotide

SEQ ID NO: 3796 - protein, 11 aa, Artificial Sequence
  Description of Artificial Sequence: Synthetic peptide
RASQGISRWLA

SEQ ID NO: 3797 - DNA, 48 bp, Artificial Sequence; identical to SEQ ID NO: 1731
  Description of Artificial Sequence: Synthetic oligonucleotide

SEQ ID NO: 3798 - protein, 16 aa, Artificial Sequence
  Description of Artificial Sequence: Synthetic peptide
RSSQSLLHSNGHNYLD

SEQ ID NO: 3799 - DNA, 48 bp, Artificial Sequence; identical to SEQ ID NO: 1069
  Description of Artificial Sequence: Synthetic oligonucleotide

SEQ ID NO: 3800 - protein, 16 aa, Artificial Sequence
  Description of Artificial Sequence: Synthetic peptide
RSSQSLVYSDGNTYLN

SEQ ID NO: 3801 - DNA, 48 bp, Artificial Sequence; identical to SEQ ID NO: 1069
  Description of Artificial Sequence: Synthetic oligonucleotide

SEQ ID NO: 3802 - protein, 16 aa, Artificial Sequence
  Description of Artificial Sequence: Synthetic peptide
RSSQSLVYSDGNTYLN

SEQ ID NO: 3803 - DNA, 48 bp, Artificial Sequence
  Description of Artificial Sequence: Synthetic oligonucleotide
aggtctagtcaaagcctcgtatacagtgatggaaacacctccttgaat

SEQ ID NO: 3804 - protein, 16 aa, Artificial Sequence
  Description of Artificial Sequence: Synthetic peptide
RSSQSLVYSDGNTSLN

SEQ ID NO: 3805 - DNA, 48 bp, Artificial Sequence; identical to SEQ ID NO: 3803
  Description of Artificial Sequence: Synthetic oligonucleotide

SEQ ID NO: 3806 - protein, 16 aa, Artificial Sequence
  Description of Artificial Sequence: Synthetic peptide
RSSQSLVYSDGNTSLN

SEQ ID NO: 3807 - DNA, 33 bp, Artificial Sequence; identical to SEQ ID NO: 105
  Description of Artificial Sequence: Synthetic oligonucleotide

SEQ ID NO: 3808 - protein, 11 aa, Artificial Sequence
  Description of Artificial Sequence: Synthetic peptide
RASQGISNYLA

SEQ ID NO: 3809 - DNA, 33 bp, Artificial Sequence; identical to SEQ ID NO: 283
  Description of Artificial Sequence: Synthetic oligonucleotide

SEQ ID NO: 3810 - protein, 11 aa, Artificial Sequence
  Description of Artificial Sequence: Synthetic peptide
RASQDISNYLA

SEQ ID NO: 3811 - DNA, 33 bp, Artificial Sequence; identical to SEQ ID NO: 109
  Description of Artificial Sequence: Synthetic oligonucleotide

SEQ ID NO: 3812 - protein, 11 aa, Artificial Sequence
  Description of Artificial Sequence: Synthetic peptide
RASQGIRNDLG

SEQ ID NO: 3813 - DNA, 33 bp, Artificial Sequence; identical to SEQ ID NO: 283
  Description of Artificial Sequence: Synthetic oligonucleotide

SEQ ID NO: 3814 - protein, 11 aa, Artificial Sequence
  Description of Artificial Sequence: Synthetic peptide
RASQDISNYLA

SEQ ID NO: 3815 - DNA, 33 bp, Artificial Sequence; identical to SEQ ID NO: 283
  Description of Artificial Sequence: Synthetic oligonucleotide

SEQ ID NO: 3816 - protein, 11 aa, Artificial Sequence
  Description of Artificial Sequence: Synthetic peptide
RASQDISNYLA

SEQ ID NO: 3817 - DNA, 48 bp, Artificial Sequence; identical to SEQ ID NO: 1069
  Description of Artificial Sequence: Synthetic oligonucleotide

SEQ ID NO: 3818 - protein, 16 aa, Artificial Sequence
  Description of Artificial Sequence: Synthetic peptide
RSSQSLVYSDGNTYLN

SEQ ID NO: 3819 - DNA, 33 bp, Artificial Sequence; identical to SEQ ID NO: 283
  Description of Artificial Sequence: Synthetic oligonucleotide

SEQ ID NO: 3820 - protein, 11 aa, Artificial Sequence
  Description of Artificial Sequence: Synthetic peptide
RASQDISNYLA

SEQ ID NO: 3821 - DNA, 33 bp, Artificial Sequence; identical to SEQ ID NO: 105
  Description of Artificial Sequence: Synthetic oligonucleotide

SEQ ID NO: 3822 - protein, 11 aa, Artificial Sequence
  Description of Artificial Sequence: Synthetic peptide
RASQGISNYLA

SEQ ID NO: 3823 - DNA, 33 bp, Artificial Sequence; identical to SEQ ID NO: 205
  Description of Artificial Sequence: Synthetic oligonucleotide

SEQ ID NO: 3824 - protein, 11 aa, Artificial Sequence
  Description of Artificial Sequence: Synthetic peptide
RASQDIRNDLG

SEQ ID NO: 3825 - DNA, 33 bp, Artificial Sequence
  Description of Artificial Sequence: Synthetic oligonucleotide
cgggcaagtcagaggtttagtaactatttaaat

SEQ ID NO: 3826 - protein, 11 aa, Artificial Sequence
  Description of Artificial Sequence: Synthetic peptide
RASQRFSNYLN

SEQ ID NO: 3827 - DNA, 33 bp, Artificial Sequence; identical to SEQ ID NO: 113
  Description of Artificial Sequence: Synthetic oligonucleotide

SEQ ID NO: 3828 - protein, 11 aa, Artificial Sequence
  Description of Artificial Sequence: Synthetic peptide
RASQGIRHDLG

SEQ ID NO: 3829 - DNA, 33 bp, Artificial Sequence; identical to SEQ ID NO: 113
  Description of Artificial Sequence: Synthetic oligonucleotide

SEQ ID NO: 3830 - protein, 11 aa, Artificial Sequence
  Description of Artificial Sequence: Synthetic peptide
RASQGIRHDLG

SEQ ID NO: 3831 - DNA, 48 bp, Artificial Sequence; identical to SEQ ID NO: 1069
  Description of Artificial Sequence: Synthetic oligonucleotide

SEQ ID NO: 3832 - protein, 16 aa, Artificial Sequence
  Description of Artificial Sequence: Synthetic peptide
RSSQSLVYSDGNTYLN

SEQ ID NO: 3833 - DNA, 33 bp, Artificial Sequence; identical to SEQ ID NO: 677
  Description of Artificial Sequence: Synthetic oligonucleotide

SEQ ID NO: 3834 - protein, 11 aa, Artificial Sequence
  Description of Artificial Sequence: Synthetic peptide
QASQDIFNYLN

SEQ ID NO: 3835 - DNA, 48 bp, Artificial Sequence; identical to SEQ ID NO: 1731
  Description of Artificial Sequence: Synthetic oligonucleotide

SEQ ID NO: 3836 - protein, 16 aa, Artificial Sequence
  Description of Artificial Sequence: Synthetic peptide
RSSQSLLHSNGHNYLD

SEQ ID NO: 3837 - DNA, 36 bp, Artificial Sequence; identical to SEQ ID NO: 1681
  Description of Artificial Sequence: Synthetic oligonucleotide

SEQ ID NO: 3838 - protein, 12 aa, Artificial Sequence
  Description of Artificial Sequence: Synthetic peptide
RASQSVSSSYLV

SEQ ID NO: 3839 - DNA, 36 bp, Artificial Sequence; identical to SEQ ID NO: 1697
  Description of Artificial Sequence: Synthetic oligonucleotide

SEQ ID NO: 3840 - protein, 12 aa, Artificial Sequence
  Description of Artificial Sequence: Synthetic peptide
RASQSVYSSYLA

SEQ ID NO: 3841 - DNA, 33 bp, Artificial Sequence
  Description of Artificial Sequence: Synthetic oligonucleotide
cgggcgagtcagggcattagcatctggttagcc

SEQ ID NO: 3842 - protein, 11 aa, Artificial Sequence
  Description of Artificial Sequence: Synthetic peptide
RASQGISIWLA

SEQ ID NO: 3843 - DNA, 36 bp, Artificial Sequence; identical to SEQ ID NO: 1697
  Description of Artificial Sequence: Synthetic oligonucleotide

SEQ ID NO: 3844 - protein, 12 aa, Artificial Sequence
  Description of Artificial Sequence: Synthetic peptide
RASQSVYSSYLA

SEQ ID NO: 3845 - DNA, 36 bp, Artificial Sequence; identical to SEQ ID NO: 1697
  Description of Artificial Sequence: Synthetic oligonucleotide

SEQ ID NO: 3846 - protein, 12 aa, Artificial Sequence
  Description of Artificial Sequence: Synthetic peptide
RASQSVYSSYLA

SEQ ID NO: 3847 - DNA, 33 bp, Artificial Sequence; identical to SEQ ID NO: 1781
  Description of Artificial Sequence: Synthetic oligonucleotide

SEQ ID NO: 3848 - protein, 11 aa, Artificial Sequence
  Description of Artificial Sequence: Synthetic peptide
RASQSVSRNLA

SEQ ID NO: 3849 - DNA, 36 bp, Artificial Sequence; identical to SEQ ID NO: 1713
  Description of Artificial Sequence: Synthetic oligonucleotide

SEQ ID NO: 3850 - protein, 12 aa, Artificial Sequence
  Description of Artificial Sequence: Synthetic peptide
RASPSVDSSYLA

SEQ ID NO: 3851 - DNA, 36 bp, Artificial Sequence; identical to SEQ ID NO: 1697
  Description of Artificial Sequence: Synthetic oligonucleotide

SEQ ID NO: 3852 - protein, 12 aa, Artificial Sequence
  Description of Artificial Sequence: Synthetic peptide
RASQSVYSSYLA

SEQ ID NO: 3853 - DNA, 33 bp, Artificial Sequence; identical to SEQ ID NO: 251
  Description of Artificial Sequence: Synthetic oligonucleotide

SEQ ID NO: 3854 - protein, 11 aa, Artificial Sequence
  Description of Artificial Sequence: Synthetic peptide
RASQGIRNDLG

SEQ ID NO: 3855 - DNA, 36 bp, Artificial Sequence; identical to SEQ ID NO: 1697
  Description of Artificial Sequence: Synthetic oligonucleotide

SEQ ID NO: 3856 - protein, 12 aa, Artificial Sequence
  Description of Artificial Sequence: Synthetic peptide
RASQSVYSSYLA

SEQ ID NO: 3857 - DNA, 51 bp, Artificial Sequence; identical to SEQ ID NO: 1839
  Description of Artificial Sequence: Synthetic oligonucleotide

SEQ ID NO: 3858 - protein, 17 aa, Artificial Sequence
  Description of Artificial Sequence: Synthetic peptide
KSSQSVLHRSNNYNYLA

SEQ ID NO: 3859 - DNA, 51 bp, Artificial Sequence
  Description of Artificial Sequence: Synthetic oligonucleotide
aagtccagccagagtattttacacagctccaacaattacaattacttagct

SEQ ID NO: 3860 - protein, 17 aa, Artificial Sequence
  Description of Artificial Sequence: Synthetic peptide
KSSQSILHSSNNYNYLA

SEQ ID NO: 3861 - DNA, 51 bp, Artificial Sequence; identical to SEQ ID NO: 1685
  Description of Artificial Sequence: Synthetic oligonucleotide

SEQ ID NO: 3862 - protein, 17 aa, Artificial Sequence
  Description of Artificial Sequence: Synthetic peptide
KSSQSVLYSSNNANYLA

SEQ ID NO: 3863 - DNA, 36 bp, Artificial Sequence; identical to SEQ ID NO: 1697
  Description of Artificial Sequence: Synthetic oligonucleotide

SEQ ID NO: 3864 - protein, 12 aa, Artificial Sequence
  Description of Artificial Sequence: Synthetic peptide
RASQSVYSSYLA

SEQ ID NO: 3865 - DNA, 48 bp, Artificial Sequence; identical to SEQ ID NO: 2021
  Description of Artificial Sequence: Synthetic oligonucleotide

SEQ ID NO: 3866 - protein, 16 aa, Artificial Sequence
  Description of Artificial Sequence: Synthetic peptide
RSSQSLVHSSGYNYLD

SEQ ID NO: 3867 - DNA, 36 bp, Artificial Sequence; identical to SEQ ID NO: 1681
  Description of Artificial Sequence: Synthetic oligonucleotide

SEQ ID NO: 3868 - protein, 12 aa, Artificial Sequence
  Description of Artificial Sequence: Synthetic peptide
RASQSVSSSYLV

SEQ ID NO: 3869 - DNA, 51 bp, Artificial Sequence; identical to SEQ ID NO: 1683
  Description of Artificial Sequence: Synthetic oligonucleotide

SEQ ID NO: 3870 - protein, 17 aa, Artificial Sequence
  Description of Artificial Sequence: Synthetic peptide
KSSQSVLHSSNNKNYLT

SEQ ID NO: 3871 - DNA, 36 bp, Artificial Sequence; identical to SEQ ID NO: 455
  Description of Artificial Sequence: Synthetic oligonucleotide

SEQ ID NO: 3872 - protein, 12 aa, Artificial Sequence
  Description of Artificial Sequence: Synthetic peptide
RASQSFSSSYLA

SEQ ID NO: 3873 - DNA, 33 bp, Artificial Sequence; identical to SEQ ID NO: 3039
  Description of Artificial Sequence: Synthetic oligonucleotide

SEQ ID NO: 3874 - protein, 11 aa, Artificial Sequence
  Description of Artificial Sequence: Synthetic peptide
RASQGISSYLA

SEQ ID NO: 3875 - DNA, 51 bp, Artificial Sequence; identical to SEQ ID NO: 479
  Description of Artificial Sequence: Synthetic oligonucleotide

SEQ ID NO: 3876 - protein, 17 aa, Artificial Sequence
  Description of Artificial Sequence: Synthetic peptide
KSSQSVLYSSHNNNYLA

SEQ ID NO: 3877 - DNA, 51 bp, Artificial Sequence; identical to SEQ ID NO: 479
  Description of Artificial Sequence: Synthetic oligonucleotide

SEQ ID NO: 3878 - protein, 17 aa, Artificial Sequence
  Description of Artificial Sequence: Synthetic peptide
KSSQSVLYSSHNNNYLA

SEQ ID NO: 3879 - DNA, 51 bp, Artificial Sequence; identical to SEQ ID NO: 479
  Description of Artificial Sequence: Synthetic oligonucleotide

SEQ ID NO: 3880 - protein, 17 aa, Artificial Sequence
  Description of Artificial Sequence: Synthetic peptide
KSSQSVLYSSHNNNYLA

SEQ ID NO: 3881 - DNA, 51 bp, Artificial Sequence; identical to SEQ ID NO: 479
  Description of Artificial Sequence: Synthetic oligonucleotide

SEQ ID NO: 3882 - protein, 17 aa, Artificial Sequence
  Description of Artificial Sequence: Synthetic peptide
KSSQSVLYSSHNNNYLA

SEQ ID NO: 3883 - DNA, 51 bp, Artificial Sequence; identical to SEQ ID NO: 479
  Description of Artificial Sequence: Synthetic oligonucleotide

SEQ ID NO: 3884 - protein, 17 aa, Artificial Sequence
  Description of Artificial Sequence: Synthetic peptide
KSSQSVLYSSHNNNYLA

SEQ ID NO: 3885 - DNA, 51 bp, Artificial Sequence; identical to SEQ ID NO: 479
  Description of Artificial Sequence: Synthetic oligonucleotide

SEQ ID NO: 3886 - protein, 17 aa, Artificial Sequence
  Description of Artificial Sequence: Synthetic peptide
KSSQSVLYSSHNNNYLA

SEQ ID NO: 3887 - DNA, 51 bp, Artificial Sequence; identical to SEQ ID NO: 479
  Description of Artificial Sequence: Synthetic oligonucleotide

SEQ ID NO: 3888 - protein, 17 aa, Artificial Sequence
  Description of Artificial Sequence: Synthetic peptide
KSSQSVLYSSHNNNYLA

SEQ ID NO: 3889 - DNA, 51 bp, Artificial Sequence; identical to SEQ ID NO: 479
  Description of Artificial Sequence: Synthetic oligonucleotide

SEQ ID NO: 3890 - protein, 17 aa, Artificial Sequence
  Description of Artificial Sequence: Synthetic peptide
KSSQSVLYSSHNNNYLA

SEQ ID NO: 3891 - DNA, 51 bp, Artificial Sequence; identical to SEQ ID NO: 479
  Description of Artificial Sequence: Synthetic oligonucleotide

SEQ ID NO: 3892 - protein, 17 aa, Artificial Sequence
  Description of Artificial Sequence: Synthetic peptide
KSSQSVLYSSHNNNYLA

SEQ ID NO: 3893 - DNA, 51 bp, Artificial Sequence; identical to SEQ ID NO: 479
  Description of Artificial Sequence: Synthetic oligonucleotide

SEQ ID NO: 3894 - protein, 17 aa, Artificial Sequence
  Description of Artificial Sequence: Synthetic peptide
KSSQSVLYSSHNNNYLA

SEQ ID NO: 3895 - DNA, 51 bp, Artificial Sequence; identical to SEQ ID NO: 479
  Description of Artificial Sequence: Synthetic oligonucleotide

SEQ ID NO: 3896 - protein, 17 aa, Artificial Sequence
  Description of Artificial Sequence: Synthetic peptide
KSSQSVLYSSHNNNYLA

SEQ ID NO: 3897 - DNA, 51 bp, Artificial Sequence; identical to SEQ ID NO: 479
  Description of Artificial Sequence: Synthetic oligonucleotide

SEQ ID NO: 3898 - protein, 17 aa, Artificial Sequence
  Description of Artificial Sequence: Synthetic peptide
KSSQSVLYSSHNNNYLA

SEQ ID NO: 3899 - DNA, 51 bp, Artificial Sequence; identical to SEQ ID NO: 1129
  Description of Artificial Sequence: Synthetic oligonucleotide

SEQ ID NO: 3900 - protein, 17 aa, Artificial Sequence
  Description of Artificial Sequence: Synthetic peptide
KSSQSILHSSNNNNYLA

SEQ ID NO: 3901 - DNA, 51 bp, Artificial Sequence; identical to SEQ ID NO: 1129
  Description of Artificial Sequence: Synthetic oligonucleotide

SEQ ID NO: 3902 - protein, 17 aa, Artificial Sequence
  Description of Artificial Sequence: Synthetic peptide
KSSQSILHSSNNNNYLA

SEQ ID NO: 3903 - DNA, 51 bp, Artificial Sequence; identical to SEQ ID NO: 1129
  Description of Artificial Sequence: Synthetic oligonucleotide

SEQ ID NO: 3904 - protein, 17 aa, Artificial Sequence
  Description of Artificial Sequence: Synthetic peptide
KSSQSILHSSNNNNYLA

SEQ ID NO: 3905 - DNA, 51 bp, Artificial Sequence; identical to SEQ ID NO: 1129
  Description of Artificial Sequence: Synthetic oligonucleotide

SEQ ID NO: 3906 - protein, 17 aa, Artificial Sequence
  Description of Artificial Sequence: Synthetic peptide
KSSQSILHSSNNNNYLA

SEQ ID NO: 3907 - DNA, 51 bp, Artificial Sequence; identical to SEQ ID NO: 1129
  Description of Artificial Sequence: Synthetic oligonucleotide

SEQ ID NO: 3908 - protein, 17 aa, Artificial Sequence
  Description of Artificial Sequence: Synthetic peptide
KSSQSILHSSNNNNYLA

SEQ ID NO: 3909 - DNA, 51 bp, Artificial Sequence; identical to SEQ ID NO: 1129
  Description of Artificial Sequence: Synthetic oligonucleotide

SEQ ID NO: 3910 - protein, 17 aa, Artificial Sequence
  Description of Artificial Sequence: Synthetic peptide
KSSQSILHSSNNNNYLA

SEQ ID NO: 3911 - DNA, 51 bp, Artificial Sequence; identical to SEQ ID NO: 1129
  Description of Artificial Sequence: Synthetic oligonucleotide

SEQ ID NO: 3912 - protein, 17 aa, Artificial Sequence
  Description of Artificial Sequence: Synthetic peptide
KSSQSILHSSNNNNYLA

SEQ ID NO: 3913 - DNA, 51 bp, Artificial Sequence; identical to SEQ ID NO: 1129
  Description of Artificial Sequence: Synthetic oligonucleotide

SEQ ID NO: 3914 - protein, 17 aa, Artificial Sequence
  Description of Artificial Sequence: Synthetic peptide
KSSQSILHSSNNNNYLA

SEQ ID NO: 3915 - DNA, 51 bp, Artificial Sequence; identical to SEQ ID NO: 1129
  Description of Artificial Sequence: Synthetic oligonucleotide

SEQ ID NO: 3916 - protein, 17 aa, Artificial Sequence
  Description of Artificial Sequence: Synthetic peptide
KSSQSILHSSNNNNYLA

SEQ ID NO: 3917 - DNA, 51 bp, Artificial Sequence; identical to SEQ ID NO: 1129
  Description of Artificial Sequence: Synthetic oligonucleotide

SEQ ID NO: 3918 - protein, 17 aa, Artificial Sequence
  Description of Artificial Sequence: Synthetic peptide
KSSQSILHSSNNNNYLA

SEQ ID NO: 3919 - DNA, 51 bp, Artificial Sequence; identical to SEQ ID NO: 1129
  Description of Artificial Sequence: Synthetic oligonucleotide

SEQ ID NO: 3920 - protein, 17 aa, Artificial Sequence
  Description of Artificial Sequence: Synthetic peptide
KSSQSILHSSNNNNYLA

SEQ ID NO: 3921 - DNA, 51 bp, Artificial Sequence; identical to SEQ ID NO: 1129
  Description of Artificial Sequence: Synthetic oligonucleotide

SEQ ID NO: 3922 - protein, 17 aa, Artificial Sequence
  Description of Artificial Sequence: Synthetic peptide
KSSQSILHSSNNNNYLA

SEQ ID NO: 3923 - DNA, 51 bp, Artificial Sequence; identical to SEQ ID NO: 1129
  Description of Artificial Sequence: Synthetic oligonucleotide

SEQ ID NO: 3924 - protein, 17 aa, Artificial Sequence
  Description of Artificial Sequence: Synthetic peptide
KSSQSILHSSNNNNYLA

SEQ ID NO: 3925 - DNA, 51 bp, Artificial Sequence; identical to SEQ ID NO: 1129
  Description of Artificial Sequence: Synthetic oligonucleotide

SEQ ID NO: 3926 - protein, 17 aa, Artificial Sequence
  Description of Artificial Sequence: Synthetic peptide
KSSQSILHSSNNNNYLA

SEQ ID NO: 3927 - DNA, 51 bp, Artificial Sequence; identical to SEQ ID NO: 1129
  Description of Artificial Sequence: Synthetic oligonucleotide

SEQ ID NO: 3928 - protein, 17 aa, Artificial Sequence
  Description of Artificial Sequence: Synthetic peptide
KSSQSILHSSNNNNYLA

SEQ ID NO: 3929 - DNA, 51 bp, Artificial Sequence; identical to SEQ ID NO: 1129
  Description of Artificial Sequence: Synthetic oligonucleotide

SEQ ID NO: 3930 - protein, 17 aa, Artificial Sequence
  Description of Artificial Sequence: Synthetic peptide
KSSQSILHSSNNNNYLA

SEQ ID NO: 3931 - DNA, 51 bp, Artificial Sequence; identical to SEQ ID NO: 1129
  Description of Artificial Sequence: Synthetic oligonucleotide

SEQ ID NO: 3932 - protein, 17 aa, Artificial Sequence
  Description of Artificial Sequence: Synthetic peptide
KSSQSILHSSNNNNYLA

SEQ ID NO: 3933 - DNA, 51 bp, Artificial Sequence; identical to SEQ ID NO: 1129
  Description of Artificial Sequence: Synthetic oligonucleotide

SEQ ID NO: 3934 - protein, 17 aa, Artificial Sequence
  Description of Artificial Sequence: Synthetic peptide
KSSQSILHSSNNNNYLA

SEQ ID NO: 3935 - DNA, 33 bp, Artificial Sequence; identical to SEQ ID NO: 173
  Description of Artificial Sequence: Synthetic oligonucleotide

SEQ ID NO: 3936 - protein, 11 aa, Artificial Sequence
  Description of Artificial Sequence: Synthetic peptide
RASQGISRWLA

SEQ ID NO: 3937 - DNA, 33 bp, Artificial Sequence; identical to SEQ ID NO: 173
  Description of Artificial Sequence: Synthetic oligonucleotide

SEQ ID NO: 3938 - protein, 11 aa, Artificial Sequence
  Description of Artificial Sequence: Synthetic peptide
RASQGISRWLA

SEQ ID NO: 3939 - DNA, 33 bp, Artificial Sequence; identical to SEQ ID NO: 173
  Description of Artificial Sequence: Synthetic oligonucleotide

SEQ ID NO: 3940 - protein, 11 aa, Artificial Sequence
  Description of Artificial Sequence: Synthetic peptide
RASQGISRWLA

SEQ ID NO: 3941 - DNA, 33 bp, Artificial Sequence; identical to SEQ ID NO: 173
  Description of Artificial Sequence: Synthetic oligonucleotide

SEQ ID NO: 3942 - protein, 11 aa, Artificial Sequence
  Description of Artificial Sequence: Synthetic peptide
RASQGISRWLA

SEQ ID NO: 3943 - DNA, 33 bp, Artificial Sequence; identical to SEQ ID NO: 173
  Description of Artificial Sequence: Synthetic oligonucleotide

SEQ ID NO: 3944 - protein, 11 aa, Artificial Sequence
  Description of Artificial Sequence: Synthetic peptide
RASQGISRWLA

SEQ ID NO: 3945 - DNA, 33 bp, Artificial Sequence; identical to SEQ ID NO: 173
  Description of Artificial Sequence: Synthetic oligonucleotide

SEQ ID NO: 3946 - protein, 11 aa, Artificial Sequence
  Description of Artificial Sequence: Synthetic peptide
RASQGISRWLA

SEQ ID NO: 3947 - DNA, 33 bp, Artificial Sequence; identical to SEQ ID NO: 173
  Description of Artificial Sequence: Synthetic oligonucleotide

SEQ ID NO: 3948 - protein, 11 aa, Artificial Sequence
  Description of Artificial Sequence: Synthetic peptide
RASQGISRWLA

SEQ ID NO: 3949 - DNA, 33 bp, Artificial Sequence; identical to SEQ ID NO: 173
  Description of Artificial Sequence: Synthetic oligonucleotide

SEQ ID NO: 3950 - protein, 11 aa, Artificial Sequence
  Description of Artificial Sequence: Synthetic peptide
RASQGISRWLA

SEQ ID NO: 3951 - DNA, 33 bp, Artificial Sequence; identical to SEQ ID NO: 109
  Description of Artificial Sequence: Synthetic oligonucleotide

SEQ ID NO: 3952 - protein, 11 aa, Artificial Sequence
  Description of Artificial Sequence: Synthetic peptide
RASQGIRNDLG

SEQ ID NO: 3953 - DNA, 33 bp, Artificial Sequence; identical to SEQ ID NO: 109
  Description of Artificial Sequence: Synthetic oligonucleotide

SEQ ID NO: 3954 - protein, 11 aa, Artificial Sequence
  Description of Artificial Sequence: Synthetic peptide
RASQGIRNDLG

SEQ ID NO: 3955 - DNA, 33 bp, Artificial Sequence; identical to SEQ ID NO: 109
  Description of Artificial Sequence: Synthetic oligonucleotide

SEQ ID NO: 3956 - protein, 11 aa, Artificial Sequence
  Description of Artificial Sequence: Synthetic peptide
RASQGIRNDLG

SEQ ID NO: 3957 - DNA, 33 bp, Artificial Sequence; identical to SEQ ID NO: 109
  Description of Artificial Sequence: Synthetic oligonucleotide

SEQ ID NO: 3958 - protein, 11 aa, Artificial Sequence
  Description of Artificial Sequence: Synthetic peptide
RASQGIRNDLG

SEQ ID NO: 3959 - DNA, 33 bp, Artificial Sequence; identical to SEQ ID NO: 109
  Description of Artificial Sequence: Synthetic oligonucleotide

SEQ ID NO: 3960 - protein, 11 aa, Artificial Sequence
  Description of Artificial Sequence: Synthetic peptide
RASQGIRNDLG

SEQ ID NO: 3961 - DNA, 33 bp, Artificial Sequence; identical to SEQ ID NO: 109
  Description of Artificial Sequence: Synthetic oligonucleotide

SEQ ID NO: 3962 - protein, 11 aa, Artificial Sequence
  Description of Artificial Sequence: Synthetic peptide
RASQGIRNDLG

SEQ ID NO: 3963 - DNA, 33 bp, Artificial Sequence; identical to SEQ ID NO: 109
  Description of Artificial Sequence: Synthetic oligonucleotide

SEQ ID NO: 3964 - protein, 11 aa, Artificial Sequence
  Description of Artificial Sequence: Synthetic peptide
RASQGIRNDLG

SEQ ID NO: 3965 - DNA, 33 bp, Artificial Sequence; identical to SEQ ID NO: 109
  Description of Artificial Sequence: Synthetic oligonucleotide

SEQ ID NO: 3966 - protein, 11 aa, Artificial Sequence
  Description of Artificial Sequence: Synthetic peptide
RASQGIRNDLG

SEQ ID NO: 3967 - DNA, 33 bp, Artificial Sequence; identical to SEQ ID NO: 109
  Description of Artificial Sequence: Synthetic oligonucleotide

SEQ ID NO: 3968 - protein, 11 aa, Artificial Sequence
  Description of Artificial Sequence: Synthetic peptide
RASQGIRNDLG

SEQ ID NO: 3969 - DNA, 33 bp, Artificial Sequence; identical to SEQ ID NO: 109
  Description of Artificial Sequence: Synthetic oligonucleotide

SEQ ID NO: 3970 - protein, 11 aa, Artificial Sequence
  Description of Artificial Sequence: Synthetic peptide
RASQGIRNDLG

SEQ ID NO: 3971 - DNA, 33 bp, Artificial Sequence; identical to SEQ ID NO: 109
  Description of Artificial Sequence: Synthetic oligonucleotide

SEQ ID NO: 3972 - protein, 11 aa, Artificial Sequence
  Description of Artificial Sequence: Synthetic peptide
RASQGIRNDLG

SEQ ID NO: 3973 - DNA, 33 bp, Artificial Sequence; identical to SEQ ID NO: 109
  Description of Artificial Sequence: Synthetic oligonucleotide

SEQ ID NO: 3974 - protein, 11 aa, Artificial Sequence
  Description of Artificial Sequence: Synthetic peptide
RASQGIRNDLG

SEQ ID NO: 3975 - DNA, 33 bp, Artificial Sequence; identical to SEQ ID NO: 109
  Description of Artificial Sequence: Synthetic oligonucleotide

SEQ ID NO: 3976 - protein, 11 aa, Artificial Sequence
  Description of Artificial Sequence: Synthetic peptide
RASQGIRNDLG

SEQ ID NO: 3977 - DNA, 33 bp, Artificial Sequence; identical to SEQ ID NO: 109
  Description of Artificial Sequence: Synthetic oligonucleotide

SEQ ID NO: 3978 - protein, 11 aa, Artificial Sequence
  Description of Artificial Sequence: Synthetic peptide
RASQGIRNDLG

SEQ ID NO: 3979 - DNA, 33 bp, Artificial Sequence; identical to SEQ ID NO: 871
  Description of Artificial Sequence: Synthetic oligonucleotide

SEQ ID NO: 3980 - protein, 11 aa, Artificial Sequence
  Description of Artificial Sequence: Synthetic peptide
RASQNIISYLN

SEQ ID NO: 3981 - DNA, 33 bp, Artificial Sequence; identical to SEQ ID NO: 871
  Description of Artificial Sequence: Synthetic oligonucleotide

SEQ ID NO: 3982 - protein, 11 aa, Artificial Sequence
  Description of Artificial Sequence: Synthetic peptide
RASQNIISYLN

SEQ ID NO: 3983 - DNA, 33 bp, Artificial Sequence; identical to SEQ ID NO: 871
  Description of Artificial Sequence: Synthetic oligonucleotide

SEQ ID NO: 3984 - protein, 11 aa, Artificial Sequence
  Description of Artificial Sequence: Synthetic peptide
RASQNIISYLN

SEQ ID NO: 3985 - DNA, 33 bp, Artificial Sequence; identical to SEQ ID NO: 871
  Description of Artificial Sequence: Synthetic oligonucleotide

SEQ ID NO: 3986 - protein, 11 aa, Artificial Sequence
  Description of Artificial Sequence: Synthetic peptide
RASQNIISYLN

SEQ ID NO: 3987 - DNA, 33 bp, Artificial Sequence; identical to SEQ ID NO: 871
  Description of Artificial Sequence: Synthetic oligonucleotide

SEQ ID NO: 3988 - protein, 11 aa, Artificial Sequence
  Description of Artificial Sequence: Synthetic peptide
RASQNIISYLN

SEQ ID NO: 3989 - DNA, 33 bp, Artificial Sequence; identical to SEQ ID NO: 871
  Description of Artificial Sequence: Synthetic oligonucleotide

SEQ ID NO: 3990 - protein, 11 aa, Artificial Sequence
  Description of Artificial Sequence: Synthetic peptide
RASQNIISYLN

SEQ ID NO: 3991 - DNA, 33 bp, Artificial Sequence; identical to SEQ ID NO: 871
  Description of Artificial Sequence: Synthetic oligonucleotide

SEQ ID NO: 3992 - protein, 11 aa, Artificial Sequence
  Description of Artificial Sequence: Synthetic peptide
RASQNIISYLN

SEQ ID NO: 3993 - DNA, 33 bp, Artificial Sequence; identical to SEQ ID NO: 871
  Description of Artificial Sequence: Synthetic oligonucleotide

SEQ ID NO: 3994 - protein, 11 aa, Artificial Sequence
  Description of Artificial Sequence: Synthetic peptide
RASQNIISYLN

SEQ ID NO: 3995 - DNA, 33 bp, Artificial Sequence; identical to SEQ ID NO: 871
  Description of Artificial Sequence: Synthetic oligonucleotide

SEQ ID NO: 3996 - protein, 11 aa, Artificial Sequence
  Description of Artificial Sequence: Synthetic peptide
RASQNIISYLN

SEQ ID NO: 3997 - DNA, 33 bp, Artificial Sequence; identical to SEQ ID NO: 871
  Description of Artificial Sequence: Synthetic oligonucleotide

SEQ ID NO: 3998 - protein, 11 aa, Artificial Sequence
  Description of Artificial Sequence: Synthetic peptide
RASQNIISYLN

SEQ ID NO: 3999 - DNA, 33 bp, Artificial Sequence; identical to SEQ ID NO: 871
  Description of Artificial Sequence: Synthetic oligonucleotide

SEQ ID NO: 4000 - protein, 11 aa, Artificial Sequence
  Description of Artificial Sequence: Synthetic peptide
RASQNIISYLN

SEQ ID NO: 4001 - DNA, 33 bp, Artificial Sequence; identical to SEQ ID NO: 871
  Description of Artificial Sequence: Synthetic oligonucleotide

SEQ ID NO: 4002 - protein, 11 aa, Artificial Sequence
  Description of Artificial Sequence: Synthetic peptide
RASQNIISYLN

SEQ ID NO: 4003 - DNA, 33 bp, Artificial Sequence; identical to SEQ ID NO: 871
  Description of Artificial Sequence: Synthetic oligonucleotide

SEQ ID NO: 4004 - protein, 11 aa, Artificial Sequence
  Description of Artificial Sequence: Synthetic peptide
RASQNIISYLN

SEQ ID NO: 4005 - DNA, 33 bp, Artificial Sequence; identical to SEQ ID NO: 871
  Description of Artificial Sequence: Synthetic oligonucleotide

SEQ ID NO: 4006 - protein, 11 aa, Artificial Sequence
  Description of Artificial Sequence: Synthetic peptide
RASQNIISYLN

SEQ ID NO: 4007 - DNA, 33 bp, Artificial Sequence; identical to SEQ ID NO: 871
  Description of Artificial Sequence: Synthetic oligonucleotide

SEQ ID NO: 4008 - protein, 11 aa, Artificial Sequence
  Description of Artificial Sequence: Synthetic peptide
RASQNIISYLN

SEQ ID NO: 4009 - DNA, 33 bp, Artificial Sequence; identical to SEQ ID NO: 871
  Description of Artificial Sequence: Synthetic oligonucleotide

SEQ ID NO: 4010 - protein, 11 aa, Artificial Sequence
  Description of Artificial Sequence: Synthetic peptide
RASQNIISYLN

SEQ ID NO: 4011 - DNA, 33 bp, Artificial Sequence; identical to SEQ ID NO: 871
  Description of Artificial Sequence: Synthetic oligonucleotide

SEQ ID NO: 4012 - protein, 11 aa, Artificial Sequence
  Description of Artificial Sequence: Synthetic peptide
RASQNIISYLN

SEQ ID NO: 4013 - DNA, 33 bp, Artificial Sequence; identical to SEQ ID NO: 871
  Description of Artificial Sequence: Synthetic oligonucleotide

SEQ ID NO: 4014 - protein, 11 aa, Artificial Sequence
  Description of Artificial Sequence: Synthetic peptide
RASQNIISYLN

SEQ ID NO: 4015 - DNA, 33 bp, Artificial Sequence; identical to SEQ ID NO: 871
  Description of Artificial Sequence: Synthetic oligonucleotide

SEQ ID NO: 4016 - protein, 11 aa, Artificial Sequence
  Description of Artificial Sequence: Synthetic peptide
RASQNIISYLN

SEQ ID NO: 4017 - DNA, 33 bp, Artificial Sequence; identical to SEQ ID NO: 871
  Description of Artificial Sequence: Synthetic oligonucleotide

SEQ ID NO: 4018 - protein, 11 aa, Artificial Sequence
  Description of Artificial Sequence: Synthetic peptide
RASQNIISYLN

SEQ ID NO: 4019 - DNA, 33 bp, Artificial Sequence; identical to SEQ ID NO: 871
  Description of Artificial Sequence: Synthetic oligonucleotide

SEQ ID NO: 4020 - protein, 11 aa, Artificial Sequence
  Description of Artificial Sequence: Synthetic peptide
RASQNIISYLN

SEQ ID NO: 4021 - DNA, 36 bp, Artificial Sequence
  Description of Artificial Sequence: Synthetic oligonucleotide
agggccagtcagagtgtgatcagcagctacttagcc

SEQ ID NO: 4022 - protein, 12 aa, Artificial Sequence
  Description of Artificial Sequence: Synthetic peptide
RASQSVISSYLA

SEQ ID NO: 4023 - DNA, 42 bp, Artificial Sequence; identical to SEQ ID NO: 3757
  Description of Artificial Sequence: Synthetic oligonucleotide

SEQ ID NO: 4024 - protein, 14 aa, Artificial Sequence
  Description of Artificial Sequence: Synthetic peptide
TGSSSNIGAGYDVH

SEQ ID NO: 4025 - DNA, 48 bp, Artificial Sequence; identical to SEQ ID NO: 1069
  Description of Artificial Sequence: Synthetic oligonucleotide

SEQ ID NO: 4026 - protein, 16 aa, Artificial Sequence
  Description of Artificial Sequence: Synthetic peptide
RSSQSLVYSDGNTYLN

SEQ ID NO: 4027 - DNA, 51 bp, Artificial Sequence; identical to SEQ ID NO: 479
  Description of Artificial Sequence: Synthetic oligonucleotide

SEQ ID NO: 4028 - protein, 17 aa, Artificial Sequence
  Description of Artificial Sequence: Synthetic peptide
KSSQSVLYSSHNNNYLA

SEQ ID NO: 4029 - DNA, 33 bp, Artificial Sequence; identical to SEQ ID NO: 173
  Description of Artificial Sequence: Synthetic oligonucleotide

SEQ ID NO: 4030 - protein, 11 aa, Artificial Sequence
  Description of Artificial Sequence: Synthetic peptide
RASQGISRWLA

SEQ ID NO: 4031 - DNA, 33 bp, Artificial Sequence; identical to SEQ ID NO: 871
  Description of Artificial Sequence: Synthetic oligonucleotide

SEQ ID NO: 4032 - protein, 11 aa, Artificial Sequence
  Description of Artificial Sequence: Synthetic peptide
RASQNIISYLN

SEQ ID NO: 4033 - DNA, 51 bp, Artificial Sequence; identical to SEQ ID NO: 1847
  Description of Artificial Sequence: Synthetic oligonucleotide

SEQ ID NO: 4034 - protein, 17 aa, Artificial Sequence
  Description of Artificial Sequence: Synthetic peptide
KSRQSVLYSSNNYNYLT

SEQ ID NO: 4035 - DNA, 51 bp, Artificial Sequence
  Description of Artificial Sequence: Synthetic oligonucleotide
aagtccagccagactgtcttacacagctccaacaattataactacttagct

SEQ ID NO: 4036 - protein, 17 aa, Artificial Sequence
  Description of Artificial Sequence: Synthetic peptide
KSSQTVLHSSNNYNYLA

SEQ ID NO: 4037 - DNA, 33 bp, Artificial Sequence
  Description of Artificial Sequence: Synthetic oligonucleotide
agggccagtcagagtgttagcatcaacttagcc

SEQ ID NO: 4038 - protein, 11 aa, Artificial Sequence
  Description of Artificial Sequence: Synthetic peptide
RASQSVSINLA

SEQ ID NO: 4039 - DNA, 33 bp, Artificial Sequence; identical to SEQ ID NO: 3791
  Description of Artificial Sequence: Synthetic oligonucleotide

SEQ ID NO: 4040 - protein, 11 aa, Artificial Sequence
  Description of Artificial Sequence: Synthetic peptide
RASQSITSYLN

SEQ ID NO: 4041 - DNA, 33 bp, Artificial Sequence; identical to SEQ ID NO: 693
  Description of Artificial Sequence: Synthetic oligonucleotide

SEQ ID NO: 4042 - protein, 11 aa, Artificial Sequence
  Description of Artificial Sequence: Synthetic peptide
SGDKLGDKYAC

SEQ ID NO: 4043 - DNA, 33 bp, Artificial Sequence; identical to SEQ ID NO: 191
  Description of Artificial Sequence: Synthetic oligonucleotide

SEQ ID NO: 4044 - protein, 11 aa, Artificial Sequence
  Description of Artificial Sequence: Synthetic peptide
SGDKLGDKYAS

SEQ ID NO: 4045 - DNA, 39 bp, Artificial Sequence; identical to SEQ ID NO: 3435
  Description of Artificial Sequence: Synthetic oligonucleotide

SEQ ID NO: 4046 - protein, 13 aa, Artificial Sequence
  Description of Artificial Sequence: Synthetic peptide
SGSSSNIGSNIVT

SEQ ID NO: 4047 - DNA, 39 bp, Artificial Sequence; identical to SEQ ID NO: 2917
  Description of Artificial Sequence: Synthetic oligonucleotide

SEQ ID NO: 4048 - protein, 13 aa, Artificial Sequence
  Description of Artificial Sequence: Synthetic peptide
SGSNSNIGSNIVT

SEQ ID NO: 4049 - DNA, 39 bp, Artificial Sequence
  Description of Artificial Sequence: Synthetic oligonucleotide
tctggaagctgctccaacatcggaagtaatattgtgacc

SEQ ID NO: 4050 - protein, 13 aa, Artificial Sequence
  Description of Artificial Sequence: Synthetic peptide
SGSCSNIGSNIVT

SEQ ID NO: 4051 - DNA, 33 bp, Artificial Sequence
  Description of Artificial Sequence: Synthetic oligonucleotide
tcaggagataaatcggggaataaatatgtttcc

SEQ ID NO: 4052 - protein, 11 aa, Artificial Sequence
  Description of Artificial Sequence: Synthetic peptide
SGDKSGNKYVS

SEQ ID NO: 4053 - DNA, 33 bp, Artificial Sequence; identical to SEQ ID NO: 701
  Description of Artificial Sequence: Synthetic oligonucleotide

SEQ ID NO: 4054 - protein, 11 aa, Artificial Sequence
  Description of Artificial Sequence: Synthetic peptide
SGDKLGNKYAC

SEQ ID NO: 4055 - DNA, 33 bp, Artificial Sequence; identical to SEQ ID NO: 2317
  Description of Artificial Sequence: Synthetic oligonucleotide

SEQ ID NO: 4056 - protein, 11 aa, Artificial Sequence
  Description of Artificial Sequence: Synthetic peptide
RASQDIRKDLG

SEQ ID NO: 4057 - DNA, 51 bp, Artificial Sequence
  Description of Artificial Sequence: Synthetic oligonucleotide
aagtccagccagagtgttttatacagctccaacaataagaactacttaact

SEQ ID NO: 4058 - protein, 17 aa, Artificial Sequence
  Description of Artificial Sequence: Synthetic peptide
KSSQSVLYSSNNKNYLT

SEQ ID NO: 4059 - DNA, 33 bp, Artificial Sequence
  Description of Artificial Sequence: Synthetic oligonucleotide
agggccagtcagagtgttcgcagtaacttagcc

SEQ ID NO: 4060 - protein, 11 aa, Artificial Sequence
  Description of Artificial Sequence: Synthetic peptide
RASQSVRSNLA

SEQ ID NO: 4061 - DNA, 33 bp, Artificial Sequence; identical to SEQ ID NO: 401
  Description of Artificial Sequence: Synthetic oligonucleotide

SEQ ID NO: 4062 - protein, 11 aa, Artificial Sequence
  Description of Artificial Sequence: Synthetic peptide
RASQGIRNYLA

SEQ ID NO: 4063 - DNA, 36 bp, Artificial Sequence
  Description of Artificial Sequence: Synthetic oligonucleotide
agggccagtcagagtgttaacagcaactatttagcc

SEQ ID NO: 4064 - protein, 12 aa, Artificial Sequence
  Description of Artificial Sequence: Synthetic peptide
RASQSVNSNYLA

SEQ ID NO: 4065 - DNA, 51 bp, Artificial Sequence; identical to SEQ ID NO: 2027
  Description of Artificial Sequence: Synthetic oligonucleotide

SEQ ID NO: 4066 - protein, 17 aa, Artificial Sequence
  Description of Artificial Sequence: Synthetic peptide
KSSQNILSSSNNKNYLT

SEQ ID NO: 4067 - DNA, 51 bp, Artificial Sequence; identical to SEQ ID NO: 1057
  Description of Artificial Sequence: Synthetic oligonucleotide

SEQ ID NO: 4068 - protein, 17 aa, Artificial Sequence
  Description of Artificial Sequence: Synthetic peptide
KSSQSVLHSSNNNNYLA

SEQ ID NO: 4069 - DNA, 51 bp, Artificial Sequence; identical to SEQ ID NO: 1683
  Description of Artificial Sequence: Synthetic oligonucleotide

SEQ ID NO: 4070 - protein, 17 aa, Artificial Sequence
  Description of Artificial Sequence: Synthetic peptide
KSSQSVLHSSNNKNYLT

SEQ ID NO: 4071 - DNA, 51 bp, Artificial Sequence
  Description of Artificial Sequence: Synthetic oligonucleotide
aagtccagccagagtgttttatccaactcccacaataacaactacttagct

SEQ ID NO: 4072 - protein, 17 aa, Artificial Sequence
  Description of Artificial Sequence: Synthetic peptide
KSSQSVLSNSHNNNYLA

SEQ ID NO: 4073 - DNA, 51 bp, Artificial Sequence; identical to SEQ ID NO: 1693
  Description of Artificial Sequence: Synthetic oligonucleotide

SEQ ID NO: 4074 - protein, 17 aa, Artificial Sequence
  Description of Artificial Sequence: Synthetic peptide
KSSQSVLFSSNNYNYLA

SEQ ID NO: 4075 - DNA, 33 bp, Artificial Sequence; identical to SEQ ID NO: 109
  Description of Artificial Sequence: Synthetic oligonucleotide

SEQ ID NO: 4076 - protein, 11 aa, Artificial Sequence
  Description of Artificial Sequence: Synthetic peptide
RASQGIRNDLG

SEQ ID NO: 4077 - DNA, 33 bp, Artificial Sequence; identical to SEQ ID NO: 109
  Description of Artificial Sequence: Synthetic oligonucleotide

SEQ ID NO: 4078 - protein, 11 aa, Artificial Sequence
  Description of Artificial Sequence: Synthetic peptide
RASQGIRNDLG

SEQ ID NO: 4079 - DNA, 33 bp, Artificial Sequence
  Description of Artificial Sequence: Synthetic oligonucleotide
cgggcgagtcagtttattagcagctggttagcc

SEQ ID NO: 4080 - protein, 11 aa, Artificial Sequence
  Description of Artificial Sequence: Synthetic peptide
RASQFISSWLA

SEQ ID NO: 4081 - DNA, 33 bp, Artificial Sequence; identical to SEQ ID NO: 109
  Description of Artificial Sequence: Synthetic oligonucleotide

SEQ ID NO: 4082 - protein, 11 aa, Artificial Sequence
  Description of Artificial Sequence: Synthetic peptide
RASQGIRNDLG

SEQ ID NO: 4083 - DNA, 33 bp, Artificial Sequence; identical to SEQ ID NO: 109
  Description of Artificial Sequence: Synthetic oligonucleotide

SEQ ID NO: 4084 - protein, 11 aa, Artificial Sequence
  Description of Artificial Sequence: Synthetic peptide
RASQGIRNDLG

SEQ ID NO: 4085 - DNA, 33 bp, Artificial Sequence; identical to SEQ ID NO: 4079
  Description of Artificial Sequence: Synthetic oligonucleotide

SEQ ID NO: 4086 - protein, 11 aa, Artificial Sequence
  Description of Artificial Sequence: Synthetic peptide
RASQFISSWLA

SEQ ID NO: 4087 - DNA, 15 bp, Artificial Sequence
  Description of Artificial Sequence: Synthetic oligonucleotide
aactatggcatgcac

SEQ ID NO: 4088 - protein, 5 aa, Artificial Sequence
  Description of Artificial Sequence: Synthetic peptide
NYGMH

SEQ ID NO: 4089 - DNA, 15 bp, Artificial Sequence
  Description of Artificial Sequence: Synthetic oligonucleotide
aattatgatatcaac

SEQ ID NO: 4090 - protein, 5 aa, Artificial Sequence
  Description of Artificial Sequence: Synthetic peptide
NYDIN

SEQ ID NO: 4091 - DNA, 15 bp, Artificial Sequence
  Description of Artificial Sequence: Synthetic oligonucleotide
aattatgatatcaac

SEQ ID NO: 4092 - protein, 5 aa, Artificial Sequence
  Description of Artificial Sequence: Synthetic peptide
NYDIN

SEQ ID NO: 4093 - DNA, 15 bp, Artificial Sequence
  Description of Artificial Sequence: Synthetic oligonucleotide
aactatggcatgcac

SEQ ID NO: 4094 - protein, 5 aa, Artificial Sequence
  Description of Artificial Sequence: Synthetic peptide
NYGMH

SEQ ID NO: 4095 - DNA, 15 bp, Artificial Sequence
  Description of Artificial Sequence: Synthetic oligonucleotide
acctatggtatcagc

SEQ ID NO: 4096 - protein, 5 aa, Artificial Sequence
  Description of Artificial Sequence: Synthetic peptide
TYGIS

SEQ ID NO: 4097 - DNA, 15 bp, Artificial Sequence
  Description of Artificial Sequence: Synthetic oligonucleotide
agctatggcatgcac

SEQ ID NO: 4098 - protein, 5 aa, Artificial Sequence
  Description of Artificial Sequence: Synthetic peptide
SYGMH

SEQ ID NO: 4099 - DNA, 15 bp, Artificial Sequence
  Description of Artificial Sequence: Synthetic oligonucleotide
ggctaccatatgcac

SEQ ID NO: 4100 - protein, 5 aa, Artificial Sequence
  Description of Artificial Sequence: Synthetic peptide
GYHMH

SEQ ID NO: 4101 - DNA, 15 bp, Artificial Sequence
  Description of Artificial Sequence: Synthetic oligonucleotide
agttactactggagc

SEQ ID NO: 4102 - protein, 5 aa, Artificial Sequence
  Description of Artificial Sequence: Synthetic peptide
SYYWS

SEQ ID NO: 4103 - DNA, 15 bp, Artificial Sequence
  Description of Artificial Sequence: Synthetic oligonucleotide
ggctactatttgcac

SEQ ID NO: 4104 - protein, 5 aa, Artificial Sequence
  Description of Artificial Sequence: Synthetic peptide
GYYLH

SEQ ID NO: 4105 - DNA, 15 bp, Artificial Sequence
  Description of Artificial Sequence: Synthetic oligonucleotide
ggctactatttgcac

SEQ ID NO: 4106 - protein, 5 aa, Artificial Sequence
  Description of Artificial Sequence: Synthetic peptide
GYYLH

SEQ ID NO: 4107 - DNA, 15 bp, Artificial Sequence
  Description of Artificial Sequence: Synthetic oligonucleotide
ggttgctactggagc

SEQ ID NO: 4108 - protein, 5 aa, Artificial Sequence
  Description of Artificial Sequence: Synthetic peptide
GCYWS

SEQ ID NO: 4109 - DNA, 15 bp, Artificial Sequence
  Description of Artificial Sequence: Synthetic oligonucleotide
gactctctcatgcac

SEQ ID NO: 4110 - protein, 5 aa, Artificial Sequence
  Description of Artificial Sequence: Synthetic peptide
DSLMH

SEQ ID NO: 4111 - DNA, 15 bp, Artificial Sequence
  Description of Artificial Sequence: Synthetic oligonucleotide
agctatggcatgcac

SEQ ID NO: 4112 - protein, 5 aa, Artificial Sequence
  Description of Artificial Sequence: Synthetic peptide
SYGMH

SEQ ID NO: 4113 - DNA, 15 bp, Artificial Sequence
  Description of Artificial Sequence: Synthetic oligonucleotide
aactatggcatggac

SEQ ID NO: 4114 - protein, 5 aa, Artificial Sequence
  Description of Artificial Sequence: Synthetic peptide
NYGMD

SEQ ID NO: 4115 - DNA, 15 bp, Artificial Sequence
  Description of Artificial Sequence: Synthetic oligonucleotide
aactatggcttacac

SEQ ID NO: 4116 - protein, 5 aa, Artificial Sequence
  Description of Artificial Sequence: Synthetic peptide
NYGLH

SEQ ID NO: 4117 - DNA, 15 bp, Artificial Sequence
  Description of Artificial Sequence: Synthetic oligonucleotide
agctatggcatgcac

SEQ ID NO: 4118 - protein, 5 aa, Artificial Sequence
  Description of Artificial Sequence: Synthetic peptide
SYGMH

SEQ ID NO: 4119 - DNA, 15 bp, Artificial Sequence
  Description of Artificial Sequence: Synthetic oligonucleotide
agttatgatatcaac

SEQ ID NO: 4120 - protein, 5 aa, Artificial Sequence
  Description of Artificial Sequence: Synthetic peptide
SYDIN

SEQ ID NO: 4121 - DNA, 15 bp, Artificial Sequence
  Description of Artificial Sequence: Synthetic oligonucleotide
gactatgtcatgcac

SEQ ID NO: 4122 - protein, 5 aa, Artificial Sequence
  Description of Artificial Sequence: Synthetic peptide
DYVMH

SEQ ID NO: 4123 - DNA, 15 bp, Artificial Sequence
  Description of Artificial Sequence: Synthetic oligonucleotide
agctgtggcatgcac

SEQ ID NO: 4124 - protein, 5 aa, Artificial Sequence
  Description of Artificial Sequence: Synthetic peptide
SCGMH

SEQ ID NO: 4125 - DNA, 15 bp, Artificial Sequence
  Description of Artificial Sequence: Synthetic oligonucleotide
ggctactatatgcac

SEQ ID NO: 4126 - protein, 5 aa, Artificial Sequence
  Description of Artificial Sequence: Synthetic peptide
GYYMH

SEQ ID NO: 4127 - DNA, 15 bp, Artificial Sequence
  Description of Artificial Sequence: Synthetic oligonucleotide
ggttgctactggagc

SEQ ID NO: 4128 - protein, 5 aa, Artificial Sequence
  Description of Artificial Sequence: Synthetic peptide
GCYWS

SEQ ID NO: 4129 - DNA, 15 bp, Artificial Sequence
  Description of Artificial Sequence: Synthetic oligonucleotide
ggttgctactggagc

SEQ ID NO: 4130 - protein, 5 aa, Artificial Sequence
  Description of Artificial Sequence: Synthetic peptide
GCYWS

SEQ ID NO: 4131 - DNA, 15 bp, Artificial Sequence
  Description of Artificial Sequence: Synthetic oligonucleotide
agctatggcatgcac

SEQ ID NO: 4132 - protein, 5 aa, Artificial Sequence
  Description of Artificial Sequence: Synthetic peptide
SYGMH

SEQ ID NO: 4133 - DNA, 15 bp, Artificial Sequence
  Description of Artificial Sequence: Synthetic oligonucleotide
ggttgctactggagc

SEQ ID NO: 4134 - protein, 5 aa, Artificial Sequence
  Description of Artificial Sequence: Synthetic peptide
GCYWS

SEQ ID NO: 4135 - DNA, 21 bp, Artificial Sequence
  Description of Artificial Sequence: Synthetic oligonucleotide
agtggtggtgactactggagc

SEQ ID NO: 4136 - protein, 7 aa, Artificial Sequence
  Description of Artificial Sequence: Synthetic peptide
SGGDYWS

SEQ ID NO: 4137 - DNA, 15 bp, Artificial Sequence
  Description of Artificial Sequence: Synthetic oligonucleotide
ggttcctactggagc

SEQ ID NO: 4138 - protein, 5 aa, Artificial Sequence
  Description of Artificial Sequence: Synthetic peptide
GSYWS

SEQ ID NO: 4139 - DNA, 15 bp, Artificial Sequence
  Description of Artificial Sequence: Synthetic oligonucleotide
agctatgtcatgcac

SEQ ID NO: 4140 - protein, 5 aa, Artificial Sequence
  Description of Artificial Sequence: Synthetic peptide
SYVMH

SEQ ID NO: 4141 - DNA, 15 bp, Artificial Sequence
  Description of Artificial Sequence: Synthetic oligonucleotide
agctataacatgaac

SEQ ID NO: 4142 - protein, 5 aa, Artificial Sequence
  Description of Artificial Sequence: Synthetic peptide
SYNMN

SEQ ID NO: 4143 - DNA, 15 bp, Artificial Sequence
  Description of Artificial Sequence: Synthetic oligonucleotide
agctatagcatgaac

SEQ ID NO: 4144 - protein, 5 aa, Artificial Sequence
  Description of Artificial Sequence: Synthetic peptide
SYSMN

SEQ ID NO: 4145 - DNA, 15 bp, Artificial Sequence
  Description of Artificial Sequence: Synthetic oligonucleotide
agctatgccatgagc

SEQ ID NO: 4146 - protein, 5 aa, Artificial Sequence
  Description of Artificial Sequence: Synthetic peptide
SYAMS

SEQ ID NO: 4147 - DNA, 15 bp, Artificial Sequence
  Description of Artificial Sequence: Synthetic oligonucleotide
aattatgatgtcaac

SEQ ID NO: 4148 - protein, 5 aa, Artificial Sequence
  Description of Artificial Sequence: Synthetic peptide
NYDVN

SEQ ID NO: 4149 - DNA, 15 bp, Artificial Sequence
  Description of Artificial Sequence: Synthetic oligonucleotide
aattatgatgtcaac

SEQ ID NO: 4150 - protein, 5 aa, Artificial Sequence
  Description of Artificial Sequence: Synthetic peptide
NYDVN

SEQ ID NO: 4151 - DNA, 15 bp, Artificial Sequence
  Description of Artificial Sequence: Synthetic oligonucleotide
aattatgatatcaac

SEQ ID NO: 4152 - protein, 5 aa, Artificial Sequence
  Description of Artificial Sequence: Synthetic peptide
NYDIN

SEQ ID NO: 4153 - DNA, 21 bp, Artificial Sequence
  Description of Artificial Sequence: Synthetic oligonucleotide
aggagtagttactactggggc

SEQ ID NO: 4154 - protein, 7 aa, Artificial Sequence
  Description of Artificial Sequence: Synthetic peptide
RSSYYWG

SEQ ID NO: 4155 - DNA, 15 bp, Artificial Sequence
  Description of Artificial Sequence: Synthetic oligonucleotide
gactatggcatgcac

SEQ ID NO: 4156 - protein, 5 aa, Artificial Sequence
  Description of Artificial Sequence: Synthetic peptide
DYGMH

SEQ ID NO: 4157 - DNA, 15 bp, Artificial Sequence
  Description of Artificial Sequence: Synthetic oligonucleotide
agctatgtcatgcac

SEQ ID NO: 4158 - protein, 5 aa, Artificial Sequence
  Description of Artificial Sequence: Synthetic peptide
SYVMH

SEQ ID NO: 4159 - DNA, 15 bp, Artificial Sequence
  Description of Artificial Sequence: Synthetic oligonucleotide
gactattatatgcac

SEQ ID NO: 4160 - protein, 5 aa, Artificial Sequence
  Description of Artificial Sequence: Synthetic peptide
DYYMH

SEQ ID NO: 4161 - DNA, 21 bp, Artificial Sequence
  Description of Artificial Sequence: Synthetic oligonucleotide
actagtggagtgggtgtgggc

SEQ ID NO: 4162 - protein, 7 aa, Artificial Sequence
  Description of Artificial Sequence: Synthetic peptide
TSGVGVG

SEQ ID NO: 4163 - DNA, 15 bp, Artificial Sequence
  Description of Artificial Sequence: Synthetic oligonucleotide
ggctactatatgcac

SEQ ID NO: 4164 - protein, 5 aa, Artificial Sequence
  Description of Artificial Sequence: Synthetic peptide
GYYMH

SEQ ID NO: 4165 - DNA, 21 bp, Artificial Sequence
  Description of Artificial Sequence: Synthetic oligonucleotide
ggtagtagttactactggggc

SEQ ID NO: 4166 - protein, 7 aa, Artificial Sequence
  Description of Artificial Sequence: Synthetic peptide
GSSYYWG

SEQ ID NO: 4167 - DNA, 15 bp, Artificial Sequence
  Description of Artificial Sequence: Synthetic oligonucleotide
aattatgatatcaac

SEQ ID NO: 4168 - protein, 5 aa, Artificial Sequence
  Description of Artificial Sequence: Synthetic peptide
NYDIN

SEQ ID NO: 4169 - DNA, 15 bp, Artificial Sequence
  Description of Artificial Sequence: Synthetic oligonucleotide
agctataccatgaac

SEQ ID NO: 4170 - protein, 5 aa, Artificial Sequence
  Description of Artificial Sequence: Synthetic peptide
SYTMN

SEQ ID NO: 4171 - DNA, 15 bp, Artificial Sequence
  Description of Artificial Sequence: Synthetic oligonucleotide
agctataccatgaac

SEQ ID NO: 4172 - protein, 5 aa, Artificial Sequence
  Description of Artificial Sequence: Synthetic peptide
SYTMN

SEQ ID NO: 4173 - DNA, 15 bp, Artificial Sequence
  Description of Artificial Sequence: Synthetic oligonucleotide
agctatgtcatgcac

SEQ ID NO: 4174 - protein, 5 aa, Artificial Sequence
  Description of Artificial Sequence: Synthetic peptide
SYVMH

SEQ ID NO: 4175 - DNA, 15 bp, Artificial Sequence
  Description of Artificial Sequence: Synthetic oligonucleotide
agctatgtcatgcac

SEQ ID NO: 4176 - protein, 5 aa, Artificial Sequence
  Description of Artificial Sequence: Synthetic peptide
SYVMH

SEQ ID NO: 4177 - DNA, 15 bp, Artificial Sequence
  Description of Artificial Sequence: Synthetic oligonucleotide
gactactatttgcac

SEQ ID NO: 4178 - protein, 5 aa, Artificial Sequence
  Description of Artificial Sequence: Synthetic peptide
DYYLH

SEQ ID NO: 4179 - DNA, 15 bp, Artificial Sequence
  Description of Artificial Sequence: Synthetic oligonucleotide
gactactatttgcac

SEQ ID NO: 4180 - protein, 5 aa, Artificial Sequence
  Description of Artificial Sequence: Synthetic peptide
DYYLH

SEQ ID NO: 4181 - DNA, 15 bp, Artificial Sequence
  Description of Artificial Sequence: Synthetic oligonucleotide
gactactatttgcac

SEQ ID NO: 4182 - protein, 5 aa, Artificial Sequence
  Description of Artificial Sequence: Synthetic peptide
DYYLH

SEQ ID NO: 4183 - DNA, 15 bp, Artificial Sequence
  Description of Artificial Sequence: Synthetic oligonucleotide
gactactatttgcac

SEQ ID NO: 4184 - protein, 5 aa, Artificial Sequence
  Description of Artificial Sequence: Synthetic peptide
DYYLH

SEQ ID NO: 4185 - DNA, 15 bp, Artificial Sequence
  Description of Artificial Sequence: Synthetic oligonucleotide
ggctactatctgcac

SEQ ID NO: 4186 - protein, 5 aa, Artificial Sequence
  Description of Artificial Sequence: Synthetic peptide
GYYLH

SEQ ID NO: 4187 - DNA, 15 bp, Artificial Sequence
  Description of Artificial Sequence: Synthetic oligonucleotide
ggctactatctgcac

SEQ ID NO: 4188 - protein, 5 aa, Artificial Sequence
  Description of Artificial Sequence: Synthetic peptide
GYYLH

SEQ ID NO: 4189 - DNA, 15 bp, Artificial Sequence
  Description of Artificial Sequence: Synthetic oligonucleotide
ggytactatatgcac

SEQ ID NO: 4190 - protein, 5 aa, Artificial Sequence
  Description of Artificial Sequence: Synthetic peptide
GYYMH

SEQ ID NO: 4191 - DNA, 21 bp, Artificial Sequence
  Description of Artificial Sequence: Synthetic oligonucleotide
actagtggagtgggtgtgggc

SEQ ID NO: 4192 - protein, 7 aa, Artificial Sequence
  Description of Artificial Sequence: Synthetic peptide
TSGVGVG

SEQ ID NO: 4193 - DNA, 21 bp, Artificial Sequence
  Description of Artificial Sequence: Synthetic oligonucleotide
actggtggagtgggtgtgggc

SEQ ID NO: 4194 - protein, 7 aa, Artificial Sequence
  Description of Artificial Sequence: Synthetic peptide
TGGVGVG

SEQ ID NO: 4195 - DNA, 15 bp, Artificial Sequence
  Description of Artificial Sequence: Synthetic oligonucleotide
ggccactatatgtgc

SEQ ID NO: 4196 - protein, 5 aa, Artificial Sequence
  Description of Artificial Sequence: Synthetic peptide
GHYMC

SEQ ID NO: 4197 - DNA, 21 bp, Artificial Sequence
  Description of Artificial Sequence: Synthetic oligonucleotide
actagtggagtgggtgtgggc

SEQ ID NO: 4198 - protein, 7 aa, Artificial Sequence
  Description of Artificial Sequence: Synthetic peptide
TSGVGVG

SEQ ID NO: 4199 - DNA, 15 bp, Artificial Sequence
  Description of Artificial Sequence: Synthetic oligonucleotide
ggctatggcatgcac

SEQ ID NO: 4200 - protein, 5 aa, Artificial Sequence
  Description of Artificial Sequence: Synthetic peptide
GYGMH

SEQ ID NO: 4201 - DNA, 21 bp, Artificial Sequence
  Description of Artificial Sequence: Synthetic oligonucleotide
actggtggagtgggtgtgggc

SEQ ID NO: 4202 - protein, 7 aa, Artificial Sequence
  Description of Artificial Sequence: Synthetic peptide
TGGVGVG

SEQ ID NO: 4203 - DNA, 15 bp, Artificial Sequence
  Description of Artificial Sequence: Synthetic oligonucleotide
agctatgtcatgagc

SEQ ID NO: 4204 - protein, 5 aa, Artificial Sequence
  Description of Artificial Sequence: Synthetic peptide
SYVMS

SEQ ID NO: 4205 - DNA, 15 bp, Artificial Sequence
  Description of Artificial Sequence: Synthetic oligonucleotide
ggctactatatgcac

SEQ ID NO: 4206 - protein, 5 aa, Artificial Sequence
  Description of Artificial Sequence: Synthetic peptide
GYYMH

SEQ ID NO: 4207 - DNA, 15 bp, Artificial Sequence
  Description of Artificial Sequence: Synthetic oligonucleotide
gactatggcatgcac

SEQ ID NO: 4208 - protein, 5 aa, Artificial Sequence
  Description of Artificial Sequence: Synthetic peptide
DYGMH

SEQ ID NO: 4209 - DNA, 15 bp, Artificial Sequence
  Description of Artificial Sequence: Synthetic oligonucleotide
agctatagcatgaac

SEQ ID NO: 4210 - protein, 5 aa, Artificial Sequence
  Description of Artificial Sequence: Synthetic peptide
SYSMN

SEQ ID NO: 4211 - DNA, 21 bp, Artificial Sequence
  Description of Artificial Sequence: Synthetic oligonucleotide
agaagtagttactactggggc

SEQ ID NO: 4212 - protein, 7 aa, Artificial Sequence
  Description of Artificial Sequence: Synthetic peptide
RSSYYWG

SEQ ID NO: 4213 - DNA, 15 bp, Artificial Sequence
  Description of Artificial Sequence: Synthetic oligonucleotide
agctataccatgaac

SEQ ID NO: 4214 - protein, 5 aa, Artificial Sequence
  Description of Artificial Sequence: Synthetic peptide
SYTMN

SEQ ID NO: 4215 - DNA, 15 bp, Artificial Sequence
  Description of Artificial Sequence: Synthetic oligonucleotide
gactatggcatgcac

SEQ ID NO: 4216 - protein, 5 aa, Artificial Sequence
  Description of Artificial Sequence: Synthetic peptide
DYGMH

SEQ ID NO: 4217 - DNA, 21 bp, Artificial Sequence
  Description of Artificial Sequence: Synthetic oligonucleotide
agaagtagttactactggggc

SEQ ID NO: 4218 - protein, 7 aa, Artificial Sequence
  Description of Artificial Sequence: Synthetic peptide
RSSYYWG

SEQ ID NO: 4219 - DNA, 15 bp, Artificial Sequence
  Description of Artificial Sequence: Synthetic oligonucleotide
gactatggcatgcac

SEQ ID NO: 4220 - protein, 5 aa, Artificial Sequence
  Description of Artificial Sequence: Synthetic peptide
DYGMH

SEQ ID NO: 4221 - DNA, 15 bp, Artificial Sequence
  Description of Artificial Sequence: Synthetic oligonucleotide
agctatagcatgaac

SEQ ID NO: 4222 - protein, 5 aa, Artificial Sequence
  Description of Artificial Sequence: Synthetic peptide
SYSMN

SEQ ID NO: 4223 - DNA, 15 bp, Artificial Sequence
  Description of Artificial Sequence: Synthetic oligonucleotide
aactgtgtcatgcac

SEQ ID NO: 4224 - protein, 5 aa, Artificial Sequence
  Description of Artificial Sequence: Synthetic peptide
NCVMH

SEQ ID NO: 4225 - DNA, 21 bp, Artificial Sequence
  Description of Artificial Sequence: Synthetic oligonucleotide
cgcaacactgctgcttggagc

SEQ ID NO: 4226 - protein, 7 aa, Artificial Sequence
  Description of Artificial Sequence: Synthetic peptide
RNTAAWS

SEQ ID NO: 4227 - DNA, 21 bp, Artificial Sequence
  Description of Artificial Sequence: Synthetic oligonucleotide
agaagtagttactattggggc

SEQ ID NO: 4228 - protein, 7 aa, Artificial Sequence
  Description of Artificial Sequence: Synthetic peptide
RSSYYWG

SEQ ID NO: 4229 - DNA, 15 bp, Artificial Sequence
  Description of Artificial Sequence: Synthetic oligonucleotide
agctatggcatgcat

SEQ ID NO: 4230 - protein, 5 aa, Artificial Sequence
  Description of Artificial Sequence: Synthetic peptide
SYGMH

SEQ ID NO: 4231 - DNA, 21 bp, Artificial Sequence
  Description of Artificial Sequence: Synthetic oligonucleotide
aggagtagttattactggggc

SEQ ID NO: 4232 - protein, 7 aa, Artificial Sequence
  Description of Artificial Sequence: Synthetic peptide
RSSYYWG

SEQ ID NO: 4233 - DNA, 15 bp, Artificial Sequence
  Description of Artificial Sequence: Synthetic oligonucleotide
aactatggcatgcac

SEQ ID NO: 4234 - protein, 5 aa, Artificial Sequence
  Description of Artificial Sequence: Synthetic peptide
NYGMH

SEQ ID NO: 4235 - DNA, 15 bp, Artificial Sequence
  Description of Artificial Sequence: Synthetic oligonucleotide
agcgatgacatgcac

SEQ ID NO: 4236 - protein, 5 aa, Artificial Sequence
  Description of Artificial Sequence: Synthetic peptide
SDDMH

SEQ ID NO: 4237 - DNA, 21 bp, Artificial Sequence
  Description of Artificial Sequence: Synthetic oligonucleotide
cgcaacactgctgcttggagc

SEQ ID NO: 4238 - protein, 7 aa, Artificial Sequence
  Description of Artificial Sequence: Synthetic peptide
RNTAAWS

SEQ ID NO: 4239 - DNA, 15 bp, Artificial Sequence
  Description of Artificial Sequence: Synthetic oligonucleotide
gactactacatgagc

SEQ ID NO: 4240 - protein, 5 aa, Artificial Sequence
  Description of Artificial Sequence: Synthetic peptide
DYYMS

SEQ ID NO: 4241 - DNA, 15 bp, Artificial Sequence
  Description of Artificial Sequence: Synthetic oligonucleotide
agctatgccatgaac

SEQ ID NO: 4242 - protein, 5 aa, Artificial Sequence
  Description of Artificial Sequence: Synthetic peptide
SYAMN

SEQ ID NO: 4243 - DNA, 15 bp, Artificial Sequence
  Description of Artificial Sequence: Synthetic oligonucleotide
aactatggcatgcac

SEQ ID NO: 4244 - protein, 5 aa, Artificial Sequence
  Description of Artificial Sequence: Synthetic peptide
NYGMH

SEQ ID NO: 4245 - DNA, 21 bp, Artificial Sequence
  Description of Artificial Sequence: Synthetic oligonucleotide
aggagtagttactactggggc

SEQ ID NO: 4246 - protein, 7 aa, Artificial Sequence
  Description of Artificial Sequence: Synthetic peptide
RSSYYWG

SEQ ID NO: 4247 - DNA, 15 bp, Artificial Sequence
  Description of Artificial Sequence: Synthetic oligonucleotide
aactatggcatgcac

SEQ ID NO: 4248 - protein, 5 aa, Artificial Sequence
  Description of Artificial Sequence: Synthetic peptide
NYGMH

SEQ ID NO: 4249 - DNA, 15 bp, Artificial Sequence
  Description of Artificial Sequence: Synthetic oligonucleotide
agttatgacatgcac

SEQ ID NO: 4250 - protein, 5 aa, Artificial Sequence
  Description of Artificial Sequence: Synthetic peptide
SYDMH

SEQ ID NO: 4251 - DNA, 15 bp, Artificial Sequence
  Description of Artificial Sequence: Synthetic oligonucleotide
agctatggcatgcac

SEQ ID NO: 4252 - protein, 5 aa, Artificial Sequence
  Description of Artificial Sequence: Synthetic peptide
SYGMH

SEQ ID NO: 4253 - DNA, 15 bp, Artificial Sequence
  Description of Artificial Sequence: Synthetic oligonucleotide
agctatggcatgcac

SEQ ID NO: 4254 - protein, 5 aa, Artificial Sequence
  Description of Artificial Sequence: Synthetic peptide
SYGMH

SEQ ID NO: 4255 - DNA, 15 bp, Artificial Sequence
  Description of Artificial Sequence: Synthetic oligonucleotide
agctatgccatgaac

SEQ ID NO: 4256 - protein, 5 aa, Artificial Sequence
  Description of Artificial Sequence: Synthetic peptide
SYAMN

SEQ ID NO: 4257 - DNA, 15 bp, Artificial Sequence
  Description of Artificial Sequence: Synthetic oligonucleotide
gactatggcatgcac

SEQ ID NO: 4258 - protein, 5 aa, Artificial Sequence
  Description of Artificial Sequence: Synthetic peptide
DYGMH

SEQ ID NO: 4259 - DNA, 21 bp, Artificial Sequence
  Description of Artificial Sequence: Synthetic oligonucleotide
ggtagtagttactactggggc

SEQ ID NO: 4260 - protein, 7 aa, Artificial Sequence
  Description of Artificial Sequence: Synthetic peptide
GSSYYWG

SEQ ID NO: 4261 - DNA, 15 bp, Artificial Sequence
  Description of Artificial Sequence: Synthetic oligonucleotide
agctatgccatgaac

SEQ ID NO: 4262 - protein, 5 aa, Artificial Sequence
  Description of Artificial Sequence: Synthetic peptide
SYAMN

SEQ ID NO: 4263 - DNA, 15 bp, Artificial Sequence
  Description of Artificial Sequence: Synthetic oligonucleotide
aactatggcatgcac

SEQ ID NO: 4264 - protein, 5 aa, Artificial Sequence
  Description of Artificial Sequence: Synthetic peptide
NYGMH

SEQ ID NO: 4265 - DNA, 15 bp, Artificial Sequence
  Description of Artificial Sequence: Synthetic oligonucleotide
agctatagaatgaac

SEQ ID NO: 4266 - protein, 5 aa, Artificial Sequence
  Description of Artificial Sequence: Synthetic peptide
SYRMN

SEQ ID NO: 4267 - DNA, 15 bp, Artificial Sequence
  Description of Artificial Sequence: Synthetic oligonucleotide
aactatggcatgaac

SEQ ID NO: 4268 - protein, 5 aa, Artificial Sequence
  Description of Artificial Sequence: Synthetic peptide
NYGMN

SEQ ID NO: 4269 - DNA, 15 bp, Artificial Sequence
  Description of Artificial Sequence: Synthetic oligonucleotide
gactatggcatgcac

SEQ ID NO: 4270 - protein, 5 aa, Artificial Sequence
  Description of Artificial Sequence: Synthetic peptide
DYGMH

SEQ ID NO: 4271 - DNA, 15 bp, Artificial Sequence
  Description of Artificial Sequence: Synthetic oligonucleotide
gactatggcatgcac

SEQ ID NO: 4272 - protein, 5 aa, Artificial Sequence
  Description of Artificial Sequence: Synthetic peptide
DYGMH

SEQ ID NO: 4273 - DNA, 15 bp, Artificial Sequence
  Description of Artificial Sequence: Synthetic oligonucleotide
acctatagcatgaac

SEQ ID NO: 4274 - protein, 5 aa, Artificial Sequence
  Description of Artificial Sequence: Synthetic peptide
TYSMN

SEQ ID NO: 4275 - DNA, 15 bp, Artificial Sequence
  Description of Artificial Sequence: Synthetic oligonucleotide
agctatgccatgcac

SEQ ID NO: 4276 - protein, 5 aa, Artificial Sequence
  Description of Artificial Sequence: Synthetic peptide
SYAMH

SEQ ID NO: 4277 - DNA, 15 bp, Artificial Sequence
  Description of Artificial Sequence: Synthetic oligonucleotide
agctatgccatgacc

SEQ ID NO: 4278 - protein, 5 aa, Artificial Sequence
  Description of Artificial Sequence: Synthetic peptide
SYAMT

SEQ ID NO: 4279 - DNA, 15 bp, Artificial Sequence
  Description of Artificial Sequence: Synthetic oligonucleotide
aactatggcatgcac

SEQ ID NO: 4280 - protein, 5 aa, Artificial Sequence
  Description of Artificial Sequence: Synthetic peptide
NYGMH

SEQ ID NO: 4281 - DNA, 15 bp, Artificial Sequence
  Description of Artificial Sequence: Synthetic oligonucleotide
agctatgccatgaac

SEQ ID NO: 4282 - protein, 5 aa, Artificial Sequence
  Description of Artificial Sequence: Synthetic peptide
SYAMN

SEQ ID NO: 4283 - DNA, 15 bp, Artificial Sequence
  Description of Artificial Sequence: Synthetic oligonucleotide
agctatgccatgagc

SEQ ID NO: 4284 - protein, 5 aa, Artificial Sequence
  Description of Artificial Sequence: Synthetic peptide
SYAMS

SEQ ID NO: 4285 - DNA, 21 bp, Artificial Sequence
  Description of Artificial Sequence: Synthetic oligonucleotide
agaagtagttattactggggc

SEQ ID NO: 4286 - protein, 7 aa, Artificial Sequence
  Description of Artificial Sequence: Synthetic peptide
RSSYYWG

SEQ ID NO: 4287 - DNA, 15 bp, Artificial Sequence
  Description of Artificial Sequence: Synthetic oligonucleotide
agctatagcatgaac

SEQ ID NO: 4288 - protein, 5 aa, Artificial Sequence
  Description of Artificial Sequence: Synthetic peptide
SYSMN

SEQ ID NO: 4289 - DNA, 15 bp, Artificial Sequence
  Description of Artificial Sequence: Synthetic oligonucleotide
agctatggcatgcac

SEQ ID NO: 4290 - protein, 5 aa, Artificial Sequence
  Description of Artificial Sequence: Synthetic peptide
SYGMH

SEQ ID NO: 4291 - DNA, 15 bp, Artificial Sequence
  Description of Artificial Sequence: Synthetic oligonucleotide
agctatgccatgacc

SEQ ID NO: 4292 - protein, 5 aa, Artificial Sequence
  Description of Artificial Sequence: Synthetic peptide
SYAMT

SEQ ID NO: 4293 - DNA, 15 bp, Artificial Sequence
  Description of Artificial Sequence: Synthetic oligonucleotide
gactatggcatgcac

SEQ ID NO: 4294 - protein, 5 aa, Artificial Sequence
  Description of Artificial Sequence: Synthetic peptide
DYGMH

SEQ ID NO: 4295 - DNA, 15 bp, Artificial Sequence
  Description of Artificial Sequence: Synthetic oligonucleotide
agctatgctatcaac

SEQ ID NO: 4296 - protein, 5 aa, Artificial Sequence
  Description of Artificial Sequence: Synthetic peptide
SYAIN

SEQ ID NO: 4297 - DNA, 15 bp, Artificial Sequence
  Description of Artificial Sequence: Synthetic oligonucleotide
agctatgccatgagc

SEQ ID NO: 4298 - protein, 5 aa, Artificial Sequence
  Description of Artificial Sequence: Synthetic peptide
SYAMS

SEQ ID NO: 4299 - DNA, 15 bp, Artificial Sequence
  Description of Artificial Sequence: Synthetic oligonucleotide
agctatgccatgagc

SEQ ID NO: 4300 - protein, 5 aa, Artificial Sequence
  Description of Artificial Sequence: Synthetic peptide
SYAMS

SEQ ID NO: 4301 - DNA, 15 bp, Artificial Sequence
  Description of Artificial Sequence: Synthetic oligonucleotide
agctatagcatgaac

SEQ ID NO: 4302 - protein, 5 aa, Artificial Sequence
  Description of Artificial Sequence: Synthetic peptide
SYSMN

SEQ ID NO: 4303 - DNA, 15 bp, Artificial Sequence
  Description of Artificial Sequence: Synthetic oligonucleotide
gactattacatgagc

SEQ ID NO: 4304 - protein, 5 aa, Artificial Sequence
  Description of Artificial Sequence: Synthetic peptide
DYYMS

SEQ ID NO: 4305 - DNA, 15 bp, Artificial Sequence
  Description of Artificial Sequence: Synthetic oligonucleotide
agctatgccatgaac

SEQ ID NO: 4306 - protein, 5 aa, Artificial Sequence
  Description of Artificial Sequence: Synthetic peptide
SYAMN

SEQ ID NO: 4307 - DNA, 15 bp, Artificial Sequence
  Description of Artificial Sequence: Synthetic oligonucleotide
gactatggcatgcac

SEQ ID NO: 4308 - protein, 5 aa, Artificial Sequence
  Description of Artificial Sequence: Synthetic peptide
DYGMH

SEQ ID NO: 4309 - DNA, 15 bp, Artificial Sequence
  Description of Artificial Sequence: Synthetic oligonucleotide
agctatggcttgaac

SEQ ID NO: 4310 - protein, 5 aa, Artificial Sequence
  Description of Artificial Sequence: Synthetic peptide
SYGLN

SEQ ID NO: 4311 - DNA, 15 bp, Artificial Sequence
  Description of Artificial Sequence: Synthetic oligonucleotide
agctatgccatgaac

SEQ ID NO: 4312 - protein, 5 aa, Artificial Sequence
  Description of Artificial Sequence: Synthetic peptide
SYAMN

SEQ ID NO: 4313 - DNA, 15 bp, Artificial Sequence
  Description of Artificial Sequence: Synthetic oligonucleotide
agctatggcatgcac

SEQ ID NO: 4314 - protein, 5 aa, Artificial Sequence
  Description of Artificial Sequence: Synthetic peptide
SYGMH

SEQ ID NO: 4315 - DNA, 15 bp, Artificial Sequence
  Description of Artificial Sequence: Synthetic oligonucleotide
gactatggcatgcac

SEQ ID NO: 4316 - protein, 5 aa, Artificial Sequence
  Description of Artificial Sequence: Synthetic peptide
DYGMH

SEQ ID NO: 4317 - DNA, 15 bp, Artificial Sequence
  Description of Artificial Sequence: Synthetic oligonucleotide
aattatgtcattcac

SEQ ID NO: 4318 - protein, 5 aa, Artificial Sequence
  Description of Artificial Sequence: Synthetic peptide
NYVIH

SEQ ID NO: 4319 - DNA, 15 bp, Artificial Sequence
  Description of Artificial Sequence: Synthetic oligonucleotide
agctatggcatgcac

SEQ ID NO: 4320 - protein, 5 aa, Artificial Sequence
  Description of Artificial Sequence: Synthetic peptide
SYGMH

SEQ ID NO: 4321 - DNA, 15 bp, Artificial Sequence
  Description of Artificial Sequence: Synthetic oligonucleotide
agctatagcatgaac

SEQ ID NO: 4322 - protein, 5 aa, Artificial Sequence
  Description of Artificial Sequence: Synthetic peptide
SYSMN

SEQ ID NO: 4323 - DNA, 15 bp, Artificial Sequence
  Description of Artificial Sequence: Synthetic oligonucleotide
agctatagcgtgaac

SEQ ID NO: 4324 - protein, 5 aa, Artificial Sequence
  Description of Artificial Sequence: Synthetic peptide
SYSVN

SEQ ID NO: 4325 - DNA, 15 bp, Artificial Sequence
  Description of Artificial Sequence: Synthetic oligonucleotide
agcgatgacatgcac

SEQ ID NO: 4326 - protein, 5 aa, Artificial Sequence
  Description of Artificial Sequence: Synthetic peptide
SDDMH

SEQ ID NO: 4327 - DNA, 15 bp, Artificial Sequence
  Description of Artificial Sequence: Synthetic oligonucleotide
agctatggcatgcac

SEQ ID NO: 4328 - protein, 5 aa, Artificial Sequence
  Description of Artificial Sequence: Synthetic peptide
SYGMH

SEQ ID NO: 4329 - DNA, 15 bp, Artificial Sequence
  Description of Artificial Sequence: Synthetic oligonucleotide
gactatggcatgcac

SEQ ID NO: 4330 - protein, 5 aa, Artificial Sequence
  Description of Artificial Sequence: Synthetic peptide
DYGMH

SEQ ID NO: 4331 - DNA, 15 bp, Artificial Sequence
  Description of Artificial Sequence: Synthetic oligonucleotide
agctatgccatgaac

SEQ ID NO: 4332 - protein, 5 aa, Artificial Sequence
  Description of Artificial Sequence: Synthetic peptide
SYAMN

SEQ ID NO: 4333 - DNA, 15 bp, Artificial Sequence
  Description of Artificial Sequence: Synthetic oligonucleotide
agctatgccatgaac

SEQ ID NO: 4334 - protein, 5 aa, Artificial Sequence
  Description of Artificial Sequence: Synthetic peptide
SYAMN

SEQ ID NO: 4335 - DNA, 15 bp, Artificial Sequence
  Description of Artificial Sequence: Synthetic oligonucleotide
agctatgccatgaac

SEQ ID NO: 4336 - protein, 5 aa, Artificial Sequence
  Description of Artificial Sequence: Synthetic peptide
SYAMN

SEQ ID NO: 4337 - DNA, 15 bp, Artificial Sequence
  Description of Artificial Sequence: Synthetic oligonucleotide
agctatgccatgaac

SEQ ID NO: 4338 - protein, 5 aa, Artificial Sequence
  Description of Artificial Sequence: Synthetic peptide
SYAMN

SEQ ID NO: 4339 - DNA, 15 bp, Artificial Sequence
  Description of Artificial Sequence: Synthetic oligonucleotide
agttatagcatgaac

SEQ ID NO: 4340 - protein, 5 aa, Artificial Sequence
  Description of Artificial Sequence: Synthetic peptide
SYSMN

SEQ ID NO: 4341 - DNA, 15 bp, Artificial Sequence
  Description of Artificial Sequence: Synthetic oligonucleotide
agctatgccatgaac

SEQ ID NO: 4342 - protein, 5 aa, Artificial Sequence
  Description of Artificial Sequence: Synthetic peptide
SYAMN

SEQ ID NO: 4343 - DNA, 15 bp, Artificial Sequence
  Description of Artificial Sequence: Synthetic oligonucleotide
agctatggcatgcac

SEQ ID NO: 4344 - protein, 5 aa, Artificial Sequence
  Description of Artificial Sequence: Synthetic peptide
SYGMH

SEQ ID NO: 4345 - DNA, 21 bp, Artificial Sequence
  Description of Artificial Sequence: Synthetic oligonucleotide
agaagtagttactactggggc

SEQ ID NO: 4346 - protein, 7 aa, Artificial Sequence
  Description of Artificial Sequence: Synthetic peptide
RSSYYWG

SEQ ID NO: 4347 - DNA, 15 bp, Artificial Sequence
  Description of Artificial Sequence: Synthetic oligonucleotide
agctatagcatgaac

SEQ ID NO: 4348 - protein, 5 aa, Artificial Sequence
  Description of Artificial Sequence: Synthetic peptide
SYSMN

SEQ ID NO: 4349 - DNA, 15 bp, Artificial Sequence
  Description of Artificial Sequence: Synthetic oligonucleotide
agctatagcatgaac

SEQ ID NO: 4350 - protein, 5 aa, Artificial Sequence
  Description of Artificial Sequence: Synthetic peptide
SYSMN

SEQ ID NO: 4351 - DNA, 15 bp, Artificial Sequence
  Description of Artificial Sequence: Synthetic oligonucleotide
agctatggcatgcac

SEQ ID NO: 4352 - protein, 5 aa, Artificial Sequence
  Description of Artificial Sequence: Synthetic peptide
SYGMH

SEQ ID NO: 4353 - DNA, 15 bp, Artificial Sequence
  Description of Artificial Sequence: Synthetic oligonucleotide
agctatagcatgaac

SEQ ID NO: 4354 - protein, 5 aa, Artificial Sequence
  Description of Artificial Sequence: Synthetic peptide
SYSMN

SEQ ID NO: 4355 - DNA, 15 bp, Artificial Sequence
  Description of Artificial Sequence: Synthetic oligonucleotide
agctatgttatgagc

SEQ ID NO: 4356 - protein, 5 aa, Artificial Sequence
  Description of Artificial Sequence: Synthetic peptide
SYVMS

SEQ ID NO: 4357 - DNA, 15 bp, Artificial Sequence
  Description of Artificial Sequence: Synthetic oligonucleotide
aattatgatatcaac

SEQ ID NO: 4358 - protein, 5 aa, Artificial Sequence
  Description of Artificial Sequence: Synthetic peptide
NYDIN

SEQ ID NO: 4359 - DNA, 15 bp, Artificial Sequence
  Description of Artificial Sequence: Synthetic oligonucleotide
agctatagcatgaac

SEQ ID NO: 4360 - protein, 5 aa, Artificial Sequence
  Description of Artificial Sequence: Synthetic peptide
SYSMN

SEQ ID NO: 4361 - DNA, 15 bp, Artificial Sequence
  Description of Artificial Sequence: Synthetic oligonucleotide
gactatggcatgcac

SEQ ID NO: 4362 - protein, 5 aa, Artificial Sequence
  Description of Artificial Sequence: Synthetic peptide
DYGMH

SEQ ID NO: 4363 - DNA, 15 bp, Artificial Sequence
  Description of Artificial Sequence: Synthetic oligonucleotide
agctatagcatgaac

SEQ ID NO: 4364 - protein, 5 aa, Artificial Sequence
  Description of Artificial Sequence: Synthetic peptide
SYSMN

SEQ ID NO: 4365 - DNA, 21 bp, Artificial Sequence
  Description of Artificial Sequence: Synthetic oligonucleotide
aggagtagttactactggggc

SEQ ID NO: 4366 - protein, 7 aa, Artificial Sequence
  Description of Artificial Sequence: Synthetic peptide
RSSYYWG

SEQ ID NO: 4367 - DNA, 15 bp, Artificial Sequence
  Description of Artificial Sequence: Synthetic oligonucleotide
gactatggcatacac

SEQ ID NO: 4368 - protein, 5 aa, Artificial Sequence
  Description of Artificial Sequence: Synthetic peptide
DYGIH

SEQ ID NO: 4369 - DNA, 15 bp, Artificial Sequence
  Description of Artificial Sequence: Synthetic oligonucleotide
agctatggcatgcac

SEQ ID NO: 4370 - protein, 5 aa, Artificial Sequence
  Description of Artificial Sequence: Synthetic peptide
SYGMH

SEQ ID NO: 4371 - DNA, 21 bp, Artificial Sequence
  Description of Artificial Sequence: Synthetic oligonucleotide
aggagtagttactactggggc

SEQ ID NO: 4372 - protein, 7 aa, Artificial Sequence
  Description of Artificial Sequence: Synthetic peptide
RSSYYWG

SEQ ID NO: 4373 - DNA, 15 bp, Artificial Sequence
  Description of Artificial Sequence: Synthetic oligonucleotide
agctatgccatgaac

SEQ ID NO: 4374 - protein, 5 aa, Artificial Sequence
  Description of Artificial Sequence: Synthetic peptide
SYAMN

SEQ ID NO: 4375 - DNA, 15 bp, Artificial Sequence
  Description of Artificial Sequence: Synthetic oligonucleotide
agctatggcatgcac

SEQ ID NO: 4376 - protein, 5 aa, Artificial Sequence
  Description of Artificial Sequence: Synthetic peptide
SYGMH

SEQ ID NO: 4377 - DNA, 15 bp, Artificial Sequence
  Description of Artificial Sequence: Synthetic oligonucleotide
agctatgccatgagc

SEQ ID NO: 4378 - protein, 5 aa, Artificial Sequence
  Description of Artificial Sequence: Synthetic peptide
SYAMS

SEQ ID NO: 4379 - DNA, 15 bp, Artificial Sequence
  Description of Artificial Sequence: Synthetic oligonucleotide
aactatggcatgcac

SEQ ID NO: 4380 - protein, 5 aa, Artificial Sequence
  Description of Artificial Sequence: Synthetic peptide
NYGMH

SEQ ID NO: 4381 - DNA, 15 bp, Artificial Sequence
  Description of Artificial Sequence: Synthetic oligonucleotide
agctatgccatgaac

SEQ ID NO: 4382 - protein, 5 aa, Artificial Sequence
  Description of Artificial Sequence: Synthetic peptide
SYAMN

SEQ ID NO: 4383 - DNA, 15 bp, Artificial Sequence
  Description of Artificial Sequence: Synthetic oligonucleotide
agctatggcatgcac

SEQ ID NO: 4384 - protein, 5 aa, Artificial Sequence
  Description of Artificial Sequence: Synthetic peptide
SYGMH

SEQ ID NO: 4385 - DNA, 15 bp, Artificial Sequence
  Description of Artificial Sequence: Synthetic oligonucleotide
agctatgccatgagc

SEQ ID NO: 4386 - protein, 5 aa, Artificial Sequence
  Description of Artificial Sequence: Synthetic peptide
SYAMS

SEQ ID NO: 4387 - DNA, 15 bp, Artificial Sequence
  Description of Artificial Sequence: Synthetic oligonucleotide
agctatggcatgcac

SEQ ID NO: 4388 - protein, 5 aa, Artificial Sequence
  Description of Artificial Sequence: Synthetic peptide
SYGMH

SEQ ID NO: 4389 - DNA, 21 bp, Artificial Sequence
  Description of Artificial Sequence: Synthetic oligonucleotide
agaagtagttactactggggc

SEQ ID NO: 4390 - protein, 7 aa, Artificial Sequence
  Description of Artificial Sequence: Synthetic peptide
RSSYYWG

SEQ ID NO: 4391 - DNA, 21 bp, Artificial Sequence
  Description of Artificial Sequence: Synthetic oligonucleotide
aggagtagttactactggggc

SEQ ID NO: 4392 - protein, 7 aa, Artificial Sequence
  Description of Artificial Sequence: Synthetic peptide
RSSYYWG

SEQ ID NO: 4393 - DNA, 21 bp, Artificial Sequence
  Description of Artificial Sequence: Synthetic oligonucleotide
aggagtagttactactggggc

SEQ ID NO: 4394 - protein, 7 aa, Artificial Sequence
  Description of Artificial Sequence: Synthetic peptide
RSSYYWG

SEQ ID NO: 4395 - DNA, 15 bp, Artificial Sequence
  Description of Artificial Sequence: Synthetic oligonucleotide
agctatagcatgaac

SEQ ID NO: 4396 - protein, 5 aa, Artificial Sequence
  Description of Artificial Sequence: Synthetic peptide
SYSMN

SEQ ID NO: 4397 - DNA, 15 bp, Artificial Sequence
  Description of Artificial Sequence: Synthetic oligonucleotide
agttacttctggagc

SEQ ID NO: 4398 - protein, 5 aa, Artificial Sequence
  Description of Artificial Sequence: Synthetic peptide
SYFWS

SEQ ID NO: 4399 - DNA, 15 bp, Artificial Sequence
  Description of Artificial Sequence: Synthetic oligonucleotide
gactatggcatgcac

SEQ ID NO: 4400 - protein, 5 aa, Artificial Sequence
  Description of Artificial Sequence: Synthetic peptide
DYGMH

SEQ ID NO: 4401 - DNA, 21 bp, Artificial Sequence
  Description of Artificial Sequence: Synthetic oligonucleotide
aggagtagttactactggggc

SEQ ID NO: 4402 - protein, 7 aa, Artificial Sequence
  Description of Artificial Sequence: Synthetic peptide
RSSYYWG

SEQ ID NO: 4403 - DNA, 15 bp, Artificial Sequence
  Description of Artificial Sequence: Synthetic oligonucleotide
gactatggcatgcac

SEQ ID NO: 4404 - protein, 5 aa, Artificial Sequence
  Description of Artificial Sequence: Synthetic peptide
DYGMH

SEQ ID NO: 4405 - DNA, 21 bp, Artificial Sequence
  Description of Artificial Sequence: Synthetic oligonucleotide
aggagtagttactactggggc

SEQ ID NO: 4406 - protein, 7 aa, Artificial Sequence
  Description of Artificial Sequence: Synthetic peptide
RSSYYWG

SEQ ID NO: 4407 - DNA, 15 bp, Artificial Sequence
  Description of Artificial Sequence: Synthetic oligonucleotide
agctatgccatgagc

SEQ ID NO: 4408 - protein, 5 aa, Artificial Sequence
  Description of Artificial Sequence: Synthetic peptide
SYAMS

SEQ ID NO: 4409 - DNA, 15 bp, Artificial Sequence
  Description of Artificial Sequence: Synthetic oligonucleotide
agctatgccatgagc

SEQ ID NO: 4410 - protein, 5 aa, Artificial Sequence
  Description of Artificial Sequence: Synthetic peptide
SYAMS

SEQ ID NO: 4411 - DNA, 15 bp, Artificial Sequence
  Description of Artificial Sequence: Synthetic oligonucleotide
tcctataccatgaac

SEQ ID NO: 4412 - protein, 5 aa, Artificial Sequence
  Description of Artificial Sequence: Synthetic peptide
SYTMN

SEQ ID NO: 4413 - DNA, 15 bp, Artificial Sequence
  Description of Artificial Sequence: Synthetic oligonucleotide
aactatgtcatgcac

SEQ ID NO: 4414 - protein, 5 aa, Artificial Sequence
  Description of Artificial Sequence: Synthetic peptide
NYVMH

SEQ ID NO: 4415 - DNA, 15 bp, Artificial Sequence
  Description of Artificial Sequence: Synthetic oligonucleotide
agctatagcatgaac

SEQ ID NO: 4416 - protein, 5 aa, Artificial Sequence
  Description of Artificial Sequence: Synthetic peptide
SYSMN

SEQ ID NO: 4417 - DNA, 15 bp, Artificial Sequence
  Description of Artificial Sequence: Synthetic oligonucleotide
acctatagcatgaac

SEQ ID NO: 4418 - protein, 5 aa, Artificial Sequence
  Description of Artificial Sequence: Synthetic peptide
TYSMN

SEQ ID NO: 4419 - DNA, 15 bp, Artificial Sequence
  Description of Artificial Sequence: Synthetic oligonucleotide
agctatgccatgaac

SEQ ID NO: 4420 - protein, 5 aa, Artificial Sequence
  Description of Artificial Sequence: Synthetic peptide
SYAMN

SEQ ID NO: 4421 - DNA, 15 bp, Artificial Sequence
  Description of Artificial Sequence: Synthetic oligonucleotide
gactatggcatgcac

SEQ ID NO: 4422 - protein, 5 aa, Artificial Sequence
  Description of Artificial Sequence: Synthetic peptide
DYGMH

SEQ ID NO: 4423 - DNA, 15 bp, Artificial Sequence
  Description of Artificial Sequence: Synthetic oligonucleotide
agctatgccatgagc

SEQ ID NO: 4424 - protein, 5 aa, Artificial Sequence
  Description of Artificial Sequence: Synthetic peptide
SYAMS

SEQ ID NO: 4425 - DNA, 21 bp, Artificial Sequence
  Description of Artificial Sequence: Synthetic oligonucleotide
aggagtagttactactggggc

SEQ ID NO: 4426 - protein, 7 aa, Artificial Sequence
  Description of Artificial Sequence: Synthetic peptide
RSSYYWG

SEQ ID NO: 4427 - DNA, 15 bp, Artificial Sequence
  Description of Artificial Sequence: Synthetic oligonucleotide
agctatggcatgcac

SEQ ID NO: 4428 - protein, 5 aa, Artificial Sequence
  Description of Artificial Sequence: Synthetic peptide
SYGMH

SEQ ID NO: 4429 - DNA, 21 bp, Artificial Sequence
  Description of Artificial Sequence: Synthetic oligonucleotide
agtggtggttactactggagc

SEQ ID NO: 4430 - protein, 7 aa, Artificial Sequence
  Description of Artificial Sequence: Synthetic peptide
SGGYYWS

SEQ ID NO: 4431 - DNA, 15 bp, Artificial Sequence
  Description of Artificial Sequence: Synthetic oligonucleotide
agctatggcatgcac

SEQ ID NO: 4432 - protein, 5 aa, Artificial Sequence
  Description of Artificial Sequence: Synthetic peptide
SYGMH

SEQ ID NO: 4433 - DNA, 15 bp, Artificial Sequence
  Description of Artificial Sequence: Synthetic oligonucleotide
agctatggcatgcac

SEQ ID NO: 4434 - protein, 5 aa, Artificial Sequence
  Description of Artificial Sequence: Synthetic peptide
SYGMH

SEQ ID NO: 4435 - DNA, 21 bp, Artificial Sequence
  Description of Artificial Sequence: Synthetic oligonucleotide
aggagtagttactactggggc

SEQ ID NO: 4436 - protein, 7 aa, Artificial Sequence
  Description of Artificial Sequence: Synthetic peptide
RSSYYWG

SEQ ID NO: 4437 - DNA, 15 bp, Artificial Sequence
  Description of Artificial Sequence: Synthetic oligonucleotide
agctatgtcatgcac

SEQ ID NO: 4438 - protein, 5 aa, Artificial Sequence
  Description of Artificial Sequence: Synthetic peptide
SYVMH

SEQ ID NO: 4439 - DNA, 15 bp, Artificial Sequence
  Description of Artificial Sequence: Synthetic oligonucleotide
aactatgccatgagc

SEQ ID NO: 4440 - protein, 5 aa, Artificial Sequence
  Description of Artificial Sequence: Synthetic peptide
NYAMS

SEQ ID NO: 4441 - DNA, 15 bp, Artificial Sequence
  Description of Artificial Sequence: Synthetic oligonucleotide
gactatggcatgcac

SEQ ID NO: 4442 - protein, 5 aa, Artificial Sequence
  Description of Artificial Sequence: Synthetic peptide
DYGMH

SEQ ID NO: 4443 - DNA, 15 bp, Artificial Sequence
  Description of Artificial Sequence: Synthetic oligonucleotide
agctatgccatgagc

SEQ ID NO: 4444 - protein, 5 aa, Artificial Sequence
  Description of Artificial Sequence: Synthetic peptide
SYAMS

SEQ ID NO: 4445 - DNA, 15 bp, Artificial Sequence
  Description of Artificial Sequence: Synthetic oligonucleotide
agctatggcatgcac

SEQ ID NO: 4446 - protein, 5 aa, Artificial Sequence
  Description of Artificial Sequence: Synthetic peptide
SYGMH

SEQ ID NO: 4447 - DNA, 21 bp, Artificial Sequence
  Description of Artificial Sequence: Synthetic oligonucleotide
aggagtagttactactggggc

SEQ ID NO: 4448 - protein, 7 aa, Artificial Sequence
  Description of Artificial Sequence: Synthetic peptide
RSSYYWG

SEQ ID NO: 4449 - DNA, 15 bp, Artificial Sequence
  Description of Artificial Sequence: Synthetic oligonucleotide
agctatggcatgcac

SEQ ID NO: 4450 - protein, 5 aa, Artificial Sequence
  Description of Artificial Sequence: Synthetic peptide
SYGMH

SEQ ID NO: 4451 - DNA, 15 bp, Artificial Sequence
  Description of Artificial Sequence: Synthetic oligonucleotide
aattatgatatcaac

SEQ ID NO: 4452 - protein, 5 aa, Artificial Sequence
  Description of Artificial Sequence: Synthetic peptide
NYDIN

SEQ ID NO: 4453 - DNA, 15 bp, Artificial Sequence
  Description of Artificial Sequence: Synthetic oligonucleotide
agctatggcatgcac

SEQ ID NO: 4454 - protein, 5 aa, Artificial Sequence
  Description of Artificial Sequence: Synthetic peptide
SYGMH

SEQ ID NO: 4455 - DNA, 15 bp, Artificial Sequence
  Description of Artificial Sequence: Synthetic oligonucleotide
agctatgccatgagc

SEQ ID NO: 4456 - protein, 5 aa, Artificial Sequence
  Description of Artificial Sequence: Synthetic peptide
SYAMS

SEQ ID NO: 4457 - DNA, 15 bp, Artificial Sequence
  Description of Artificial Sequence: Synthetic oligonucleotide
agctatgccatgagc

SEQ ID NO: 4458 - protein, 5 aa, Artificial Sequence
  Description of Artificial Sequence: Synthetic peptide
SYAMS

SEQ ID NO: 4459 - DNA, 15 bp, Artificial Sequence
  Description of Artificial Sequence: Synthetic oligonucleotide
gactatggcatgcac

SEQ ID NO: 4460 - protein, 5 aa, Artificial Sequence
  Description of Artificial Sequence: Synthetic peptide
DYGMH

SEQ ID NO: 4461 - DNA, 21 bp, Artificial Sequence
  Description of Artificial Sequence: Synthetic oligonucleotide
agaagtagttactactggggc

SEQ ID NO: 4462 - protein, 7 aa, Artificial Sequence
  Description of Artificial Sequence: Synthetic peptide
RSSYYWG

SEQ ID NO: 4463 - DNA, 15 bp, Artificial Sequence
  Description of Artificial Sequence: Synthetic oligonucleotide
aacgcctggatgaac

SEQ ID NO: 4464 - protein, 5 aa, Artificial Sequence
  Description of Artificial Sequence: Synthetic peptide
NAWMN

SEQ ID NO: 4465 - DNA, 15 bp, Artificial Sequence
  Description of Artificial Sequence: Synthetic oligonucleotide
gactatggcatgcac

SEQ ID NO: 4466 - protein, 5 aa, Artificial Sequence
  Description of Artificial Sequence: Synthetic peptide
DYGMH

SEQ ID NO: 4467 - DNA, 15 bp, Artificial Sequence
  Description of Artificial Sequence: Synthetic oligonucleotide
agctatgccatgagc

SEQ ID NO: 4468 - protein, 5 aa, Artificial Sequence
  Description of Artificial Sequence: Synthetic peptide
SYAMS

SEQ ID NO: 4469 - DNA, 21 bp, Artificial Sequence
  Description of Artificial Sequence: Synthetic oligonucleotide
ggtagtaattactactggggc

SEQ ID NO: 4470 - protein, 7 aa, Artificial Sequence
  Description of Artificial Sequence: Synthetic peptide
GSNYYWG

SEQ ID NO: 4471 - DNA, 15 bp, Artificial Sequence
  Description of Artificial Sequence: Synthetic oligonucleotide
agctatggcatgcac

SEQ ID NO: 4472 - protein, 5 aa, Artificial Sequence
  Description of Artificial Sequence: Synthetic peptide
SYGMH

SEQ ID NO: 4473 - DNA, 15 bp, Artificial Sequence
  Description of Artificial Sequence: Synthetic oligonucleotide
agctatggcatgcac

SEQ ID NO: 4474 - protein, 5 aa, Artificial Sequence
  Description of Artificial Sequence: Synthetic peptide
SYGMH

SEQ ID NO: 4475 - DNA, 15 bp, Artificial Sequence
  Description of Artificial Sequence: Synthetic oligonucleotide
agcgatggcatgcac

SEQ ID NO: 4476 - protein, 5 aa, Artificial Sequence
  Description of Artificial Sequence: Synthetic peptide
SDGMH

SEQ ID NO: 4477 - DNA, 15 bp, Artificial Sequence
  Description of Artificial Sequence: Synthetic oligonucleotide
agctatagcatgaac

SEQ ID NO: 4478 - protein, 5 aa, Artificial Sequence
  Description of Artificial Sequence: Synthetic peptide
SYSMN

SEQ ID NO: 4479 - DNA, 15 bp, Artificial Sequence
  Description of Artificial Sequence: Synthetic oligonucleotide
agctatggcatgcac

SEQ ID NO: 4480 - protein, 5 aa, Artificial Sequence
  Description of Artificial Sequence: Synthetic peptide
SYGMH

SEQ ID NO: 4481 - DNA, 15 bp, Artificial Sequence
  Description of Artificial Sequence: Synthetic oligonucleotide
gactatggcatacac

SEQ ID NO: 4482 - protein, 5 aa, Artificial Sequence
  Description of Artificial Sequence: Synthetic peptide
DYGIH

SEQ ID NO: 4483 - DNA, 15 bp, Artificial Sequence
  Description of Artificial Sequence: Synthetic oligonucleotide
agctatggcatgcac

SEQ ID NO: 4484 - protein, 5 aa, Artificial Sequence
  Description of Artificial Sequence: Synthetic peptide
SYGMH

SEQ ID NO: 4485 - DNA, 15 bp, Artificial Sequence
  Description of Artificial Sequence: Synthetic oligonucleotide
agctatggcatgcac

SEQ ID NO: 4486 - protein, 5 aa, Artificial Sequence
  Description of Artificial Sequence: Synthetic peptide
SYGMH

SEQ ID NO: 4487 - DNA, 15 bp, Artificial Sequence
  Description of Artificial Sequence: Synthetic oligonucleotide
aattatgatattaat

SEQ ID NO: 4488 - protein, 5 aa, Artificial Sequence
  Description of Artificial Sequence: Synthetic peptide
NYDIN

SEQ ID NO: 4489 - DNA, 15 bp, Artificial Sequence
  Description of Artificial Sequence: Synthetic oligonucleotide
aactatggcatgcac

SEQ ID NO: 4490 - protein, 5 aa, Artificial Sequence
  Description of Artificial Sequence: Synthetic peptide
NYGMH

SEQ ID NO: 4491 - DNA, 15 bp, Artificial Sequence
  Description of Artificial Sequence: Synthetic oligonucleotide
agctatggcatgcac

SEQ ID NO: 4492 - protein, 5 aa, Artificial Sequence
  Description of Artificial Sequence: Synthetic peptide
SYGMH

SEQ ID NO: 4493 - DNA, 15 bp, Artificial Sequence
  Description of Artificial Sequence: Synthetic oligonucleotide
aattatgatattaat

SEQ ID NO: 4494 - protein, 5 aa, Artificial Sequence
  Description of Artificial Sequence: Synthetic peptide
NYDIN

SEQ ID NO: 4495 - DNA, 15 bp, Artificial Sequence
  Description of Artificial Sequence: Synthetic oligonucleotide
agctatggcatacac

SEQ ID NO: 4496 - protein, 5 aa, Artificial Sequence
  Description of Artificial Sequence: Synthetic peptide
SYGIH

SEQ ID NO: 4497 - DNA, 15 bp, Artificial Sequence
  Description of Artificial Sequence: Synthetic oligonucleotide
gactatggcattcac

SEQ ID NO: 4498 - protein, 5 aa, Artificial Sequence
  Description of Artificial Sequence: Synthetic peptide
DYGIH

SEQ ID NO: 4499 - DNA, 15 bp, Artificial Sequence
  Description of Artificial Sequence: Synthetic oligonucleotide
agctgtgccatgaac

SEQ ID NO: 4500 - protein, 5 aa, Artificial Sequence
  Description of Artificial Sequence: Synthetic peptide
SCAMN

SEQ ID NO: 4501 - DNA, 15 bp, Artificial Sequence
  Description of Artificial Sequence: Synthetic oligonucleotide
agctatgccatgagc

SEQ ID NO: 4502 - protein, 5 aa, Artificial Sequence
  Description of Artificial Sequence: Synthetic peptide
SYAMS

SEQ ID NO: 4503 - DNA, 15 bp, Artificial Sequence
  Description of Artificial Sequence: Synthetic oligonucleotide
gactatggcatacac

SEQ ID NO: 4504 - protein, 5 aa, Artificial Sequence
  Description of Artificial Sequence: Synthetic peptide
DYGIH

SEQ ID NO: 4505 - DNA, 15 bp, Artificial Sequence
  Description of Artificial Sequence: Synthetic oligonucleotide
agctataggatgaac

SEQ ID NO: 4506 - protein, 5 aa, Artificial Sequence
  Description of Artificial Sequence: Synthetic peptide
SYRMN

SEQ ID NO: 4507 - DNA, 15 bp, Artificial Sequence
  Description of Artificial Sequence: Synthetic oligonucleotide
agctatggcatgaac

SEQ ID NO: 4508 - protein, 5 aa, Artificial Sequence
  Description of Artificial Sequence: Synthetic peptide
SYGMN

SEQ ID NO: 4509 - DNA, 15 bp, Artificial Sequence
  Description of Artificial Sequence: Synthetic oligonucleotide
agctatgccatgagc

SEQ ID NO: 4510 - protein, 5 aa, Artificial Sequence
  Description of Artificial Sequence: Synthetic peptide
SYAMS

SEQ ID NO: 4511 - DNA, 15 bp, Artificial Sequence
  Description of Artificial Sequence: Synthetic oligonucleotide
agctatggcatgcac

SEQ ID NO: 4512 - protein, 5 aa, Artificial Sequence
  Description of Artificial Sequence: Synthetic peptide
SYGMH

SEQ ID NO: 4513 - DNA, 15 bp, Artificial Sequence
  Description of Artificial Sequence: Synthetic oligonucleotide
agctatggcatgcac

SEQ ID NO: 4514 - protein, 5 aa, Artificial Sequence
  Description of Artificial Sequence: Synthetic peptide
SYGMH

SEQ ID NO: 4515 - DNA, 15 bp, Artificial Sequence
  Description of Artificial Sequence: Synthetic oligonucleotide
aattatgatattaat

SEQ ID NO: 4516 - protein, 5 aa, Artificial Sequence
  Description of Artificial Sequence: Synthetic peptide
NYDIN

SEQ ID NO: 4517 - DNA, 15 bp, Artificial Sequence
  Description of Artificial Sequence: Synthetic oligonucleotide
agctatgtcatgaac

SEQ ID NO: 4518 - protein, 5 aa, Artificial Sequence
  Description of Artificial Sequence: Synthetic peptide
SYVMN

SEQ ID NO: 4519 - DNA, 15 bp, Artificial Sequence
  Description of Artificial Sequence: Synthetic oligonucleotide
agctatgccatgagc

SEQ ID NO: 4520 - protein, 5 aa, Artificial Sequence
  Description of Artificial Sequence: Synthetic peptide
SYAMS

SEQ ID NO: 4521 - DNA, 15 bp, Artificial Sequence
  Description of Artificial Sequence: Synthetic oligonucleotide
agctatagcatgaac

SEQ ID NO: 4522 - protein, 5 aa, Artificial Sequence
  Description of Artificial Sequence: Synthetic peptide
SYSMN

SEQ ID NO: 4523 - DNA, 15 bp, Artificial Sequence
  Description of Artificial Sequence: Synthetic oligonucleotide
aactatggcatgcac

SEQ ID NO: 4524 - protein, 5 aa, Artificial Sequence
  Description of Artificial Sequence: Synthetic peptide
NYGMH

SEQ ID NO: 4525 - DNA, 15 bp, Artificial Sequence
  Description of Artificial Sequence: Synthetic oligonucleotide
agctatggcatgcac

SEQ ID NO: 4526 - protein, 5 aa, Artificial Sequence
  Description of Artificial Sequence: Synthetic peptide
SYGMH

SEQ ID NO: 4527 - DNA, 15 bp, Artificial Sequence
  Description of Artificial Sequence: Synthetic oligonucleotide
aactgtgtcatgcac

SEQ ID NO: 4528 - protein, 5 aa, Artificial Sequence
  Description of Artificial Sequence: Synthetic peptide
NCVMH

SEQ ID NO: 4529 - DNA, 15 bp, Artificial Sequence
  Description of Artificial Sequence: Synthetic oligonucleotide
agctatagcctgaac

SEQ ID NO: 4530 - protein, 5 aa, Artificial Sequence
  Description of Artificial Sequence: Synthetic peptide
SYSLN

SEQ ID NO: 4531 - DNA, 15 bp, Artificial Sequence
  Description of Artificial Sequence: Synthetic oligonucleotide
gactatggcatgcac

SEQ ID NO: 4532 - protein, 5 aa, Artificial Sequence
  Description of Artificial Sequence: Synthetic peptide
DYGMH

SEQ ID NO: 4533 - DNA, 15 bp, Artificial Sequence
  Description of Artificial Sequence: Synthetic oligonucleotide
gactatggcatgcac

SEQ ID NO: 4534 - protein, 5 aa, Artificial Sequence
  Description of Artificial Sequence: Synthetic peptide
DYGMH

SEQ ID NO: 4535 - DNA, 15 bp, Artificial Sequence
  Description of Artificial Sequence: Synthetic oligonucleotide
agctatgccatgagc

SEQ ID NO: 4536 - protein, 5 aa, Artificial Sequence
  Description of Artificial Sequence: Synthetic peptide
SYAMS

SEQ ID NO: 4537 - DNA, 15 bp, Artificial Sequence
  Description of Artificial Sequence: Synthetic oligonucleotide
atctatgccatgagc

SEQ ID NO: 4538 - protein, 5 aa, Artificial Sequence
  Description of Artificial Sequence: Synthetic peptide
IYAMS

SEQ ID NO: 4539 - DNA, 15 bp, Artificial Sequence
  Description of Artificial Sequence: Synthetic oligonucleotide
agctatgccatgagc

SEQ ID NO: 4540 - protein, 5 aa, Artificial Sequence
  Description of Artificial Sequence: Synthetic peptide
SYAMS

SEQ ID NO: 4541 - DNA, 15 bp, Artificial Sequence
  Description of Artificial Sequence: Synthetic oligonucleotide
gactatggcatgcac

SEQ ID NO: 4542 - protein, 5 aa, Artificial Sequence
  Description of Artificial Sequence: Synthetic peptide
DYGMH

SEQ ID NO: 4543 - DNA, 15 bp, Artificial Sequence
  Description of Artificial Sequence: Synthetic oligonucleotide
gactatggcatgcac

SEQ ID NO: 4544 - protein, 5 aa, Artificial Sequence
  Description of Artificial Sequence: Synthetic peptide
DYGMH

SEQ ID NO: 4545 - DNA, 15 bp, Artificial Sequence
  Description of Artificial Sequence: Synthetic oligonucleotide
aattatgatatcaac

SEQ ID NO: 4546 - protein, 5 aa, Artificial Sequence
  Description of Artificial Sequence: Synthetic peptide
NYDIN

SEQ ID NO: 4547 - DNA, 15 bp, Artificial Sequence
  Description of Artificial Sequence: Synthetic oligonucleotide
agctatggcatgcac

SEQ ID NO: 4548 - protein, 5 aa, Artificial Sequence
  Description of Artificial Sequence: Synthetic peptide
SYGMH

SEQ ID NO: 4549 - DNA, 15 bp, Artificial Sequence
  Description of Artificial Sequence: Synthetic oligonucleotide
agctatgccatgagc

SEQ ID NO: 4550 - protein, 5 aa, Artificial Sequence
  Description of Artificial Sequence: Synthetic peptide
SYAMS

SEQ ID NO: 4551 - DNA, 15 bp, Artificial Sequence
  Description of Artificial Sequence: Synthetic oligonucleotide
agctatggcatacac

SEQ ID NO: 4552 - protein, 5 aa, Artificial Sequence
  Description of Artificial Sequence: Synthetic peptide
SYGIH

SEQ ID NO: 4553 - DNA, 15 bp, Artificial Sequence
  Description of Artificial Sequence: Synthetic oligonucleotide
agctatggcatgcac

SEQ ID NO: 4554 - protein, 5 aa, Artificial Sequence
  Description of Artificial Sequence: Synthetic peptide
SYGMH

SEQ ID NO: 4555 - DNA, 15 bp, Artificial Sequence
  Description of Artificial Sequence: Synthetic oligonucleotide
tactatggcatgcac

SEQ ID NO: 4556 - protein, 5 aa, Artificial Sequence
  Description of Artificial Sequence: Synthetic peptide
YYGMH

SEQ ID NO: 4557 - DNA, 15 bp, Artificial Sequence
  Description of Artificial Sequence: Synthetic oligonucleotide
agctatgccatgagc

SEQ ID NO: 4558 - protein, 5 aa, Artificial Sequence
  Description of Artificial Sequence: Synthetic peptide
SYAMS

SEQ ID NO: 4559 - DNA, 15 bp, Artificial Sequence
  Description of Artificial Sequence: Synthetic oligonucleotide
agctatagcatgaac

SEQ ID NO: 4560 - protein, 5 aa, Artificial Sequence
  Description of Artificial Sequence: Synthetic peptide
SYSMN

SEQ ID NO: 4561 - DNA, 15 bp, Artificial Sequence
  Description of Artificial Sequence: Synthetic oligonucleotide
agctatgccatgagc

SEQ ID NO: 4562 - protein, 5 aa, Artificial Sequence
  Description of Artificial Sequence: Synthetic peptide
SYAMS

SEQ ID NO: 4563 - DNA, 15 bp, Artificial Sequence
  Description of Artificial Sequence: Synthetic oligonucleotide
agctatggcatgcac

SEQ ID NO: 4564 - protein, 5 aa, Artificial Sequence
  Description of Artificial Sequence: Synthetic peptide
SYGMH

SEQ ID NO: 4565 - DNA, 15 bp, Artificial Sequence
  Description of Artificial Sequence: Synthetic oligonucleotide
agttatggcatgcac

SEQ ID NO: 4566 - protein, 5 aa, Artificial Sequence
  Description of Artificial Sequence: Synthetic peptide
SYGMH

SEQ ID NO: 4567 - DNA, 15 bp, Artificial Sequence
  Description of Artificial Sequence: Synthetic oligonucleotide
agctatgccatgagc

SEQ ID NO: 4568 - protein, 5 aa, Artificial Sequence
  Description of Artificial Sequence: Synthetic peptide
SYAMS

SEQ ID NO: 4569 - DNA, 15 bp, Artificial Sequence
  Description of Artificial Sequence: Synthetic oligonucleotide
gactatggcatgcac

SEQ ID NO: 4570 - protein, 5 aa, Artificial Sequence
  Description of Artificial Sequence: Synthetic peptide
DYGMH

SEQ ID NO: 4571 - DNA, 15 bp, Artificial Sequence
  Description of Artificial Sequence: Synthetic oligonucleotide
agctatggcatgcac

SEQ ID NO: 4572 - protein, 5 aa, Artificial Sequence
  Description of Artificial Sequence: Synthetic peptide
SYGMH

SEQ ID NO: 4573 - DNA, 15 bp, Artificial Sequence
  Description of Artificial Sequence: Synthetic oligonucleotide
agctatagcatgaac

SEQ ID NO: 4574 - protein, 5 aa, Artificial Sequence
  Description of Artificial Sequence: Synthetic peptide
SYSMN

SEQ ID NO: 4575 - DNA, 15 bp, Artificial Sequence
  Description of Artificial Sequence: Synthetic oligonucleotide
agctgtgccatgaac

SEQ ID NO: 4576 - protein, 5 aa, Artificial Sequence
  Description of Artificial Sequence: Synthetic peptide
SCAMN

SEQ ID NO: 4577 - DNA, 15 bp, Artificial Sequence
  Description of Artificial Sequence: Synthetic oligonucleotide
gactatggcatgcac

SEQ ID NO: 4578 - protein, 5 aa, Artificial Sequence
  Description of Artificial Sequence: Synthetic peptide
DYGMH

SEQ ID NO: 4579 - DNA, 15 bp, Artificial Sequence
  Description of Artificial Sequence: Synthetic oligonucleotide
agctatgccatgagc

SEQ ID NO: 4580 - protein, 5 aa, Artificial Sequence
  Description of Artificial Sequence: Synthetic peptide
SYAMS

SEQ ID NO: 4581 - DNA, 15 bp, Artificial Sequence
  Description of Artificial Sequence: Synthetic oligonucleotide
gactatggcatgcac

SEQ ID NO: 4582 - protein, 5 aa, Artificial Sequence
  Description of Artificial Sequence: Synthetic peptide
DYGMH

SEQ ID NO: 4583 - DNA, 15 bp, Artificial Sequence
  Description of Artificial Sequence: Synthetic oligonucleotide
ggctatggcatgcac

SEQ ID NO: 4584 - protein, 5 aa, Artificial Sequence
  Description of Artificial Sequence: Synthetic peptide
GYGMH

SEQ ID NO: 4585 - DNA, 15 bp, Artificial Sequence
  Description of Artificial Sequence: Synthetic oligonucleotide
gactatggcatgcac

SEQ ID NO: 4586 - protein, 5 aa, Artificial Sequence
  Description of Artificial Sequence: Synthetic peptide
DYGMH

SEQ ID NO: 4587 - DNA, 15 bp, Artificial Sequence
  Description of Artificial Sequence: Synthetic oligonucleotide
acctatggcatgcac

SEQ ID NO: 4588 - protein, 5 aa, Artificial Sequence
  Description of Artificial Sequence: Synthetic peptide
TYGMH

SEQ ID NO: 4589 - DNA, 15 bp, Artificial Sequence
  Description of Artificial Sequence: Synthetic oligonucleotide
gactatggcatacac

SEQ ID NO: 4590 - protein, 5 aa, Artificial Sequence
  Description of Artificial Sequence: Synthetic peptide
DYGIH

SEQ ID NO: 4591 - DNA, 15 bp, Artificial Sequence
  Description of Artificial Sequence: Synthetic oligonucleotide
agctatgccatgaac

SEQ ID NO: 4592 - protein, 5 aa, Artificial Sequence
  Description of Artificial Sequence: Synthetic peptide
SYAMN

SEQ ID NO: 4593 - DNA, 15 bp, Artificial Sequence
  Description of Artificial Sequence: Synthetic oligonucleotide
gactactatatgcac

SEQ ID NO: 4594 - protein, 5 aa, Artificial Sequence
  Description of Artificial Sequence: Synthetic peptide
DYYMH

SEQ ID NO: 4595 - DNA, 15 bp, Artificial Sequence
  Description of Artificial Sequence: Synthetic oligonucleotide
agctatggtatcagc

SEQ ID NO: 4596 - protein, 5 aa, Artificial Sequence
  Description of Artificial Sequence: Synthetic peptide
SYGIS

SEQ ID NO: 4597 - DNA, 15 bp, Artificial Sequence
  Description of Artificial Sequence: Synthetic oligonucleotide
aactgtgtcatgcac

SEQ ID NO: 4598 - protein, 5 aa, Artificial Sequence
  Description of Artificial Sequence: Synthetic peptide
NCVMH

SEQ ID NO: 4599 - DNA, 15 bp, Artificial Sequence
  Description of Artificial Sequence: Synthetic oligonucleotide
gactatggcatgcac

SEQ ID NO: 4600 - protein, 5 aa, Artificial Sequence
  Description of Artificial Sequence: Synthetic peptide
DYGMH

SEQ ID NO: 4601 - DNA, 15 bp, Artificial Sequence
  Description of Artificial Sequence: Synthetic oligonucleotide
agctatggtatcagc

SEQ ID NO: 4602 - protein, 5 aa, Artificial Sequence
  Description of Artificial Sequence: Synthetic peptide
SYGIS

SEQ ID NO: 4603 - DNA, 15 bp, Artificial Sequence
  Description of Artificial Sequence: Synthetic oligonucleotide
gactatggcatgcac

SEQ ID NO: 4604 - protein, 5 aa, Artificial Sequence
  Description of Artificial Sequence: Synthetic peptide
DYGMH

SEQ ID NO: 4605 - DNA, 15 bp, Artificial Sequence
  Description of Artificial Sequence: Synthetic oligonucleotide
agctatggcatgcac

SEQ ID NO: 4606 - protein, 5 aa, Artificial Sequence
  Description of Artificial Sequence: Synthetic peptide
SYGMH

SEQ ID NO: 4607 - DNA, 15 bp, Artificial Sequence
  Description of Artificial Sequence: Synthetic oligonucleotide
agctatgccatgaac

SEQ ID NO: 4608 - protein, 5 aa, Artificial Sequence
  Description of Artificial Sequence: Synthetic peptide
SYAMN

SEQ ID NO: 4609 - DNA, 15 bp, Artificial Sequence
  Description of Artificial Sequence: Synthetic oligonucleotide
agctatgccatgagc

SEQ ID NO: 4610 - protein, 5 aa, Artificial Sequence
  Description of Artificial Sequence: Synthetic peptide
SYAMS

SEQ ID NO: 4611 - DNA, 15 bp, Artificial Sequence
  Description of Artificial Sequence: Synthetic oligonucleotide
agctatggcatgcac

SEQ ID NO: 4612 - protein, 5 aa, Artificial Sequence
  Description of Artificial Sequence: Synthetic peptide
SYGMH

SEQ ID NO: 4613 - DNA, 15 bp, Artificial Sequence
  Description of Artificial Sequence: Synthetic oligonucleotide
agttatgatatcaac

SEQ ID NO: 4614 - protein, 5 aa, Artificial Sequence
  Description of Artificial Sequence: Synthetic peptide
SYDIN

SEQ ID NO: 4615 - DNA, 15 bp, Artificial Sequence
  Description of Artificial Sequence: Synthetic oligonucleotide
tactatggcatgcac

SEQ ID NO: 4616 - protein, 5 aa, Artificial Sequence
  Description of Artificial Sequence: Synthetic peptide
YYGMH

SEQ ID NO: 4617 - DNA, 15 bp, Artificial Sequence
  Description of Artificial Sequence: Synthetic oligonucleotide
agctatgccatgagc

SEQ ID NO: 4618 - protein, 5 aa, Artificial Sequence
  Description of Artificial Sequence: Synthetic peptide
SYAMS

SEQ ID NO: 4619 - DNA, 15 bp, Artificial Sequence
  Description of Artificial Sequence: Synthetic oligonucleotide
agctatgccatgaac

SEQ ID NO: 4620 - protein, 5 aa, Artificial Sequence
  Description of Artificial Sequence: Synthetic peptide
SYAMN

SEQ ID NO: 4621 - DNA, 15 bp, Artificial Sequence
  Description of Artificial Sequence: Synthetic oligonucleotide
gactatggcatgcac

SEQ ID NO: 4622 - protein, 5 aa, Artificial Sequence
  Description of Artificial Sequence: Synthetic peptide
DYGMH

SEQ ID NO: 4623 - DNA, 15 bp, Artificial Sequence
  Description of Artificial Sequence: Synthetic oligonucleotide
agctatgccatgaac

SEQ ID NO: 4624 - protein, 5 aa, Artificial Sequence
  Description of Artificial Sequence: Synthetic peptide
SYAMN

SEQ ID NO: 4625 - DNA, 15 bp, Artificial Sequence
  Description of Artificial Sequence: Synthetic oligonucleotide
agctatagcatgaac

SEQ ID NO: 4626 - protein, 5 aa, Artificial Sequence
  Description of Artificial Sequence: Synthetic peptide
SYSMN

SEQ ID NO: 4627 - DNA, 15 bp, Artificial Sequence
  Description of Artificial Sequence: Synthetic oligonucleotide
ggctaccatatgcac

SEQ ID NO: 4628 - protein, 5 aa, Artificial Sequence
  Description of Artificial Sequence: Synthetic peptide
GYHMH

SEQ ID NO: 4629 - DNA, 15 bp, Artificial Sequence
  Description of Artificial Sequence: Synthetic oligonucleotide
agttataccatgagc

SEQ ID NO: 4630 - protein, 5 aa, Artificial Sequence
  Description of Artificial Sequence: Synthetic peptide
SYTMS

SEQ ID NO: 4631 - DNA, 15 bp, Artificial Sequence
  Description of Artificial Sequence: Synthetic oligonucleotide
ggcgattatatgcac

SEQ ID NO: 4632 - protein, 5 aa, Artificial Sequence
  Description of Artificial Sequence: Synthetic peptide
GDYMH

SEQ ID NO: 4633 - DNA, 15 bp, Artificial Sequence
  Description of Artificial Sequence: Synthetic oligonucleotide
gactatcatatgcac

SEQ ID NO: 4634 - protein, 5 aa, Artificial Sequence
  Description of Artificial Sequence: Synthetic peptide
DYHMH

SEQ ID NO: 4635 - DNA, 15 bp, Artificial Sequence
  Description of Artificial Sequence: Synthetic oligonucleotide
aattatgacattaac

SEQ ID NO: 4636 - protein, 5 aa, Artificial Sequence
  Description of Artificial Sequence: Synthetic peptide
NYDIN

SEQ ID NO: 4637 - DNA, 15 bp, Artificial Sequence
  Description of Artificial Sequence: Synthetic oligonucleotide
agctatgtcataaac

SEQ ID NO: 4638 - protein, 5 aa, Artificial Sequence
  Description of Artificial Sequence: Synthetic peptide
SYVIN

SEQ ID NO: 4639 - DNA, 15 bp, Artificial Sequence
  Description of Artificial Sequence: Synthetic oligonucleotide
cactatggcatgcac

SEQ ID NO: 4640 - protein, 5 aa, Artificial Sequence
  Description of Artificial Sequence: Synthetic peptide
HYGMH

SEQ ID NO: 4641 - DNA, 21 bp, Artificial Sequence
  Description of Artificial Sequence: Synthetic oligonucleotide
agaagtagttactactggggc

SEQ ID NO: 4642 - protein, 7 aa, Artificial Sequence
  Description of Artificial Sequence: Synthetic peptide
RSSYYWG

SEQ ID NO: 4643 - DNA, 15 bp, Artificial Sequence
  Description of Artificial Sequence: Synthetic oligonucleotide
agctatgccatgaac

SEQ ID NO: 4644 - protein, 5 aa, Artificial Sequence
  Description of Artificial Sequence: Synthetic peptide
SYAMN

SEQ ID NO: 4645 - DNA, 15 bp, Artificial Sequence
  Description of Artificial Sequence: Synthetic oligonucleotide
gactaccatatacac

SEQ ID NO: 4646 - protein, 5 aa, Artificial Sequence
  Description of Artificial Sequence: Synthetic peptide
DYHIH

SEQ ID NO: 4647 - DNA, 15 bp, Artificial Sequence
  Description of Artificial Sequence: Synthetic oligonucleotide
aactatggcatgcac

SEQ ID NO: 4648 - protein, 5 aa, Artificial Sequence
  Description of Artificial Sequence: Synthetic peptide
NYGMH

SEQ ID NO: 4649 - DNA, 15 bp, Artificial Sequence
  Description of Artificial Sequence: Synthetic oligonucleotide
agctatgccatgagc

SEQ ID NO: 4650 - protein, 5 aa, Artificial Sequence
  Description of Artificial Sequence: Synthetic peptide
SYAMS

SEQ ID NO: 4651 - DNA, 15 bp, Artificial Sequence
  Description of Artificial Sequence: Synthetic oligonucleotide
agctgtgccatgagc

SEQ ID NO: 4652 - protein, 5 aa, Artificial Sequence
  Description of Artificial Sequence: Synthetic peptide
SCAMS

SEQ ID NO: 4653 - DNA, 15 bp, Artificial Sequence
  Description of Artificial Sequence: Synthetic oligonucleotide
aactatgccatgaac

SEQ ID NO: 4654 - protein, 5 aa, Artificial Sequence
  Description of Artificial Sequence: Synthetic peptide
NYAMN

SEQ ID NO: 4655 - DNA, 15 bp, Artificial Sequence
  Description of Artificial Sequence: Synthetic oligonucleotide
ggctactatatgcac

SEQ ID NO: 4656 - protein, 5 aa, Artificial Sequence
  Description of Artificial Sequence: Synthetic peptide
GYYMH

SEQ ID NO: 4657 - DNA, 15 bp, Artificial Sequence
  Description of Artificial Sequence: Synthetic oligonucleotide
agctatgccatgagc

SEQ ID NO: 4658 - protein, 5 aa, Artificial Sequence
  Description of Artificial Sequence: Synthetic peptide
SYAMS

SEQ ID NO: 4659 - DNA, 15 bp, Artificial Sequence
  Description of Artificial Sequence: Synthetic oligonucleotide
ggctactatatgcac

SEQ ID NO: 4660 - protein, 5 aa, Artificial Sequence
  Description of Artificial Sequence: Synthetic peptide
GYYMH

SEQ ID NO: 4661 - DNA, 15 bp, Artificial Sequence
  Description of Artificial Sequence: Synthetic oligonucleotide
agctatgccatgagc

SEQ ID NO: 4662 - protein, 5 aa, Artificial Sequence
  Description of Artificial Sequence: Synthetic peptide
SYAMS

SEQ ID NO: 4663 - DNA, 15 bp, Artificial Sequence
  Description of Artificial Sequence: Synthetic oligonucleotide
gactaccatattcac

SEQ ID NO: 4664 - protein, 5 aa, Artificial Sequence
  Description of Artificial Sequence: Synthetic peptide
DYHIH

SEQ ID NO: 4665 - DNA, 15 bp, Artificial Sequence
  Description of Artificial Sequence: Synthetic oligonucleotide
agctatgccatgaac

SEQ ID NO: 4666 - protein, 5 aa, Artificial Sequence
  Description of Artificial Sequence: Synthetic peptide
SYAMN

SEQ ID NO: 4667 - DNA, 15 bp, Artificial Sequence
  Description of Artificial Sequence: Synthetic oligonucleotide
agttatagcatgaac

SEQ ID NO: 4668 - protein, 5 aa, Artificial Sequence
  Description of Artificial Sequence: Synthetic peptide
SYSMN

SEQ ID NO: 4669 - DNA, 15 bp, Artificial Sequence
  Description of Artificial Sequence: Synthetic oligonucleotide
aactatggcatgcac

SEQ ID NO: 4670 - protein, 5 aa, Artificial Sequence
  Description of Artificial Sequence: Synthetic peptide
NYGMH

SEQ ID NO: 4671 - DNA, 15 bp, Artificial Sequence
  Description of Artificial Sequence: Synthetic oligonucleotide
aactatgccatgagc

SEQ ID NO: 4672 - protein, 5 aa, Artificial Sequence
  Description of Artificial Sequence: Synthetic peptide
NYAMS

SEQ ID NO: 4673 - DNA, 15 bp, Artificial Sequence
  Description of Artificial Sequence: Synthetic oligonucleotide
agctatgccatgagc

SEQ ID NO: 4674 - protein, 5 aa, Artificial Sequence
  Description of Artificial Sequence: Synthetic peptide
SYAMS

SEQ ID NO: 4675 - DNA, 15 bp, Artificial Sequence
  Description of Artificial Sequence: Synthetic oligonucleotide
agctatgccatgagc

SEQ ID NO: 4676 - protein, 5 aa, Artificial Sequence
  Description of Artificial Sequence: Synthetic peptide
SYAMS

SEQ ID NO: 4677 - DNA, 15 bp, Artificial Sequence
  Description of Artificial Sequence: Synthetic oligonucleotide
agctataccatgaac

SEQ ID NO: 4678 - protein, 5 aa, Artificial Sequence
  Description of Artificial Sequence: Synthetic peptide
SYTMN

SEQ ID NO: 4679 - DNA, 15 bp, Artificial Sequence
  Description of Artificial Sequence: Synthetic oligonucleotide
gactaccatatacac

SEQ ID NO: 4680 - protein, 5 aa, Artificial Sequence
  Description of Artificial Sequence: Synthetic peptide
DYHIH

SEQ ID NO: 4681 - DNA, 15 bp, Artificial Sequence
  Description of Artificial Sequence: Synthetic oligonucleotide
aactatgtcatgcac

SEQ ID NO: 4682 - protein, 5 aa, Artificial Sequence
  Description of Artificial Sequence: Synthetic peptide
NYVMH

SEQ ID NO: 4683 - DNA, 15 bp, Artificial Sequence
  Description of Artificial Sequence: Synthetic oligonucleotide
aactatggcatgcac

SEQ ID NO: 4684 - protein, 5 aa, Artificial Sequence
  Description of Artificial Sequence: Synthetic peptide
NYGMH

SEQ ID NO: 4685 - DNA, 15 bp, Artificial Sequence
  Description of Artificial Sequence: Synthetic oligonucleotide
agctatggcatgcac

SEQ ID NO: 4686 - protein, 5 aa, Artificial Sequence
  Description of Artificial Sequence: Synthetic peptide
SYGMH

SEQ ID NO: 4687 - DNA, 15 bp, Artificial Sequence
  Description of Artificial Sequence: Synthetic oligonucleotide
gactactatatacac

SEQ ID NO: 4688 - protein, 5 aa, Artificial Sequence
  Description of Artificial Sequence: Synthetic peptide
DYYIH

SEQ ID NO: 4689 - DNA, 15 bp, Artificial Sequence
  Description of Artificial Sequence: Synthetic oligonucleotide
agctatggcatgaac

SEQ ID NO: 4690 - protein, 5 aa, Artificial Sequence
  Description of Artificial Sequence: Synthetic peptide
SYGMN

SEQ ID NO: 4691 - DNA, 15 bp, Artificial Sequence
  Description of Artificial Sequence: Synthetic oligonucleotide
aattatgacattaac

SEQ ID NO: 4692 - protein, 5 aa, Artificial Sequence
  Description of Artificial Sequence: Synthetic peptide
NYDIN

SEQ ID NO: 4693 - DNA, 15 bp, Artificial Sequence
  Description of Artificial Sequence: Synthetic oligonucleotide
agctatgccatgagc

SEQ ID NO: 4694 - protein, 5 aa, Artificial Sequence
  Description of Artificial Sequence: Synthetic peptide
SYAMS

SEQ ID NO: 4695 - DNA, 15 bp, Artificial Sequence
  Description of Artificial Sequence: Synthetic oligonucleotide
agttatgatatcaac

SEQ ID NO: 4696 - protein, 5 aa, Artificial Sequence
  Description of Artificial Sequence: Synthetic peptide
SYDIN

SEQ ID NO: 4697 - DNA, 15 bp, Artificial Sequence
  Description of Artificial Sequence: Synthetic oligonucleotide
aactatgccatgaac

SEQ ID NO: 4698 - protein, 5 aa, Artificial Sequence
  Description of Artificial Sequence: Synthetic peptide
NYAMN

SEQ ID NO: 4699 - DNA, 15 bp, Artificial Sequence
  Description of Artificial Sequence: Synthetic oligonucleotide
agctatggcatgcac

SEQ ID NO: 4700 - protein, 5 aa, Artificial Sequence
  Description of Artificial Sequence: Synthetic peptide
SYGMH

SEQ ID NO: 4701 - DNA, 15 bp, Artificial Sequence
  Description of Artificial Sequence: Synthetic oligonucleotide
ggctatggcatgcac

SEQ ID NO: 4702 - protein, 5 aa, Artificial Sequence
  Description of Artificial Sequence: Synthetic peptide
GYGMH

SEQ ID NO: 4703 - DNA, 15 bp, Artificial Sequence
  Description of Artificial Sequence: Synthetic oligonucleotide
ggctactatatgcac

SEQ ID NO: 4704 - protein, 5 aa, Artificial Sequence
  Description of Artificial Sequence: Synthetic peptide
GYYMH

SEQ ID NO: 4705 - DNA, 15 bp, Artificial Sequence
  Description of Artificial Sequence: Synthetic oligonucleotide
tactatggcatgcac

SEQ ID NO: 4706 - protein, 5 aa, Artificial Sequence
  Description of Artificial Sequence: Synthetic peptide
YYGMH

SEQ ID NO: 4707 - DNA, 15 bp, Artificial Sequence
  Description of Artificial Sequence: Synthetic oligonucleotide
ggctatggcatgcac

SEQ ID NO: 4708 - protein, 5 aa, Artificial Sequence
  Description of Artificial Sequence: Synthetic peptide
GYGMH

SEQ ID NO: 4709 - DNA, 15 bp, Artificial Sequence
  Description of Artificial Sequence: Synthetic oligonucleotide
agctatggcatgcac

SEQ ID NO: 4710 - protein, 5 aa, Artificial Sequence
  Description of Artificial Sequence: Synthetic peptide
SYGMH

SEQ ID NO: 4711 - DNA, 15 bp, Artificial Sequence
  Description of Artificial Sequence: Synthetic oligonucleotide
ggctactatatgcac

SEQ ID NO: 4712 - protein, 5 aa, Artificial Sequence
  Description of Artificial Sequence: Synthetic peptide
GYYMH

SEQ ID NO: 4713 - DNA, 15 bp, Artificial Sequence
  Description of Artificial Sequence: Synthetic oligonucleotide
agctatgccatgagc

SEQ ID NO: 4714 - protein, 5 aa, Artificial Sequence
  Description of Artificial Sequence: Synthetic peptide
SYAMS

SEQ ID NO: 4715 - DNA, 15 bp, Artificial Sequence
  Description of Artificial Sequence: Synthetic oligonucleotide
ggctactatatgcac

SEQ ID NO: 4716 - protein, 5 aa, Artificial Sequence
  Description of Artificial Sequence: Synthetic peptide
GYYMH

SEQ ID NO: 4717 - DNA, 21 bp, Artificial Sequence
  Description of Artificial Sequence: Synthetic oligonucleotide
actggtggagtgggtgtgggc

SEQ ID NO: 4718 - protein, 7 aa, Artificial Sequence
  Description of Artificial Sequence: Synthetic peptide
TGGVGVG

SEQ ID NO: 4719 - DNA, 15 bp, Artificial Sequence
  Description of Artificial Sequence: Synthetic oligonucleotide
ggctactatatgcac

SEQ ID NO: 4720 - protein, 5 aa, Artificial Sequence
  Description of Artificial Sequence: Synthetic peptide
GYYMH

SEQ ID NO: 4721 - DNA, 21 bp, Artificial Sequence
  Description of Artificial Sequence: Synthetic oligonucleotide
actagtggagtgggtgtgggc

SEQ ID NO: 4722 - protein, 7 aa, Artificial Sequence
  Description of Artificial Sequence: Synthetic peptide
TSGVGVG

SEQ ID NO: 4723 - DNA, 15 bp, Artificial Sequence
  Description of Artificial Sequence: Synthetic oligonucleotide
agctatggcatgcac

SEQ ID NO: 4724 - protein, 5 aa, Artificial Sequence
  Description of Artificial Sequence: Synthetic peptide
SYGMH

SEQ ID NO: 4725 - DNA, 15 bp, Artificial Sequence
  Description of Artificial Sequence: Synthetic oligonucleotide
aacgcctggatgaac

SEQ ID NO: 4726 - protein, 5 aa, Artificial Sequence
  Description of Artificial Sequence: Synthetic peptide
NAWMN

SEQ ID NO: 4727 - DNA, 15 bp, Artificial Sequence
  Description of Artificial Sequence: Synthetic oligonucleotide
agctatgccatgagc

SEQ ID NO: 4728 - protein, 5 aa, Artificial Sequence
  Description of Artificial Sequence: Synthetic peptide
SYAMS

SEQ ID NO: 4729 - DNA, 15 bp, Artificial Sequence
  Description of Artificial Sequence: Synthetic oligonucleotide
ggctatggcctgcac

SEQ ID NO: 4730 - protein, 5 aa, Artificial Sequence
  Description of Artificial Sequence: Synthetic peptide
GYGLH

SEQ ID NO: 4731 - DNA, 15 bp, Artificial Sequence
  Description of Artificial Sequence: Synthetic oligonucleotide
ggctactatatgcac

SEQ ID NO: 4732 - protein, 5 aa, Artificial Sequence
  Description of Artificial Sequence: Synthetic peptide
GYYMH

SEQ ID NO: 4733 - DNA, 15 bp, Artificial Sequence
  Description of Artificial Sequence: Synthetic oligonucleotide
agctatgccatgagc

SEQ ID NO: 4734 - protein, 5 aa, Artificial Sequence
  Description of Artificial Sequence: Synthetic peptide
SYAMS

SEQ ID NO: 4735 - DNA, 15 bp, Artificial Sequence
  Description of Artificial Sequence: Synthetic oligonucleotide
agctatggcatgcac

SEQ ID NO: 4736 - protein, 5 aa, Artificial Sequence
  Description of Artificial Sequence: Synthetic peptide
SYGMH

SEQ ID NO: 4737 - DNA, 15 bp, Artificial Sequence
  Description of Artificial Sequence: Synthetic oligonucleotide
ggctactatatgcac

SEQ ID NO: 4738 - protein, 5 aa, Artificial Sequence
  Description of Artificial Sequence: Synthetic peptide
GYYMH

SEQ ID NO: 4739 - DNA, 15 bp, Artificial Sequence
  Description of Artificial Sequence: Synthetic oligonucleotide
gggcactatatgcac

SEQ ID NO: 4740 - protein, 5 aa, Artificial Sequence
  Description of Artificial Sequence: Synthetic peptide
GHYMH

SEQ ID NO: 4741 - DNA, 15 bp, Artificial Sequence
  Description of Artificial Sequence: Synthetic oligonucleotide
ggctactatatgcac

SEQ ID NO: 4742 - protein, 5 aa, Artificial Sequence
  Description of Artificial Sequence: Synthetic peptide
GYYMH

SEQ ID NO: 4743 - DNA, 21 bp, Artificial Sequence
  Description of Artificial Sequence: Synthetic oligonucleotide
actggtggagtgggtgtgggc

SEQ ID NO: 4744 - protein, 7 aa, Artificial Sequence
  Description of Artificial Sequence: Synthetic peptide
TGGVGVG

SEQ ID NO: 4745 - DNA, 15 bp, Artificial Sequence
  Description of Artificial Sequence: Synthetic oligonucleotide
ggctactatatgcac

SEQ ID NO: 4746 - protein, 5 aa, Artificial Sequence
  Description of Artificial Sequence: Synthetic peptide
GYYMH

SEQ ID NO: 4747 - DNA, 15 bp, Artificial Sequence
  Description of Artificial Sequence: Synthetic oligonucleotide
ggctactatatgtac

SEQ ID NO: 4748 - protein, 5 aa, Artificial Sequence
  Description of Artificial Sequence: Synthetic peptide
GYYMY

SEQ ID NO: 4749 - DNA, 21 bp, Artificial Sequence
  Description of Artificial Sequence: Synthetic oligonucleotide
actagtggagtgggtgtgggc

SEQ ID NO: 4750 - protein, 7 aa, Artificial Sequence
  Description of Artificial Sequence: Synthetic peptide
TSGVGVG

SEQ ID NO: 4751 - DNA, 21 bp, Artificial Sequence
  Description of Artificial Sequence: Synthetic oligonucleotide
actggtggagtgggtgtgggc

SEQ ID NO: 4752 - protein, 7 aa, Artificial Sequence
  Description of Artificial Sequence: Synthetic peptide
TGGVGVG

SEQ ID NO: 4753 - DNA, 15 bp, Artificial Sequence
  Description of Artificial Sequence: Synthetic oligonucleotide
ggctactatatgcac

SEQ ID NO: 4754 - protein, 5 aa, Artificial Sequence
  Description of Artificial Sequence: Synthetic peptide
GYYMH

SEQ ID NO: 4755 - DNA, 15 bp, Artificial Sequence
  Description of Artificial Sequence: Synthetic oligonucleotide
ggctactatatacac

SEQ ID NO: 4756 - protein, 5 aa, Artificial Sequence
  Description of Artificial Sequence: Synthetic peptide
GYYIH

SEQ ID NO: 4757 - DNA, 15 bp, Artificial Sequence
  Description of Artificial Sequence: Synthetic oligonucleotide
agctatgccatgagc

SEQ ID NO: 4758 - protein, 5 aa, Artificial Sequence
  Description of Artificial Sequence: Synthetic peptide
SYAMS

SEQ ID NO: 4759 - DNA, 15 bp, Artificial Sequence
  Description of Artificial Sequence: Synthetic oligonucleotide
ggctactatgtgcac

SEQ ID NO: 4760 - protein, 5 aa, Artificial Sequence
  Description of Artificial Sequence: Synthetic peptide
GYYVH

SEQ ID NO: 4761 - DNA, 15 bp, Artificial Sequence
  Description of Artificial Sequence: Synthetic oligonucleotide
agctatgccatgagc

SEQ ID NO: 4762 - protein, 5 aa, Artificial Sequence
  Description of Artificial Sequence: Synthetic peptide
SYAMS

SEQ ID NO: 4763 - DNA, 15 bp, Artificial Sequence
  Description of Artificial Sequence: Synthetic oligonucleotide
aattatgatatcaac

SEQ ID NO: 4764 - protein, 5 aa, Artificial Sequence
  Description of Artificial Sequence: Synthetic peptide
NYDIN

SEQ ID NO: 4765 - DNA, 15 bp, Artificial Sequence
  Description of Artificial Sequence: Synthetic oligonucleotide
ggctactatatgcac

SEQ ID NO: 4766 - protein, 5 aa, Artificial Sequence
  Description of Artificial Sequence: Synthetic peptide
GYYMH

SEQ ID NO: 4767 - DNA, 15 bp, Artificial Sequence
  Description of Artificial Sequence: Synthetic oligonucleotide
accgcctggatgaac

SEQ ID NO: 4768 - protein, 5 aa, Artificial Sequence
  Description of Artificial Sequence: Synthetic peptide
TAWMN

SEQ ID NO: 4769 - DNA, 21 bp, Artificial Sequence
  Description of Artificial Sequence: Synthetic oligonucleotide
agaagtagttattactggggc

SEQ ID NO: 4770 - protein, 7 aa, Artificial Sequence
  Description of Artificial Sequence: Synthetic peptide
RSSYYWG

SEQ ID NO: 4771 - DNA, 21 bp, Artificial Sequence
  Description of Artificial Sequence: Synthetic oligonucleotide
agaagtagttactactggggc

SEQ ID NO: 4772 - protein, 7 aa, Artificial Sequence
  Description of Artificial Sequence: Synthetic peptide
RSSYYWG

SEQ ID NO: 4773 - DNA, 15 bp, Artificial Sequence
  Description of Artificial Sequence: Synthetic oligonucleotide
agctataccatgaac

SEQ ID NO: 4774 - protein, 5 aa, Artificial Sequence
  Description of Artificial Sequence: Synthetic peptide
SYTMN

SEQ ID NO: 4775 - DNA, 15 bp, Artificial Sequence
  Description of Artificial Sequence: Synthetic oligonucleotide
agctctgccatgagc

SEQ ID NO: 4776 - protein, 5 aa, Artificial Sequence
  Description of Artificial Sequence: Synthetic peptide
SSAMS

SEQ ID NO: 4777 - DNA, 15 bp, Artificial Sequence
  Description of Artificial Sequence: Synthetic oligonucleotide
gactatggcatgcac

SEQ ID NO: 4778 - protein, 5 aa, Artificial Sequence
  Description of Artificial Sequence: Synthetic peptide
DYGMH

SEQ ID NO: 4779 - DNA, 21 bp, Artificial Sequence
  Description of Artificial Sequence: Synthetic oligonucleotide
aggagtagttactactggggc

SEQ ID NO: 4780 - protein, 7 aa, Artificial Sequence
  Description of Artificial Sequence: Synthetic peptide
RSSYYWG

SEQ ID NO: 4781 - DNA, 21 bp, Artificial Sequence
  Description of Artificial Sequence: Synthetic oligonucleotide
agaagtagttcctactggggc

SEQ ID NO: 4782 - protein, 7 aa, Artificial Sequence
  Description of Artificial Sequence: Synthetic peptide
RSSSYWG

SEQ ID NO: 4783 - DNA, 15 bp, Artificial Sequence
  Description of Artificial Sequence: Synthetic oligonucleotide
agctatggcatgcac

SEQ ID NO: 4784 - protein, 5 aa, Artificial Sequence
  Description of Artificial Sequence: Synthetic peptide
SYGMH

SEQ ID NO: 4785 - DNA, 15 bp, Artificial Sequence
  Description of Artificial Sequence: Synthetic oligonucleotide
gactttggcatgcac

SEQ ID NO: 4786 - protein, 5 aa, Artificial Sequence
  Description of Artificial Sequence: Synthetic peptide
DFGMH

SEQ ID NO: 4787 - DNA, 15 bp, Artificial Sequence
  Description of Artificial Sequence: Synthetic oligonucleotide
aactatggcatgcac

SEQ ID NO: 4788 - protein, 5 aa, Artificial Sequence
  Description of Artificial Sequence: Synthetic peptide
NYGMH

SEQ ID NO: 4789 - DNA, 15 bp, Artificial Sequence
  Description of Artificial Sequence: Synthetic oligonucleotide
agctatgccatgagc

SEQ ID NO: 4790 - protein, 5 aa, Artificial Sequence
  Description of Artificial Sequence: Synthetic peptide
SYAMS

SEQ ID NO: 4791 - DNA, 15 bp, Artificial Sequence
  Description of Artificial Sequence: Synthetic oligonucleotide
aactatggcatgcac

SEQ ID NO: 4792 - protein, 5 aa, Artificial Sequence
  Description of Artificial Sequence: Synthetic peptide
NYGMH

SEQ ID NO: 4793 - DNA, 15 bp, Artificial Sequence
  Description of Artificial Sequence: Synthetic oligonucleotide
gactatggcatgcac

SEQ ID NO: 4794 - protein, 5 aa, Artificial Sequence
  Description of Artificial Sequence: Synthetic peptide
DYGMH

SEQ ID NO: 4795 - DNA, 15 bp, Artificial Sequence
  Description of Artificial Sequence: Synthetic oligonucleotide
agctatggcatgcac

SEQ ID NO: 4796 - protein, 5 aa, Artificial Sequence
  Description of Artificial Sequence: Synthetic peptide
SYGMH

SEQ ID NO: 4797 - DNA, 21 bp, Artificial Sequence
  Description of Artificial Sequence: Synthetic oligonucleotide
agaagtagttattactggggt

SEQ ID NO: 4798 - protein, 7 aa, Artificial Sequence
  Description of Artificial Sequence: Synthetic peptide
RSSYYWG

SEQ ID NO: 4799 - DNA, 15 bp, Artificial Sequence
  Description of Artificial Sequence: Synthetic oligonucleotide
agctataccatgaac

SEQ ID NO: 4800 - protein, 5 aa, Artificial Sequence
  Description of Artificial Sequence: Synthetic peptide
SYTMN

SEQ ID NO: 4801 - DNA, 15 bp, Artificial Sequence
  Description of Artificial Sequence: Synthetic oligonucleotide
gactatggcatacac

SEQ ID NO: 4802 - protein, 5 aa, Artificial Sequence
  Description of Artificial Sequence: Synthetic peptide
DYGIH

SEQ ID NO: 4803 - DNA, 15 bp, Artificial Sequence
  Description of Artificial Sequence: Synthetic oligonucleotide
agctatggcatgcac

SEQ ID NO: 4804 - protein, 5 aa, Artificial Sequence
  Description of Artificial Sequence: Synthetic peptide
SYGMH

SEQ ID NO: 4805 - DNA, 15 bp, Artificial Sequence
  Description of Artificial Sequence: Synthetic oligonucleotide
aactatggcatgcac

SEQ ID NO: 4806 - protein, 5 aa, Artificial Sequence
  Description of Artificial Sequence: Synthetic peptide
NYGMH

SEQ ID NO: 4807 - DNA, 15 bp, Artificial Sequence
  Description of Artificial Sequence: Synthetic oligonucleotide
ggctatgccatgaac

SEQ ID NO: 4808 - protein, 5 aa, Artificial Sequence
  Description of Artificial Sequence: Synthetic peptide
GYAMN

SEQ ID NO: 4809 - DNA, 15 bp, Artificial Sequence
  Description of Artificial Sequence: Synthetic oligonucleotide
agctatggcatgcac

SEQ ID NO: 4810 - protein, 5 aa, Artificial Sequence
  Description of Artificial Sequence: Synthetic peptide
SYGMH

SEQ ID NO: 4811 - DNA, 15 bp, Artificial Sequence
  Description of Artificial Sequence: Synthetic oligonucleotide
gactatggcatgcac

SEQ ID NO: 4812 - protein, 5 aa, Artificial Sequence
  Description of Artificial Sequence: Synthetic peptide
DYGMH

SEQ ID NO: 4813 - DNA, 15 bp, Artificial Sequence
  Description of Artificial Sequence: Synthetic oligonucleotide
gactatggcatgcac

SEQ ID NO: 4814 - protein, 5 aa, Artificial Sequence
  Description of Artificial Sequence: Synthetic peptide
DYGMH

SEQ ID NO: 4815 - DNA, 15 bp, Artificial Sequence
  Description of Artificial Sequence: Synthetic oligonucleotide
agctatgccatgagc

SEQ ID NO: 4816 - protein, 5 aa, Artificial Sequence
  Description of Artificial Sequence: Synthetic peptide
SYAMS

SEQ ID NO: 4817 - DNA, 15 bp, Artificial Sequence
  Description of Artificial Sequence: Synthetic oligonucleotide
agctatgtcctgcac

SEQ ID NO: 4818 - protein, 5 aa, Artificial Sequence
  Description of Artificial Sequence: Synthetic peptide
SYVLH

SEQ ID NO: 4819 - DNA, 15 bp, Artificial Sequence
  Description of Artificial Sequence: Synthetic oligonucleotide
gactttggcatgcac

SEQ ID NO: 4820 - protein, 5 aa, Artificial Sequence
  Description of Artificial Sequence: Synthetic peptide
DFGMH

SEQ ID NO: 4821 - DNA, 15 bp, Artificial Sequence
  Description of Artificial Sequence: Synthetic oligonucleotide
agctatggcatgcac

SEQ ID NO: 4822 - protein, 5 aa, Artificial Sequence
  Description of Artificial Sequence: Synthetic peptide
SYGMH

SEQ ID NO: 4823 - DNA, 15 bp, Artificial Sequence
  Description of Artificial Sequence: Synthetic oligonucleotide
agctatgacatgagc

SEQ ID NO: 4824 - protein, 5 aa, Artificial Sequence
  Description of Artificial Sequence: Synthetic peptide
SYDMS

SEQ ID NO: 4825 - DNA, 21 bp, Artificial Sequence
  Description of Artificial Sequence: Synthetic oligonucleotide
aggagtagttactactggggc

SEQ ID NO: 4826 - protein, 7 aa, Artificial Sequence
  Description of Artificial Sequence: Synthetic peptide
RSSYYWG

SEQ ID NO: 4827 - DNA, 15 bp, Artificial Sequence
  Description of Artificial Sequence: Synthetic oligonucleotide
aactatggcatgcac

SEQ ID NO: 4828 - protein, 5 aa, Artificial Sequence
  Description of Artificial Sequence: Synthetic peptide
NYGMH

SEQ ID NO: 4829 - DNA, 15 bp, Artificial Sequence
  Description of Artificial Sequence: Synthetic oligonucleotide
gactatggcatgcac

SEQ ID NO: 4830 - protein, 5 aa, Artificial Sequence
  Description of Artificial Sequence: Synthetic peptide
DYGMH

SEQ ID NO: 4831 - DNA, 15 bp, Artificial Sequence
  Description of Artificial Sequence: Synthetic oligonucleotide
agctatgccatgaac

SEQ ID NO: 4832 - protein, 5 aa, Artificial Sequence
  Description of Artificial Sequence: Synthetic peptide
SYAMN

SEQ ID NO: 4833 - DNA, 21 bp, Artificial Sequence
  Description of Artificial Sequence: Synthetic oligonucleotide
agaagtagttactactggggc

SEQ ID NO: 4834 - protein, 7 aa, Artificial Sequence
  Description of Artificial Sequence: Synthetic peptide
RSSYYWG

SEQ ID NO: 4835 - DNA, 15 bp, Artificial Sequence
  Description of Artificial Sequence: Synthetic oligonucleotide
agctatggcatgcac

SEQ ID NO: 4836 - protein, 5 aa, Artificial Sequence
  Description of Artificial Sequence: Synthetic peptide
SYGMH

SEQ ID NO: 4837 - DNA, 15 bp, Artificial Sequence
  Description of Artificial Sequence: Synthetic oligonucleotide
aactatggcatgcac

SEQ ID NO: 4838 - protein, 5 aa, Artificial Sequence
  Description of Artificial Sequence: Synthetic peptide
NYGMH

SEQ ID NO: 4839 - DNA, 18 bp, Artificial Sequence
  Description of Artificial Sequence: Synthetic oligonucleotide
cctaattactactggggc

SEQ ID NO: 4840 - protein, 6 aa, Artificial Sequence
  Description of Artificial Sequence: Synthetic peptide
PNYYWG

SEQ ID NO: 4841 - DNA, 15 bp, Artificial Sequence
  Description of Artificial Sequence: Synthetic oligonucleotide
agctatgtcatgagc

SEQ ID NO: 4842 - protein, 5 aa, Artificial Sequence
  Description of Artificial Sequence: Synthetic peptide
SYVMS

SEQ ID NO: 4843 - DNA, 15 bp, Artificial Sequence
  Description of Artificial Sequence: Synthetic oligonucleotide
agttactcctggagc

SEQ ID NO: 4844 - protein, 5 aa, Artificial Sequence
  Description of Artificial Sequence: Synthetic peptide
SYSWS

SEQ ID NO: 4845 - DNA, 15 bp, Artificial Sequence
  Description of Artificial Sequence: Synthetic oligonucleotide
agctatggcatgcac

SEQ ID NO: 4846 - protein, 5 aa, Artificial Sequence
  Description of Artificial Sequence: Synthetic peptide
SYGMH

SEQ ID NO: 4847 - DNA, 15 bp, Artificial Sequence
  Description of Artificial Sequence: Synthetic oligonucleotide
agctatagcatgaac

SEQ ID NO: 4848 - protein, 5 aa, Artificial Sequence
  Description of Artificial Sequence: Synthetic peptide
SYSMN

SEQ ID NO: 4849 - DNA, 15 bp, Artificial Sequence
  Description of Artificial Sequence: Synthetic oligonucleotide
agctatagcatgaac

SEQ ID NO: 4850 - protein, 5 aa, Artificial Sequence
  Description of Artificial Sequence: Synthetic peptide
SYSMN

SEQ ID NO: 4851 - DNA, 15 bp, Artificial Sequence
  Description of Artificial Sequence: Synthetic oligonucleotide
agctatgccatgagc

SEQ ID NO: 4852 - protein, 5 aa, Artificial Sequence
  Description of Artificial Sequence: Synthetic peptide
SYAMS

SEQ ID NO: 4853 - DNA, 15 bp, Artificial Sequence
  Description of Artificial Sequence: Synthetic oligonucleotide
aactatggcatgcac

SEQ ID NO: 4854 - protein, 5 aa, Artificial Sequence
  Description of Artificial Sequence: Synthetic peptide
NYGMH

SEQ ID NO: 4855 - DNA, 15 bp, Artificial Sequence
  Description of Artificial Sequence: Synthetic oligonucleotide
gactatggcatgcac

SEQ ID NO: 4856 - protein, 5 aa, Artificial Sequence
  Description of Artificial Sequence: Synthetic peptide
DYGMH

SEQ ID NO: 4857 - DNA, 15 bp, Artificial Sequence
  Description of Artificial Sequence: Synthetic oligonucleotide
acctataacatgcac

SEQ ID NO: 4858 - protein, 5 aa, Artificial Sequence
  Description of Artificial Sequence: Synthetic peptide
TYNMH

SEQ ID NO: 4859 - DNA, 15 bp, Artificial Sequence
  Description of Artificial Sequence: Synthetic oligonucleotide
agttataccatgaac

SEQ ID NO: 4860 - protein, 5 aa, Artificial Sequence
  Description of Artificial Sequence: Synthetic peptide
SYTMN

SEQ ID NO: 4861 - DNA, 15 bp, Artificial Sequence
  Description of Artificial Sequence: Synthetic oligonucleotide
aactatgtcatacac

SEQ ID NO: 4862 - protein, 5 aa, Artificial Sequence
  Description of Artificial Sequence: Synthetic peptide
NYVIH

SEQ ID NO: 4863 - DNA, 15 bp, Artificial Sequence
  Description of Artificial Sequence: Synthetic oligonucleotide
agctatggcatgcac

SEQ ID NO: 4864 - protein, 5 aa, Artificial Sequence
  Description of Artificial Sequence: Synthetic peptide
SYGMH

SEQ ID NO: 4865 - DNA, 15 bp, Artificial Sequence
  Description of Artificial Sequence: Synthetic oligonucleotide
aactatggcatgcac

SEQ ID NO: 4866 - protein, 5 aa, Artificial Sequence
  Description of Artificial Sequence: Synthetic peptide
NYGMH

SEQ ID NO: 4867 - DNA, 15 bp, Artificial Sequence
  Description of Artificial Sequence: Synthetic oligonucleotide
agctatagcatgaac

SEQ ID NO: 4868 - protein, 5 aa, Artificial Sequence
  Description of Artificial Sequence: Synthetic peptide
SYSMN

SEQ ID NO: 4869 - DNA, 15 bp, Artificial Sequence
  Description of Artificial Sequence: Synthetic oligonucleotide
agctatgtcatgcac

SEQ ID NO: 4870 - protein, 5 aa, Artificial Sequence
  Description of Artificial Sequence: Synthetic peptide
SYVMH

SEQ ID NO: 4871 - DNA, 15 bp, Artificial Sequence
  Description of Artificial Sequence: Synthetic oligonucleotide
agctatggcatgcac

SEQ ID NO: 4872 - protein, 5 aa, Artificial Sequence
  Description of Artificial Sequence: Synthetic peptide
SYGMH

SEQ ID NO: 4873 - DNA, 15 bp, Artificial Sequence
  Description of Artificial Sequence: Synthetic oligonucleotide
agctatggcatgcac

SEQ ID NO: 4874 - protein, 5 aa, Artificial Sequence
  Description of Artificial Sequence: Synthetic peptide
SYGMH

SEQ ID NO: 4875 - DNA, 15 bp, Artificial Sequence
  Description of Artificial Sequence: Synthetic oligonucleotide
agctatggcatgcac

SEQ ID NO: 4876 - protein, 5 aa, Artificial Sequence
  Description of Artificial Sequence: Synthetic peptide
SYGMH

SEQ ID NO: 4877 - DNA, 21 bp, Artificial Sequence
  Description of Artificial Sequence: Synthetic oligonucleotide
cgtagtagttactactggggc

SEQ ID NO: 4878 - protein, 7 aa, Artificial Sequence
  Description of Artificial Sequence: Synthetic peptide
RSSYYWG

SEQ ID NO: 4879 - DNA, 15 bp, Artificial Sequence
  Description of Artificial Sequence: Synthetic oligonucleotide
agctttggcatgcac

SEQ ID NO: 4880 - protein, 5 aa, Artificial Sequence
  Description of Artificial Sequence: Synthetic peptide
SFGMH

SEQ ID NO: 4881 - DNA, 15 bp, Artificial Sequence
  Description of Artificial Sequence: Synthetic oligonucleotide
agctatggcatgcac

SEQ ID NO: 4882 - protein, 5 aa, Artificial Sequence
  Description of Artificial Sequence: Synthetic peptide
SYGMH

SEQ ID NO: 4883 - DNA, 15 bp, Artificial Sequence
  Description of Artificial Sequence: Synthetic oligonucleotide
aactatggcatgcac

SEQ ID NO: 4884 - protein, 5 aa, Artificial Sequence
  Description of Artificial Sequence: Synthetic peptide
NYGMH

SEQ ID NO: 4885 - DNA, 15 bp, Artificial Sequence
  Description of Artificial Sequence: Synthetic oligonucleotide
agctatgccatgaac

SEQ ID NO: 4886 - protein, 5 aa, Artificial Sequence
  Description of Artificial Sequence: Synthetic peptide
SYAMN

SEQ ID NO: 4887 - DNA, 15 bp, Artificial Sequence
  Description of Artificial Sequence: Synthetic oligonucleotide
agctatgccatgacc

SEQ ID NO: 4888 - protein, 5 aa, Artificial Sequence
  Description of Artificial Sequence: Synthetic peptide
SYAMT

SEQ ID NO: 4889 - DNA, 15 bp, Artificial Sequence
  Description of Artificial Sequence: Synthetic oligonucleotide
aattatgatatcaac

SEQ ID NO: 4890 - protein, 5 aa, Artificial Sequence
  Description of Artificial Sequence: Synthetic peptide
NYDIN

SEQ ID NO: 4891 - DNA, 15 bp, Artificial Sequence
  Description of Artificial Sequence: Synthetic oligonucleotide
agttataccatgaac

SEQ ID NO: 4892 - protein, 5 aa, Artificial Sequence
  Description of Artificial Sequence: Synthetic peptide
SYTMN

SEQ ID NO: 4893 - DNA, 15 bp, Artificial Sequence
  Description of Artificial Sequence: Synthetic oligonucleotide
agctatagcatgaac

SEQ ID NO: 4894 - protein, 5 aa, Artificial Sequence
  Description of Artificial Sequence: Synthetic peptide
SYSMN

SEQ ID NO: 4895 - DNA, 15 bp, Artificial Sequence
  Description of Artificial Sequence: Synthetic oligonucleotide
gactatggcatgcac

SEQ ID NO: 4896 - protein, 5 aa, Artificial Sequence
  Description of Artificial Sequence: Synthetic peptide
DYGMH

SEQ ID NO: 4897 - DNA, 15 bp, Artificial Sequence
  Description of Artificial Sequence: Synthetic oligonucleotide
agctatgtcatgcac

SEQ ID NO: 4898 - protein, 5 aa, Artificial Sequence
  Description of Artificial Sequence: Synthetic peptide
SYVMH

SEQ ID NO: 4899 - DNA, 15 bp, Artificial Sequence
  Description of Artificial Sequence: Synthetic oligonucleotide
agctataacatgaac

SEQ ID NO: 4900 - protein, 5 aa, Artificial Sequence
  Description of Artificial Sequence: Synthetic peptide
SYNMN

SEQ ID NO: 4901 - DNA, 15 bp, Artificial Sequence
  Description of Artificial Sequence: Synthetic oligonucleotide
gactactatttgcac

SEQ ID NO: 4902 - protein, 5 aa, Artificial Sequence
  Description of Artificial Sequence: Synthetic peptide
DYYLH

SEQ ID NO: 4903 - DNA, 15 bp, Artificial Sequence
  Description of Artificial Sequence: Synthetic oligonucleotide
agctatgccatgagc

SEQ ID NO: 4904 - protein, 5 aa, Artificial Sequence
  Description of Artificial Sequence: Synthetic peptide
SYAMS

SEQ ID NO: 4905 - DNA, 15 bp, Artificial Sequence
  Description of Artificial Sequence: Synthetic oligonucleotide
agctataccatgaac

SEQ ID NO: 4906 - protein, 5 aa, Artificial Sequence
  Description of Artificial Sequence: Synthetic peptide
SYTMN

SEQ ID NO: 4907 - DNA, 15 bp, Artificial Sequence
  Description of Artificial Sequence: Synthetic oligonucleotide
gactatggcatgcac

SEQ ID NO: 4908 - protein, 5 aa, Artificial Sequence
  Description of Artificial Sequence: Synthetic peptide
DYGMH

SEQ ID NO: 4909 - DNA, 21 bp, Artificial Sequence
  Description of Artificial Sequence: Synthetic oligonucleotide
agaagtagttactactggggc

SEQ ID NO: 4910 - protein, 7 aa, Artificial Sequence
  Description of Artificial Sequence: Synthetic peptide
RSSYYWG

SEQ ID NO: 4911 - DNA, 15 bp, Artificial Sequence
  Description of Artificial Sequence: Synthetic oligonucleotide
agctatggcatgcac

SEQ ID NO: 4912 - protein, 5 aa, Artificial Sequence
  Description of Artificial Sequence: Synthetic peptide
SYGMH

SEQ ID NO: 4913 - DNA, 15 bp, Artificial Sequence
  Description of Artificial Sequence: Synthetic oligonucleotide
agctgtgtcatgcac

SEQ ID NO: 4914 - protein, 5 aa, Artificial Sequence
  Description of Artificial Sequence: Synthetic peptide
SCVMH

SEQ ID NO: 4915 - DNA, 15 bp, Artificial Sequence
  Description of Artificial Sequence: Synthetic oligonucleotide
agctatgccatgaac

SEQ ID NO: 4916 - protein, 5 aa, Artificial Sequence
  Description of Artificial Sequence: Synthetic peptide
SYAMN

SEQ ID NO: 4917 - DNA, 15 bp, Artificial Sequence
  Description of Artificial Sequence: Synthetic oligonucleotide
aactatgtcatgcac

SEQ ID NO: 4918 - protein, 5 aa, Artificial Sequence
  Description of Artificial Sequence: Synthetic peptide
NYVMH

SEQ ID NO: 4919 - DNA, 15 bp, Artificial Sequence
  Description of Artificial Sequence: Synthetic oligonucleotide
aactatggcatgcac

SEQ ID NO: 4920 - protein, 5 aa, Artificial Sequence
  Description of Artificial Sequence: Synthetic peptide
NYGMH

SEQ ID NO: 4921 - DNA, 15 bp, Artificial Sequence
  Description of Artificial Sequence: Synthetic oligonucleotide
gactatggcatgcac

SEQ ID NO: 4922 - protein, 5 aa, Artificial Sequence
  Description of Artificial Sequence: Synthetic peptide
DYGMH

SEQ ID NO: 4923 - DNA, 15 bp, Artificial Sequence
  Description of Artificial Sequence: Synthetic oligonucleotide
agctatgtcatgcac

SEQ ID NO: 4924 - protein, 5 aa, Artificial Sequence
  Description of Artificial Sequence: Synthetic peptide
SYVMH

SEQ ID NO: 4925 - DNA, 15 bp, Artificial Sequence
  Description of Artificial Sequence: Synthetic oligonucleotide
agctatgccatgaac

SEQ ID NO: 4926 - protein, 5 aa, Artificial Sequence
  Description of Artificial Sequence: Synthetic peptide
SYAMN

SEQ ID NO: 4927 - DNA, 15 bp, Artificial Sequence
  Description of Artificial Sequence: Synthetic oligonucleotide
agctatagcatgaac

SEQ ID NO: 4928 - protein, 5 aa, Artificial Sequence
  Description of Artificial Sequence: Synthetic peptide
SYSMN

SEQ ID NO: 4929 - DNA, 15 bp, Artificial Sequence
  Description of Artificial Sequence: Synthetic oligonucleotide
agctatggcatgcac

SEQ ID NO: 4930 - protein, 5 aa, Artificial Sequence
  Description of Artificial Sequence: Synthetic peptide
SYGMH

SEQ ID NO: 4931 - DNA, 15 bp, Artificial Sequence
  Description of Artificial Sequence: Synthetic oligonucleotide
aactatgtcatgcac

SEQ ID NO: 4932 - protein, 5 aa, Artificial Sequence
  Description of Artificial Sequence: Synthetic peptide
NYVMH

SEQ ID NO: 4933 - DNA, 15 bp, Artificial Sequence
  Description of Artificial Sequence: Synthetic oligonucleotide
agctatagcatgaac

SEQ ID NO: 4934 - protein, 5 aa, Artificial Sequence
  Description of Artificial Sequence: Synthetic peptide
SYSMN

SEQ ID NO: 4935 - DNA, 21 bp, Artificial Sequence
  Description of Artificial Sequence: Synthetic oligonucleotide
aggagtacttactactggggc

SEQ ID NO: 4936 - protein, 7 aa, Artificial Sequence
  Description of Artificial Sequence: Synthetic peptide
RSTYYWG

SEQ ID NO: 4937 - DNA, 15 bp, Artificial Sequence
  Description of Artificial Sequence: Synthetic oligonucleotide
agcaatagcatgaac

SEQ ID NO: 4938 - protein, 5 aa, Artificial Sequence
  Description of Artificial Sequence: Synthetic peptide
SNSMN

SEQ ID NO: 4939 - DNA, 15 bp, Artificial Sequence
  Description of Artificial Sequence: Synthetic oligonucleotide
agctatggcatgcac

SEQ ID NO: 4940 - protein, 5 aa, Artificial Sequence
  Description of Artificial Sequence: Synthetic peptide
SYGMH

SEQ ID NO: 4941 - DNA, 15 bp, Artificial Sequence
  Description of Artificial Sequence: Synthetic oligonucleotide
gactatgtcatgcac

SEQ ID NO: 4942 - protein, 5 aa, Artificial Sequence
  Description of Artificial Sequence: Synthetic peptide
DYVMH

SEQ ID NO: 4943 - DNA, 15 bp, Artificial Sequence
  Description of Artificial Sequence: Synthetic oligonucleotide
gactatggcatgcac

SEQ ID NO: 4944 - protein, 5 aa, Artificial Sequence
  Description of Artificial Sequence: Synthetic peptide
DYGMH

SEQ ID NO: 4945 - DNA, 15 bp, Artificial Sequence
  Description of Artificial Sequence: Synthetic oligonucleotide
agctatggcatgcac

SEQ ID NO: 4946 - protein, 5 aa, Artificial Sequence
  Description of Artificial Sequence: Synthetic peptide
SYGMH

SEQ ID NO: 4947 - DNA, 21 bp, Artificial Sequence
  Description of Artificial Sequence: Synthetic oligonucleotide
aggagtagttcctactggggc

SEQ ID NO: 4948 - protein, 7 aa, Artificial Sequence
  Description of Artificial Sequence: Synthetic peptide
RSSSYWG

SEQ ID NO: 4949 - DNA, 15 bp, Artificial Sequence
  Description of Artificial Sequence: Synthetic oligonucleotide
agctatggcatgcac

SEQ ID NO: 4950 - protein, 5 aa, Artificial Sequence
  Description of Artificial Sequence: Synthetic peptide
SYGMH

SEQ ID NO: 4951 - DNA, 15 bp, Artificial Sequence
  Description of Artificial Sequence: Synthetic oligonucleotide
agctatggcatgcac

SEQ ID NO: 4952 - protein, 5 aa, Artificial Sequence
  Description of Artificial Sequence: Synthetic peptide
SYGMH

SEQ ID NO: 4953 - DNA, 15 bp, Artificial Sequence
  Description of Artificial Sequence: Synthetic oligonucleotide
agctatgtcatgaac

SEQ ID NO: 4954 - protein, 5 aa, Artificial Sequence
  Description of Artificial Sequence: Synthetic peptide
SYVMN

SEQ ID NO: 4955 - DNA, 15 bp, Artificial Sequence
  Description of Artificial Sequence: Synthetic oligonucleotide
aactatggcatctac

SEQ ID NO: 4956 - protein, 5 aa, Artificial Sequence
  Description of Artificial Sequence: Synthetic peptide
NYGIY

SEQ ID NO: 4957 - DNA, 15 bp, Artificial Sequence
  Description of Artificial Sequence: Synthetic oligonucleotide
agctatggcattcac

SEQ ID NO: 4958 - protein, 5 aa, Artificial Sequence
  Description of Artificial Sequence: Synthetic peptide
SYGIH

SEQ ID NO: 4959 - DNA, 15 bp, Artificial Sequence
  Description of Artificial Sequence: Synthetic oligonucleotide
agctatgtcatgaac

SEQ ID NO: 4960 - protein, 5 aa, Artificial Sequence
  Description of Artificial Sequence: Synthetic peptide
SYVMN

SEQ ID NO: 4961 - DNA, 15 bp, Artificial Sequence
  Description of Artificial Sequence: Synthetic oligonucleotide
agctatggcatgcac

SEQ ID NO: 4962 - protein, 5 aa, Artificial Sequence
  Description of Artificial Sequence: Synthetic peptide
SYGMH

SEQ ID NO: 4963 - DNA, 15 bp, Artificial Sequence
  Description of Artificial Sequence: Synthetic oligonucleotide
agctatgtcatgagc

SEQ ID NO: 4964 - protein, 5 aa, Artificial Sequence
  Description of Artificial Sequence: Synthetic peptide
SYVMS

SEQ ID NO: 4965 - DNA, 15 bp, Artificial Sequence
  Description of Artificial Sequence: Synthetic oligonucleotide
aactatggcatgcac

SEQ ID NO: 4966 - protein, 5 aa, Artificial Sequence
  Description of Artificial Sequence: Synthetic peptide
NYGMH

SEQ ID NO: 4967 - DNA, 15 bp, Artificial Sequence
  Description of Artificial Sequence: Synthetic oligonucleotide
agctatgccatgaac

SEQ ID NO: 4968 - protein, 5 aa, Artificial Sequence
  Description of Artificial Sequence: Synthetic peptide
SYAMN

SEQ ID NO: 4969 - DNA, 15 bp, Artificial Sequence
  Description of Artificial Sequence: Synthetic oligonucleotide
agctatggcatgcac

SEQ ID NO: 4970 - protein, 5 aa, Artificial Sequence
  Description of Artificial Sequence: Synthetic peptide
SYGMH

SEQ ID NO: 4971 - DNA, 15 bp, Artificial Sequence
  Description of Artificial Sequence: Synthetic oligonucleotide
agctatgtcatgacc

SEQ ID NO: 4972 - protein, 5 aa, Artificial Sequence
  Description of Artificial Sequence: Synthetic peptide
SYVMT

SEQ ID NO: 4973 - DNA, 15 bp, Artificial Sequence
  Description of Artificial Sequence: Synthetic oligonucleotide
agctatggcatgcac

SEQ ID NO: 4974 - protein, 5 aa, Artificial Sequence
  Description of Artificial Sequence: Synthetic peptide
SYGMH

SEQ ID NO: 4975 - DNA, 15 bp, Artificial Sequence
  Description of Artificial Sequence: Synthetic oligonucleotide
agctatagcatgaac

SEQ ID NO: 4976 - protein, 5 aa, Artificial Sequence
  Description of Artificial Sequence: Synthetic peptide
SYSMN

SEQ ID NO: 4977 - DNA, 15 bp, Artificial Sequence
  Description of Artificial Sequence: Synthetic oligonucleotide
aattatggcatgcac

SEQ ID NO: 4978 - protein, 5 aa, Artificial Sequence
  Description of Artificial Sequence: Synthetic peptide
NYGMH

SEQ ID NO: 4979 - DNA, 21 bp, Artificial Sequence
  Description of Artificial Sequence: Synthetic oligonucleotide
aggagtagttactactggggc

SEQ ID NO: 4980 - protein, 7 aa, Artificial Sequence
  Description of Artificial Sequence: Synthetic peptide
RSSYYWG

SEQ ID NO: 4981 - DNA, 15 bp, Artificial Sequence
  Description of Artificial Sequence: Synthetic oligonucleotide
aactatgtcatgcac

SEQ ID NO: 4982 - protein, 5 aa, Artificial Sequence
  Description of Artificial Sequence: Synthetic peptide
NYVMH

SEQ ID NO: 4983 - DNA, 15 bp, Artificial Sequence
  Description of Artificial Sequence: Synthetic oligonucleotide
agctatgccatgaac

SEQ ID NO: 4984 - protein, 5 aa, Artificial Sequence
  Description of Artificial Sequence: Synthetic peptide
SYAMN

SEQ ID NO: 4985 - DNA, 21 bp, Artificial Sequence
  Description of Artificial Sequence: Synthetic oligonucleotide
aggagtagttactactggggc

SEQ ID NO: 4986 - protein, 7 aa, Artificial Sequence
  Description of Artificial Sequence: Synthetic peptide
RSSYYWG

SEQ ID NO: 4987 - DNA, 15 bp, Artificial Sequence
  Description of Artificial Sequence: Synthetic oligonucleotide
agctatggcatgcac

SEQ ID NO: 4988 - protein, 5 aa, Artificial Sequence
  Description of Artificial Sequence: Synthetic peptide
SYGMH

SEQ ID NO: 4989 - DNA, 21 bp, Artificial Sequence
  Description of Artificial Sequence: Synthetic oligonucleotide
agaagtagttactactggggc

SEQ ID NO: 4990 - protein, 7 aa, Artificial Sequence
  Description of Artificial Sequence: Synthetic peptide
RSSYYWG

SEQ ID NO: 4991 - DNA, 15 bp, Artificial Sequence
  Description of Artificial Sequence: Synthetic oligonucleotide
aactatgccatgaac

SEQ ID NO: 4992 - protein, 5 aa, Artificial Sequence
  Description of Artificial Sequence: Synthetic peptide
NYAMN

SEQ ID NO: 4993 - DNA, 21 bp, Artificial Sequence
  Description of Artificial Sequence: Synthetic oligonucleotide
agaagtagttactactggggc

SEQ ID NO: 4994 - protein, 7 aa, Artificial Sequence
  Description of Artificial Sequence: Synthetic peptide
RSSYYWG

SEQ ID NO: 4995 - DNA, 15 bp, Artificial Sequence
  Description of Artificial Sequence: Synthetic oligonucleotide
agccagagcatgaac

SEQ ID NO: 4996 - protein, 5 aa, Artificial Sequence
  Description of Artificial Sequence: Synthetic peptide
SQSMN

SEQ ID NO: 4997 - DNA, 21 bp, Artificial Sequence
  Description of Artificial Sequence: Synthetic oligonucleotide
agaagtagttactactggggc

SEQ ID NO: 4998 - protein, 7 aa, Artificial Sequence
  Description of Artificial Sequence: Synthetic peptide
RSSYYWG

SEQ ID NO: 4999 - DNA, 15 bp, Artificial Sequence
  Description of Artificial Sequence: Synthetic oligonucleotide
agctatggcatgcac

SEQ ID NO: 5000 - protein, 5 aa, Artificial Sequence
  Description of Artificial Sequence: Synthetic peptide
SYGMH

SEQ ID NO: 5001 - DNA, 15 bp, Artificial Sequence
  Description of Artificial Sequence: Synthetic oligonucleotide
agctatagcatgaac

SEQ ID NO: 5002 - protein, 5 aa, Artificial Sequence
  Description of Artificial Sequence: Synthetic peptide
SYSMN

SEQ ID NO: 5003 - DNA, 21 bp, Artificial Sequence
  Description of Artificial Sequence: Synthetic oligonucleotide
aggagtagttactactggggc

SEQ ID NO: 5004 - protein, 7 aa, Artificial Sequence
  Description of Artificial Sequence: Synthetic peptide
RSSYYWG

SEQ ID NO: 5005 - DNA, 15 bp, Artificial Sequence
  Description of Artificial Sequence: Synthetic oligonucleotide
aattatgatatcaac

SEQ ID NO: 5006 - protein, 5 aa, Artificial Sequence
  Description of Artificial Sequence: Synthetic peptide
NYDIN

SEQ ID NO: 5007 - DNA, 15 bp, Artificial Sequence
  Description of Artificial Sequence: Synthetic oligonucleotide
gactatggcatgcac

SEQ ID NO: 5008 - protein, 5 aa, Artificial Sequence
  Description of Artificial Sequence: Synthetic peptide
DYGMH

SEQ ID NO: 5009 - DNA, 15 bp, Artificial Sequence
  Description of Artificial Sequence: Synthetic oligonucleotide
agctatagcatgaac

SEQ ID NO: 5010 - protein, 5 aa, Artificial Sequence
  Description of Artificial Sequence: Synthetic peptide
SYSMN

SEQ ID NO: 5011 - DNA, 15 bp, Artificial Sequence
  Description of Artificial Sequence: Synthetic oligonucleotide
agctatagcatgaac

SEQ ID NO: 5012 - protein, 5 aa, Artificial Sequence
  Description of Artificial Sequence: Synthetic peptide
SYSMN

SEQ ID NO: 5013 - DNA, 21 bp, Artificial Sequence
  Description of Artificial Sequence: Synthetic oligonucleotide
agaagtagttactactggggc

SEQ ID NO: 5014 - protein, 7 aa, Artificial Sequence
  Description of Artificial Sequence: Synthetic peptide
RSSYYWG

SEQ ID NO: 5015 - DNA, 21 bp, Artificial Sequence
  Description of Artificial Sequence: Synthetic oligonucleotide
agaagtagttactactggggc

SEQ ID NO: 5016 - protein, 7 aa, Artificial Sequence
  Description of Artificial Sequence: Synthetic peptide
RSSYYWG

SEQ ID NO: 5017 - DNA, 15 bp, Artificial Sequence
  Description of Artificial Sequence: Synthetic oligonucleotide
agctatgccatgagc

SEQ ID NO: 5018 - protein, 5 aa, Artificial Sequence
  Description of Artificial Sequence: Synthetic peptide
SYAMS

SEQ ID NO: 5019 - DNA, 21 bp, Artificial Sequence
  Description of Artificial Sequence: Synthetic oligonucleotide
aggagtagttactactggggc

SEQ ID NO: 5020 - protein, 7 aa, Artificial Sequence
  Description of Artificial Sequence: Synthetic peptide
RSSYYWG

SEQ ID NO: 5021 - DNA, 15 bp, Artificial Sequence
  Description of Artificial Sequence: Synthetic oligonucleotide
agctatggcatgcac

SEQ ID NO: 5022 - protein, 5 aa, Artificial Sequence
  Description of Artificial Sequence: Synthetic peptide
SYGMH

SEQ ID NO: 5023 - DNA, 15 bp, Artificial Sequence
  Description of Artificial Sequence: Synthetic oligonucleotide
agctatggcatgcac

SEQ ID NO: 5024 - protein, 5 aa, Artificial Sequence
  Description of Artificial Sequence: Synthetic peptide
SYGMH

SEQ ID NO: 5025 - DNA, 15 bp, Artificial Sequence
  Description of Artificial Sequence: Synthetic oligonucleotide
aattatgatatcaac

SEQ ID NO: 5026 - protein, 5 aa, Artificial Sequence
  Description of Artificial Sequence: Synthetic peptide
NYDIN

SEQ ID NO: 5027 - DNA, 15 bp, Artificial Sequence
  Description of Artificial Sequence: Synthetic oligonucleotide
agctatgccatgagc

SEQ ID NO: 5028 - protein, 5 aa, Artificial Sequence
  Description of Artificial Sequence: Synthetic peptide
SYAMS

SEQ ID NO: 5029 - DNA, 15 bp, Artificial Sequence
  Description of Artificial Sequence: Synthetic oligonucleotide
gactatggcatgcac

SEQ ID NO: 5030 - protein, 5 aa, Artificial Sequence
  Description of Artificial Sequence: Synthetic peptide
DYGMH

SEQ ID NO: 5031 - DNA, 15 bp, Artificial Sequence
  Description of Artificial Sequence: Synthetic oligonucleotide
agctatggcatgcac

SEQ ID NO: 5032 - protein, 5 aa, Artificial Sequence
  Description of Artificial Sequence: Synthetic peptide
SYGMH

SEQ ID NO: 5033 - DNA, 15 bp, Artificial Sequence
  Description of Artificial Sequence: Synthetic oligonucleotide
gactatggcatgcac

SEQ ID NO: 5034 - protein, 5 aa, Artificial Sequence
  Description of Artificial Sequence: Synthetic peptide
DYGMH

SEQ ID NO: 5035 - DNA, 15 bp, Artificial Sequence
  Description of Artificial Sequence: Synthetic oligonucleotide
aactatggcatgcac

SEQ ID NO: 5036 - protein, 5 aa, Artificial Sequence
  Description of Artificial Sequence: Synthetic peptide
NYGMH

SEQ ID NO: 5037 - DNA, 15 bp, Artificial Sequence
  Description of Artificial Sequence: Synthetic oligonucleotide
gactatggcatgcac

SEQ ID NO: 5038 - protein, 5 aa, Artificial Sequence
  Description of Artificial Sequence: Synthetic peptide
DYGMH

SEQ ID NO: 5039 - DNA, 15 bp, Artificial Sequence
  Description of Artificial Sequence: Synthetic oligonucleotide
ggctactatatgcac

SEQ ID NO: 5040 - protein, 5 aa, Artificial Sequence
  Description of Artificial Sequence: Synthetic peptide
GYYMH

SEQ ID NO: 5041 - DNA, 15 bp, Artificial Sequence
  Description of Artificial Sequence: Synthetic oligonucleotide
agctatgtcatgagc

SEQ ID NO: 5042 - protein, 5 aa, Artificial Sequence
  Description of Artificial Sequence: Synthetic peptide
SYVMS

SEQ ID NO: 5043 - DNA, 15 bp, Artificial Sequence
  Description of Artificial Sequence: Synthetic oligonucleotide
agctatgccatgagc

SEQ ID NO: 5044 - protein, 5 aa, Artificial Sequence
  Description of Artificial Sequence: Synthetic peptide
SYAMS

SEQ ID NO: 5045 - DNA, 15 bp, Artificial Sequence
  Description of Artificial Sequence: Synthetic oligonucleotide
agctatgccatgagc

SEQ ID NO: 5046 - protein, 5 aa, Artificial Sequence
  Description of Artificial Sequence: Synthetic peptide
SYAMS

SEQ ID NO: 5047 - DNA, 15 bp, Artificial Sequence
  Description of Artificial Sequence: Synthetic oligonucleotide
agctatagcatgaac

SEQ ID NO: 5048 - protein, 5 aa, Artificial Sequence
  Description of Artificial Sequence: Synthetic peptide
SYSMN

SEQ ID NO: 5049 - DNA, 15 bp, Artificial Sequence
  Description of Artificial Sequence: Synthetic oligonucleotide
gactattatatgcac

SEQ ID NO: 5050 - protein, 5 aa, Artificial Sequence
  Description of Artificial Sequence: Synthetic peptide
DYYMH

SEQ ID NO: 5051 - DNA, 15 bp, Artificial Sequence
  Description of Artificial Sequence: Synthetic oligonucleotide
agctatagcatgaac

SEQ ID NO: 5052 - protein, 5 aa, Artificial Sequence
  Description of Artificial Sequence: Synthetic peptide
SYSMN

SEQ ID NO: 5053 - DNA, 15 bp, Artificial Sequence
  Description of Artificial Sequence: Synthetic oligonucleotide
ggctactatttgcac

SEQ ID NO: 5054 - protein, 5 aa, Artificial Sequence
  Description of Artificial Sequence: Synthetic peptide
GYYLH

SEQ ID NO: 5055 - DNA, 15 bp, Artificial Sequence
  Description of Artificial Sequence: Synthetic oligonucleotide
ggctactatatgcac

SEQ ID NO: 5056 - protein, 5 aa, Artificial Sequence
  Description of Artificial Sequence: Synthetic peptide
GYYMH

SEQ ID NO: 5057 - DNA, 15 bp, Artificial Sequence
  Description of Artificial Sequence: Synthetic oligonucleotide
aacgcctggatgaac

SEQ ID NO: 5058 - protein, 5 aa, Artificial Sequence
  Description of Artificial Sequence: Synthetic peptide
NAWMN

SEQ ID NO: 5059 - DNA, 15 bp, Artificial Sequence
  Description of Artificial Sequence: Synthetic oligonucleotide
gactactatattcac

SEQ ID NO: 5060 - protein, 5 aa, Artificial Sequence
  Description of Artificial Sequence: Synthetic peptide
DYYIH

SEQ ID NO: 5061 - DNA, 15 bp, Artificial Sequence
  Description of Artificial Sequence: Synthetic oligonucleotide
agctatgccatgagc

SEQ ID NO: 5062 - protein, 5 aa, Artificial Sequence
  Description of Artificial Sequence: Synthetic peptide
SYAMS

SEQ ID NO: 5063 - DNA, 15 bp, Artificial Sequence
  Description of Artificial Sequence: Synthetic oligonucleotide
aattatgatatcaac

SEQ ID NO: 5064 - protein, 5 aa, Artificial Sequence
  Description of Artificial Sequence: Synthetic peptide
NYDIN

SEQ ID NO: 5065 - DNA, 21 bp, Artificial Sequence
  Description of Artificial Sequence: Synthetic oligonucleotide
actggtggagtgggtgtgggc

SEQ ID NO: 5066 - protein, 7 aa, Artificial Sequence
  Description of Artificial Sequence: Synthetic peptide
TGGVGVG

SEQ ID NO: 5067 - DNA, 15 bp, Artificial Sequence
  Description of Artificial Sequence: Synthetic oligonucleotide
agttatagcatgaac

SEQ ID NO: 5068 - protein, 5 aa, Artificial Sequence
  Description of Artificial Sequence: Synthetic peptide
SYSMN

SEQ ID NO: 5069 - DNA, 15 bp, Artificial Sequence
  Description of Artificial Sequence: Synthetic oligonucleotide
ggctactatctgcac

SEQ ID NO: 5070 - protein, 5 aa, Artificial Sequence
  Description of Artificial Sequence: Synthetic peptide
GYYLH

SEQ ID NO: 5071 - DNA, 21 bp, Artificial Sequence
  Description of Artificial Sequence: Synthetic oligonucleotide
actagtggagtgggtgtgggc

SEQ ID NO: 5072 - protein, 7 aa, Artificial Sequence
  Description of Artificial Sequence: Synthetic peptide
TSGVGVG

SEQ ID NO: 5073 - DNA, 15 bp, Artificial Sequence
  Description of Artificial Sequence: Synthetic oligonucleotide
aattatgatatcaac

SEQ ID NO: 5074 - protein, 5 aa, Artificial Sequence
  Description of Artificial Sequence: Synthetic peptide
NYDIN

SEQ ID NO: 5075 - DNA, 15 bp, Artificial Sequence
  Description of Artificial Sequence: Synthetic oligonucleotide
agctatgccatgagc

SEQ ID NO: 5076 - protein, 5 aa, Artificial Sequence
  Description of Artificial Sequence: Synthetic peptide
SYAMS

SEQ ID NO: 5077 - DNA, 15 bp, Artificial Sequence
  Description of Artificial Sequence: Synthetic oligonucleotide
aattatgatatcaac

SEQ ID NO: 5078 - protein, 5 aa, Artificial Sequence
  Description of Artificial Sequence: Synthetic peptide
NYDIN

SEQ ID NO: 5079 - DNA, 15 bp, Artificial Sequence
  Description of Artificial Sequence: Synthetic oligonucleotide
aattatgatatcaac

SEQ ID NO: 5080 - protein, 5 aa, Artificial Sequence
  Description of Artificial Sequence: Synthetic peptide
NYDIN

SEQ ID NO: 5081 - DNA, 15 bp, Artificial Sequence
  Description of Artificial Sequence: Synthetic oligonucleotide
aattatgatatcaac

SEQ ID NO: 5082 - protein, 5 aa, Artificial Sequence
  Description of Artificial Sequence: Synthetic peptide
NYDIN

SEQ ID NO: 5083 - DNA, 15 bp, Artificial Sequence
  Description of Artificial Sequence: Synthetic oligonucleotide
ggcgattatatgcac

SEQ ID NO: 5084 - protein, 5 aa, Artificial Sequence
  Description of Artificial Sequence: Synthetic peptide
GDYMH

SEQ ID NO: 5085 - DNA, 15 bp, Artificial Sequence
  Description of Artificial Sequence: Synthetic oligonucleotide
aactatgatattaac

SEQ ID NO: 5086 - protein, 5 aa, Artificial Sequence
  Description of Artificial Sequence: Synthetic peptide
NYDIN

SEQ ID NO: 5087 - DNA, 15 bp, Artificial Sequence
  Description of Artificial Sequence: Synthetic oligonucleotide
aattatgacatcaac

SEQ ID NO: 5088 - protein, 5 aa, Artificial Sequence
  Description of Artificial Sequence: Synthetic peptide
NYDIN

SEQ ID NO: 5089 - DNA, 15 bp, Artificial Sequence
  Description of Artificial Sequence: Synthetic oligonucleotide
agctatagcatgaac

SEQ ID NO: 5090 - protein, 5 aa, Artificial Sequence
  Description of Artificial Sequence: Synthetic peptide
SYSMN

SEQ ID NO: 5091 - DNA, 15 bp, Artificial Sequence
  Description of Artificial Sequence: Synthetic oligonucleotide
agctatgccatgagc

SEQ ID NO: 5092 - protein, 5 aa, Artificial Sequence
  Description of Artificial Sequence: Synthetic peptide
SYAMS

SEQ ID NO: 5093 - DNA, 15 bp, Artificial Sequence
  Description of Artificial Sequence: Synthetic oligonucleotide
agttatgatatcaac

SEQ ID NO: 5094 - protein, 5 aa, Artificial Sequence
  Description of Artificial Sequence: Synthetic peptide
SYDIN

SEQ ID NO: 5095 - DNA, 15 bp, Artificial Sequence
  Description of Artificial Sequence: Synthetic oligonucleotide
agctataacatgaac

SEQ ID NO: 5096 - protein, 5 aa, Artificial Sequence
  Description of Artificial Sequence: Synthetic peptide
SYNMN

SEQ ID NO: 5097 - DNA, 15 bp, Artificial Sequence
  Description of Artificial Sequence: Synthetic oligonucleotide
agctatgccatgagc

SEQ ID NO: 5098 - protein, 5 aa, Artificial Sequence
  Description of Artificial Sequence: Synthetic peptide
SYAMS

SEQ ID NO: 5099 - DNA, 15 bp, Artificial Sequence
  Description of Artificial Sequence: Synthetic oligonucleotide
agttatgatatcagc

SEQ ID NO: 5100 - protein, 5 aa, Artificial Sequence
  Description of Artificial Sequence: Synthetic peptide
SYDIS

SEQ ID NO: 5101 - DNA, 15 bp, Artificial Sequence
  Description of Artificial Sequence: Synthetic oligonucleotide
aactatgatattaac

SEQ ID NO: 5102 - protein, 5 aa, Artificial Sequence
  Description of Artificial Sequence: Synthetic peptide
NYDIN

SEQ ID NO: 5103 - DNA, 15 bp, Artificial Sequence
  Description of Artificial Sequence: Synthetic oligonucleotide
agctatgccatgagc

SEQ ID NO: 5104 - protein, 5 aa, Artificial Sequence
  Description of Artificial Sequence: Synthetic peptide
SYAMS

SEQ ID NO: 5105 - DNA, 15 bp, Artificial Sequence
  Description of Artificial Sequence: Synthetic oligonucleotide
aacgcccggatgaac

SEQ ID NO: 5106 - protein, 5 aa, Artificial Sequence
  Description of Artificial Sequence: Synthetic peptide
NARMN

SEQ ID NO: 5107 - DNA, 21 bp, Artificial Sequence
  Description of Artificial Sequence: Synthetic oligonucleotide
actagtggagtgggtgtgggc

SEQ ID NO: 5108 - protein, 7 aa, Artificial Sequence
  Description of Artificial Sequence: Synthetic peptide
TSGVGVG

SEQ ID NO: 5109 - DNA, 15 bp, Artificial Sequence
  Description of Artificial Sequence: Synthetic oligonucleotide
aactatggcatgcac

SEQ ID NO: 5110 - protein, 5 aa, Artificial Sequence
  Description of Artificial Sequence: Synthetic peptide
NYGMH

SEQ ID NO: 5111 - DNA, 15 bp, Artificial Sequence
  Description of Artificial Sequence: Synthetic oligonucleotide
agctatagcatgaac

SEQ ID NO: 5112 - protein, 5 aa, Artificial Sequence
  Description of Artificial Sequence: Synthetic peptide
SYSMN

SEQ ID NO: 5113 - DNA, 15 bp, Artificial Sequence
  Description of Artificial Sequence: Synthetic oligonucleotide
gactatcatatgcac

SEQ ID NO: 5114 - protein, 5 aa, Artificial Sequence
  Description of Artificial Sequence: Synthetic peptide
DYHMH

SEQ ID NO: 5115 - DNA, 15 bp, Artificial Sequence
  Description of Artificial Sequence: Synthetic oligonucleotide
agctatagcatgaac

SEQ ID NO: 5116 - protein, 5 aa, Artificial Sequence
  Description of Artificial Sequence: Synthetic peptide
SYSMN

SEQ ID NO: 5117 - DNA, 15 bp, Artificial Sequence
  Description of Artificial Sequence: Synthetic oligonucleotide
agctatagcatgaac

SEQ ID NO: 5118 - protein, 5 aa, Artificial Sequence
  Description of Artificial Sequence: Synthetic peptide
SYSMN

SEQ ID NO: 5119 - DNA, 15 bp, Artificial Sequence
  Description of Artificial Sequence: Synthetic oligonucleotide
aacgcctggatgaac

SEQ ID NO: 5120 - protein, 5 aa, Artificial Sequence
  Description of Artificial Sequence: Synthetic peptide
NAWMN

SEQ ID NO: 5121 - DNA, 15 bp, Artificial Sequence
  Description of Artificial Sequence: Synthetic oligonucleotide
acctataacttgaac

SEQ ID NO: 5122 - protein, 5 aa, Artificial Sequence
  Description of Artificial Sequence: Synthetic peptide
TYNLN

SEQ ID NO: 5123 - DNA, 15 bp, Artificial Sequence
  Description of Artificial Sequence: Synthetic oligonucleotide
agctatagcatgaac

SEQ ID NO: 5124 - protein, 5 aa, Artificial Sequence
  Description of Artificial Sequence: Synthetic peptide
SYSMN

SEQ ID NO: 5125 - DNA, 15 bp, Artificial Sequence
  Description of Artificial Sequence: Synthetic oligonucleotide
agctataacataaac

SEQ ID NO: 5126 - protein, 5 aa, Artificial Sequence
  Description of Artificial Sequence: Synthetic peptide
SYNIN

SEQ ID NO: 5127 - DNA, 21 bp, Artificial Sequence
  Description of Artificial Sequence: Synthetic oligonucleotide
agaagtagttattactggggc

SEQ ID NO: 5128 - protein, 7 aa, Artificial Sequence
  Description of Artificial Sequence: Synthetic peptide
RSSYYWG

SEQ ID NO: 5129 - DNA, 15 bp, Artificial Sequence
  Description of Artificial Sequence: Synthetic oligonucleotide
agctatgccatgagc

SEQ ID NO: 5130 - protein, 5 aa, Artificial Sequence
  Description of Artificial Sequence: Synthetic peptide
SYAMS

SEQ ID NO: 5131 - DNA, 21 bp, Artificial Sequence
  Description of Artificial Sequence: Synthetic oligonucleotide
aggactagttactactggggc

SEQ ID NO: 5132 - protein, 7 aa, Artificial Sequence
  Description of Artificial Sequence: Synthetic peptide
RTSYYWG

SEQ ID NO: 5133 - DNA, 15 bp, Artificial Sequence
  Description of Artificial Sequence: Synthetic oligonucleotide
agctatagcatgaac

SEQ ID NO: 5134 - protein, 5 aa, Artificial Sequence
  Description of Artificial Sequence: Synthetic peptide
SYSMN

SEQ ID NO: 5135 - DNA, 15 bp, Artificial Sequence
  Description of Artificial Sequence: Synthetic oligonucleotide
aattatgatatcaac

SEQ ID NO: 5136 - protein, 5 aa, Artificial Sequence
  Description of Artificial Sequence: Synthetic peptide
NYDIN

SEQ ID NO: 5137 - DNA, 15 bp, Artificial Sequence
  Description of Artificial Sequence: Synthetic oligonucleotide
aattatgatatcaac

SEQ ID NO: 5138 - protein, 5 aa, Artificial Sequence
  Description of Artificial Sequence: Synthetic peptide
NYDIN

SEQ ID NO: 5139 - DNA, 15 bp, Artificial Sequence
  Description of Artificial Sequence: Synthetic oligonucleotide
ggctactatatgcac

SEQ ID NO: 5140 - protein, 5 aa, Artificial Sequence
  Description of Artificial Sequence: Synthetic peptide
GYYMH

SEQ ID NO: 5141 - DNA, 15 bp, Artificial Sequence
  Description of Artificial Sequence: Synthetic oligonucleotide
ggctactatatgcac

SEQ ID NO: 5142 - protein, 5 aa, Artificial Sequence
  Description of Artificial Sequence: Synthetic peptide
GYYMH

SEQ ID NO: 5143 - DNA, 15 bp, Artificial Sequence
  Description of Artificial Sequence: Synthetic oligonucleotide
aattatgatatcaac

SEQ ID NO: 5144 - protein, 5 aa, Artificial Sequence
  Description of Artificial Sequence: Synthetic peptide
NYDIN

SEQ ID NO: 5145 - DNA, 15 bp, Artificial Sequence
  Description of Artificial Sequence: Synthetic oligonucleotide
aattatgatattaat

SEQ ID NO: 5146 - protein, 5 aa, Artificial Sequence
  Description of Artificial Sequence: Synthetic peptide
NYDIN

SEQ ID NO: 5147 - DNA, 15 bp, Artificial Sequence
  Description of Artificial Sequence: Synthetic oligonucleotide
agctttggcatgcac

SEQ ID NO: 5148 - protein, 5 aa, Artificial Sequence
  Description of Artificial Sequence: Synthetic peptide
SFGMH

SEQ ID NO: 5149 - DNA, 15 bp, Artificial Sequence
  Description of Artificial Sequence: Synthetic oligonucleotide
gcctaccatatgcac

SEQ ID NO: 5150 - protein, 5 aa, Artificial Sequence
  Description of Artificial Sequence: Synthetic peptide
AYHMH

SEQ ID NO: 5151 - DNA, 15 bp, Artificial Sequence
  Description of Artificial Sequence: Synthetic oligonucleotide
gactactatttgcac

SEQ ID NO: 5152 - protein, 5 aa, Artificial Sequence
  Description of Artificial Sequence: Synthetic peptide
DYYLH

SEQ ID NO: 5153 - DNA, 15 bp, Artificial Sequence
  Description of Artificial Sequence: Synthetic oligonucleotide
aattatgatatcaac

SEQ ID NO: 5154 - protein, 5 aa, Artificial Sequence
  Description of Artificial Sequence: Synthetic peptide
NYDIN

SEQ ID NO: 5155 - DNA, 15 bp, Artificial Sequence
  Description of Artificial Sequence: Synthetic oligonucleotide
aactatgtcatgcac

SEQ ID NO: 5156 - protein, 5 aa, Artificial Sequence
  Description of Artificial Sequence: Synthetic peptide
NYVMH

SEQ ID NO: 5157 - DNA, 15 bp, Artificial Sequence
  Description of Artificial Sequence: Synthetic oligonucleotide
aactgtgtcatgcac

SEQ ID NO: 5158 - protein, 5 aa, Artificial Sequence
  Description of Artificial Sequence: Synthetic peptide
NCVMH

SEQ ID NO: 5159 - DNA, 15 bp, Artificial Sequence
  Description of Artificial Sequence: Synthetic oligonucleotide
agctatggcatgcac

SEQ ID NO: 5160 - protein, 5 aa, Artificial Sequence
  Description of Artificial Sequence: Synthetic peptide
SYGMH

SEQ ID NO: 5161 - DNA, 15 bp, Artificial Sequence
  Description of Artificial Sequence: Synthetic oligonucleotide
agctatggcatgcac

SEQ ID NO: 5162 - protein, 5 aa, Artificial Sequence
  Description of Artificial Sequence: Synthetic peptide
SYGMH

SEQ ID NO: 5163 - DNA, 15 bp, Artificial Sequence
  Description of Artificial Sequence: Synthetic oligonucleotide
aattatgatatcaac

SEQ ID NO: 5164 - protein, 5 aa, Artificial Sequence
  Description of Artificial Sequence: Synthetic peptide
NYDIN

SEQ ID NO: 5165 - DNA, 15 bp, Artificial Sequence
  Description of Artificial Sequence: Synthetic oligonucleotide
agctatagcatgaac

SEQ ID NO: 5166 - protein, 5 aa, Artificial Sequence
  Description of Artificial Sequence: Synthetic peptide
SYSMN

SEQ ID NO: 5167 - DNA, 15 bp, Artificial Sequence
  Description of Artificial Sequence: Synthetic oligonucleotide
agctatgccatgagc

SEQ ID NO: 5168 - protein, 5 aa, Artificial Sequence
  Description of Artificial Sequence: Synthetic peptide
SYAMS

SEQ ID NO: 5169 - DNA, 15 bp, Artificial Sequence
  Description of Artificial Sequence: Synthetic oligonucleotide
agctatggcatacac

SEQ ID NO: 5170 - protein, 5 aa, Artificial Sequence
  Description of Artificial Sequence: Synthetic peptide
SYGIH

SEQ ID NO: 5171 - DNA, 15 bp, Artificial Sequence
  Description of Artificial Sequence: Synthetic oligonucleotide
agctataccatgaac

SEQ ID NO: 5172 - protein, 5 aa, Artificial Sequence
  Description of Artificial Sequence: Synthetic peptide
SYTMN

SEQ ID NO: 5173 - DNA, 15 bp, Artificial Sequence
  Description of Artificial Sequence: Synthetic oligonucleotide
agctatgccatgagc

SEQ ID NO: 5174 - protein, 5 aa, Artificial Sequence
  Description of Artificial Sequence: Synthetic peptide
SYAMS

SEQ ID NO: 5175 - DNA, 15 bp, Artificial Sequence
  Description of Artificial Sequence: Synthetic oligonucleotide
gactactacatgatc

SEQ ID NO: 5176 - protein, 5 aa, Artificial Sequence
  Description of Artificial Sequence: Synthetic peptide
DYYMI

SEQ ID NO: 5177 - DNA, 15 bp, Artificial Sequence
  Description of Artificial Sequence: Synthetic oligonucleotide
aattatgatatcaac

SEQ ID NO: 5178 - protein, 5 aa, Artificial Sequence
  Description of Artificial Sequence: Synthetic peptide
NYDIN

SEQ ID NO: 5179 - DNA, 15 bp, Artificial Sequence
  Description of Artificial Sequence: Synthetic oligonucleotide
agctatgccatgagc

SEQ ID NO: 5180 - protein, 5 aa, Artificial Sequence
  Description of Artificial Sequence: Synthetic peptide
SYAMS

SEQ ID NO: 5181 - DNA, 15 bp, Artificial Sequence
  Description of Artificial Sequence: Synthetic oligonucleotide
gactactacatgaac

SEQ ID NO: 5182 - protein, 5 aa, Artificial Sequence
  Description of Artificial Sequence: Synthetic peptide
DYYMN

SEQ ID NO: 5183 - DNA, 15 bp, Artificial Sequence
  Description of Artificial Sequence: Synthetic oligonucleotide
agctatgccatgagt

SEQ ID NO: 5184 - protein, 5 aa, Artificial Sequence
  Description of Artificial Sequence: Synthetic peptide
SYAMS

SEQ ID NO: 5185 - DNA, 15 bp, Artificial Sequence
  Description of Artificial Sequence: Synthetic oligonucleotide
gactatggcatgcac

SEQ ID NO: 5186 - protein, 5 aa, Artificial Sequence
  Description of Artificial Sequence: Synthetic peptide
DYGMH

SEQ ID NO: 5187 - DNA, 15 bp, Artificial Sequence
  Description of Artificial Sequence: Synthetic oligonucleotide
gactatggcatgcac

SEQ ID NO: 5188 - protein, 5 aa, Artificial Sequence
  Description of Artificial Sequence: Synthetic peptide
DYGMH

SEQ ID NO: 5189 - DNA, 15 bp, Artificial Sequence
  Description of Artificial Sequence: Synthetic oligonucleotide
agctatggcatgcac

SEQ ID NO: 5190 - protein, 5 aa, Artificial Sequence
  Description of Artificial Sequence: Synthetic peptide
SYGMH

SEQ ID NO: 5191 - DNA, 15 bp, Artificial Sequence
  Description of Artificial Sequence: Synthetic oligonucleotide
agctatgtcatgcac

SEQ ID NO: 5192 - protein, 5 aa, Artificial Sequence
  Description of Artificial Sequence: Synthetic peptide
SYVMH

SEQ ID NO: 5193 - DNA, 15 bp, Artificial Sequence
  Description of Artificial Sequence: Synthetic oligonucleotide
agctatgccatgagc

SEQ ID NO: 5194 - protein, 5 aa, Artificial Sequence
  Description of Artificial Sequence: Synthetic peptide
SYAMS

SEQ ID NO: 5195 - DNA, 15 bp, Artificial Sequence
  Description of Artificial Sequence: Synthetic oligonucleotide
agctatgtcatgcac

SEQ ID NO: 5196 - protein, 5 aa, Artificial Sequence
  Description of Artificial Sequence: Synthetic peptide
SYVMH

SEQ ID NO: 5197 - DNA, 15 bp, Artificial Sequence
  Description of Artificial Sequence: Synthetic oligonucleotide
agttactactggagc

SEQ ID NO: 5198 - protein, 5 aa, Artificial Sequence
  Description of Artificial Sequence: Synthetic peptide
SYYWS

SEQ ID NO: 5199 - DNA, 15 bp, Artificial Sequence
  Description of Artificial Sequence: Synthetic oligonucleotide
aactatggcatgcac

SEQ ID NO: 5200 - protein, 5 aa, Artificial Sequence
  Description of Artificial Sequence: Synthetic peptide
NYGMH

SEQ ID NO: 5201 - DNA, 15 bp, Artificial Sequence
  Description of Artificial Sequence: Synthetic oligonucleotide
agctatgtcatgcac

SEQ ID NO: 5202 - protein, 5 aa, Artificial Sequence
  Description of Artificial Sequence: Synthetic peptide
SYVMH

SEQ ID NO: 5203 - DNA, 15 bp, Artificial Sequence
  Description of Artificial Sequence: Synthetic oligonucleotide
agctatggcatgcac

SEQ ID NO: 5204 - protein, 5 aa, Artificial Sequence
  Description of Artificial Sequence: Synthetic peptide
SYGMH

SEQ ID NO: 5205 - DNA, 15 bp, Artificial Sequence
  Description of Artificial Sequence: Synthetic oligonucleotide
gactgtgtcatgcac

SEQ ID NO: 5206 - protein, 5 aa, Artificial Sequence
  Description of Artificial Sequence: Synthetic peptide
DCVMH

SEQ ID NO: 5207 - DNA, 15 bp, Artificial Sequence
  Description of Artificial Sequence: Synthetic oligonucleotide
agctatgccatgagc

SEQ ID NO: 5208 - protein, 5 aa, Artificial Sequence
  Description of Artificial Sequence: Synthetic peptide
SYAMS

SEQ ID NO: 5209 - DNA, 15 bp, Artificial Sequence
  Description of Artificial Sequence: Synthetic oligonucleotide
agctatgccatgaac

SEQ ID NO: 5210 - protein, 5 aa, Artificial Sequence
  Description of Artificial Sequence: Synthetic peptide
SYAMN

SEQ ID NO: 5211 - DNA, 15 bp, Artificial Sequence
  Description of Artificial Sequence: Synthetic oligonucleotide
agctatagcgtgaac

SEQ ID NO: 5212 - protein, 5 aa, Artificial Sequence
  Description of Artificial Sequence: Synthetic peptide
SYSVN

SEQ ID NO: 5213 - DNA, 15 bp, Artificial Sequence
  Description of Artificial Sequence: Synthetic oligonucleotide
agcgatgacacgcac

SEQ ID NO: 5214 - protein, 5 aa, Artificial Sequence
  Description of Artificial Sequence: Synthetic peptide
SDDTH

SEQ ID NO: 5215 - DNA, 15 bp, Artificial Sequence
  Description of Artificial Sequence: Synthetic oligonucleotide
gactactacatgaac

SEQ ID NO: 5216 - protein, 5 aa, Artificial Sequence
  Description of Artificial Sequence: Synthetic peptide
DYYMN

SEQ ID NO: 5217 - DNA, 15 bp, Artificial Sequence
  Description of Artificial Sequence: Synthetic oligonucleotide
gactgtgtcatgcac

SEQ ID NO: 5218 - protein, 5 aa, Artificial Sequence
  Description of Artificial Sequence: Synthetic peptide
DCVMH

SEQ ID NO: 5219 - DNA, 15 bp, Artificial Sequence
  Description of Artificial Sequence: Synthetic oligonucleotide
agctatgccatgagt

SEQ ID NO: 5220 - protein, 5 aa, Artificial Sequence
  Description of Artificial Sequence: Synthetic peptide
SYAMS

SEQ ID NO: 5221 - DNA, 15 bp, Artificial Sequence
  Description of Artificial Sequence: Synthetic oligonucleotide
gactgtgtcatgcac

SEQ ID NO: 5222 - protein, 5 aa, Artificial Sequence
  Description of Artificial Sequence: Synthetic peptide
DCVMH

SEQ ID NO: 5223 - DNA, 15 bp, Artificial Sequence
  Description of Artificial Sequence: Synthetic oligonucleotide
agctatgccatgagc

SEQ ID NO: 5224 - protein, 5 aa, Artificial Sequence
  Description of Artificial Sequence: Synthetic peptide
SYAMS

SEQ ID NO: 5225 - DNA, 15 bp, Artificial Sequence
  Description of Artificial Sequence: Synthetic oligonucleotide
agctatgccatgagc

SEQ ID NO: 5226 - protein, 5 aa, Artificial Sequence
  Description of Artificial Sequence: Synthetic peptide
SYAMS

SEQ ID NO: 5227 - DNA, 15 bp, Artificial Sequence
  Description of Artificial Sequence: Synthetic oligonucleotide
agctataccatgaac

SEQ ID NO: 5228 - protein, 5 aa, Artificial Sequence
  Description of Artificial Sequence: Synthetic peptide
SYTMN

SEQ ID NO: 5229 - DNA, 15 bp, Artificial Sequence
  Description of Artificial Sequence: Synthetic oligonucleotide
agcgatgactcgcac

SEQ ID NO: 5230 - protein, 5 aa, Artificial Sequence
  Description of Artificial Sequence: Synthetic peptide
SDDSH

SEQ ID NO: 5231 - DNA, 15 bp, Artificial Sequence
  Description of Artificial Sequence: Synthetic oligonucleotide
agctatggcatgcac

SEQ ID NO: 5232 - protein, 5 aa, Artificial Sequence
  Description of Artificial Sequence: Synthetic peptide
SYGMH

SEQ ID NO: 5233 - DNA, 15 bp, Artificial Sequence
  Description of Artificial Sequence: Synthetic oligonucleotide
agctatgtcatgcac

SEQ ID NO: 5234 - protein, 5 aa, Artificial Sequence
  Description of Artificial Sequence: Synthetic peptide
SYVMH

SEQ ID NO: 5235 - DNA, 15 bp, Artificial Sequence
  Description of Artificial Sequence: Synthetic oligonucleotide
gattatggcatgcac

SEQ ID NO: 5236 - protein, 5 aa, Artificial Sequence
  Description of Artificial Sequence: Synthetic peptide
DYGMH

SEQ ID NO: 5237 - DNA, 15 bp, Artificial Sequence
  Description of Artificial Sequence: Synthetic oligonucleotide
agctatgtcatgcac

SEQ ID NO: 5238 - protein, 5 aa, Artificial Sequence
  Description of Artificial Sequence: Synthetic peptide
SYVMH

SEQ ID NO: 5239 - DNA, 15 bp, Artificial Sequence
  Description of Artificial Sequence: Synthetic oligonucleotide
agctatgccatgagc

SEQ ID NO: 5240 - protein, 5 aa, Artificial Sequence
  Description of Artificial Sequence: Synthetic peptide
SYAMS

SEQ ID NO: 5241 - DNA, 15 bp, Artificial Sequence
  Description of Artificial Sequence: Synthetic oligonucleotide
agctatggcatacac

SEQ ID NO: 5242 - protein, 5 aa, Artificial Sequence
  Description of Artificial Sequence: Synthetic peptide
SYGIH

SEQ ID NO: 5243 - DNA, 15 bp, Artificial Sequence
  Description of Artificial Sequence: Synthetic oligonucleotide
gattatggcatacac

SEQ ID NO: 5244 - protein, 5 aa, Artificial Sequence
  Description of Artificial Sequence: Synthetic peptide
DYGIH

SEQ ID NO: 5245 - DNA, 15 bp, Artificial Sequence
  Description of Artificial Sequence: Synthetic oligonucleotide
agctatggcatgcac

SEQ ID NO: 5246 - protein, 5 aa, Artificial Sequence
  Description of Artificial Sequence: Synthetic peptide
SYGMH

SEQ ID NO: 5247 - DNA, 15 bp, Artificial Sequence
  Description of Artificial Sequence: Synthetic oligonucleotide
gactactacatgaac

SEQ ID NO: 5248 - protein, 5 aa, Artificial Sequence
  Description of Artificial Sequence: Synthetic peptide
DYYMN

SEQ ID NO: 5249 - DNA, 15 bp, Artificial Sequence
  Description of Artificial Sequence: Synthetic oligonucleotide
gactatggcatgcac

SEQ ID NO: 5250 - protein, 5 aa, Artificial Sequence
  Description of Artificial Sequence: Synthetic peptide
DYGMH

SEQ ID NO: 5251 - DNA, 15 bp, Artificial Sequence
  Description of Artificial Sequence: Synthetic oligonucleotide
gactatggcatgcac

SEQ ID NO: 5252 - protein, 5 aa, Artificial Sequence
  Description of Artificial Sequence: Synthetic peptide
DYGMH

SEQ ID NO: 5253 - DNA, 15 bp, Artificial Sequence
  Description of Artificial Sequence: Synthetic oligonucleotide
gacgatgacacacac

SEQ ID NO: 5254 - protein, 5 aa, Artificial Sequence
  Description of Artificial Sequence: Synthetic peptide
DDDTH

SEQ ID NO: 5255 - DNA, 15 bp, Artificial Sequence
  Description of Artificial Sequence: Synthetic oligonucleotide
aactatgccatgagc

SEQ ID NO: 5256 - protein, 5 aa, Artificial Sequence
  Description of Artificial Sequence: Synthetic peptide
NYAMS

SEQ ID NO: 5257 - DNA, 15 bp, Artificial Sequence
  Description of Artificial Sequence: Synthetic oligonucleotide
atctatggcatgcac

SEQ ID NO: 5258 - protein, 5 aa, Artificial Sequence
  Description of Artificial Sequence: Synthetic peptide
IYGMH

SEQ ID NO: 5259 - DNA, 15 bp, Artificial Sequence
  Description of Artificial Sequence: Synthetic oligonucleotide
agctatgccatgagt

SEQ ID NO: 5260 - protein, 5 aa, Artificial Sequence
  Description of Artificial Sequence: Synthetic peptide
SYAMS

SEQ ID NO: 5261 - DNA, 15 bp, Artificial Sequence
  Description of Artificial Sequence: Synthetic oligonucleotide
gactactacatgatc

SEQ ID NO: 5262 - protein, 5 aa, Artificial Sequence
  Description of Artificial Sequence: Synthetic peptide
DYYMI

SEQ ID NO: 5263 - DNA, 15 bp, Artificial Sequence
  Description of Artificial Sequence: Synthetic oligonucleotide
agctatggcatgcac

SEQ ID NO: 5264 - protein, 5 aa, Artificial Sequence
  Description of Artificial Sequence: Synthetic peptide
SYGMH

SEQ ID NO: 5265 - DNA, 15 bp, Artificial Sequence
  Description of Artificial Sequence: Synthetic oligonucleotide
agttatgccatgagc

SEQ ID NO: 5266 - protein, 5 aa, Artificial Sequence
  Description of Artificial Sequence: Synthetic peptide
SYAMS

SEQ ID NO: 5267 - DNA, 15 bp, Artificial Sequence
  Description of Artificial Sequence: Synthetic oligonucleotide
aactatgtcatgcac

SEQ ID NO: 5268 - protein, 5 aa, Artificial Sequence
  Description of Artificial Sequence: Synthetic peptide
NYVMH

SEQ ID NO: 5269 - DNA, 15 bp, Artificial Sequence
  Description of Artificial Sequence: Synthetic oligonucleotide
agttatgccatgagc

SEQ ID NO: 5270 - protein, 5 aa, Artificial Sequence
  Description of Artificial Sequence: Synthetic peptide
SYAMS

SEQ ID NO: 5271 - DNA, 15 bp, Artificial Sequence
  Description of Artificial Sequence: Synthetic oligonucleotide
aactctgccatgaac

SEQ ID NO: 5272 - protein, 5 aa, Artificial Sequence
  Description of Artificial Sequence: Synthetic peptide
NSAMN

SEQ ID NO: 5273 - DNA, 15 bp, Artificial Sequence
  Description of Artificial Sequence: Synthetic oligonucleotide
agctatggcatgcac

SEQ ID NO: 5274 - protein, 5 aa, Artificial Sequence
  Description of Artificial Sequence: Synthetic peptide
SYGMH

SEQ ID NO: 5275 - DNA, 15 bp, Artificial Sequence
  Description of Artificial Sequence: Synthetic oligonucleotide
gactacttcatgacc

SEQ ID NO: 5276 - protein, 5 aa, Artificial Sequence
  Description of Artificial Sequence: Synthetic peptide
DYFMT

SEQ ID NO: 5277 - DNA, 15 bp, Artificial Sequence
  Description of Artificial Sequence: Synthetic oligonucleotide
gactatggcatgcac

SEQ ID NO: 5278 - protein, 5 aa, Artificial Sequence
  Description of Artificial Sequence: Synthetic peptide
DYGMH

SEQ ID NO: 5279 - DNA, 15 bp, Artificial Sequence
  Description of Artificial Sequence: Synthetic oligonucleotide
gactacttcatgacc

SEQ ID NO: 5280 - protein, 5 aa, Artificial Sequence
  Description of Artificial Sequence: Synthetic peptide
DYFMT

SEQ ID NO: 5281 - DNA, 15 bp, Artificial Sequence
  Description of Artificial Sequence: Synthetic oligonucleotide
gactacttcatgacc

SEQ ID NO: 5282 - protein, 5 aa, Artificial Sequence
  Description of Artificial Sequence: Synthetic peptide
DYFMT

SEQ ID NO: 5283 - DNA, 15 bp, Artificial Sequence
  Description of Artificial Sequence: Synthetic oligonucleotide
gactatggcatgcac

SEQ ID NO: 5284 - protein, 5 aa, Artificial Sequence
  Description of Artificial Sequence: Synthetic peptide
DYGMH

SEQ ID NO: 5285 - DNA, 15 bp, Artificial Sequence
  Description of Artificial Sequence: Synthetic oligonucleotide
agctatggcatgcac

SEQ ID NO: 5286 - protein, 5 aa, Artificial Sequence
  Description of Artificial Sequence: Synthetic peptide
SYGMH

SEQ ID NO: 5287 - DNA, 15 bp, Artificial Sequence
  Description of Artificial Sequence: Synthetic oligonucleotide
agctatgccatgagc

SEQ ID NO: 5288 - protein, 5 aa, Artificial Sequence
  Description of Artificial Sequence: Synthetic peptide
SYAMS

SEQ ID NO: 5289 - DNA, 15 bp, Artificial Sequence
  Description of Artificial Sequence: Synthetic oligonucleotide
agttatggcatgcac

SEQ ID NO: 5290 - protein, 5 aa, Artificial Sequence
  Description of Artificial Sequence: Synthetic peptide
SYGMH

SEQ ID NO: 5291 - DNA, 15 bp, Artificial Sequence
  Description of Artificial Sequence: Synthetic oligonucleotide
agctatgccatgacc

SEQ ID NO: 5292 - protein, 5 aa, Artificial Sequence
  Description of Artificial Sequence: Synthetic peptide
SYAMT

SEQ ID NO: 5293 - DNA, 15 bp, Artificial Sequence
  Description of Artificial Sequence: Synthetic oligonucleotide
aactatggcatgcac

SEQ ID NO: 5294 - protein, 5 aa, Artificial Sequence
  Description of Artificial Sequence: Synthetic peptide
NYGMH

SEQ ID NO: 5295 - DNA, 15 bp, Artificial Sequence
  Description of Artificial Sequence: Synthetic oligonucleotide
agctatggcatgcac

SEQ ID NO: 5296 - protein, 5 aa, Artificial Sequence
  Description of Artificial Sequence: Synthetic peptide
SYGMH

SEQ ID NO: 5297 - DNA, 15 bp, Artificial Sequence
  Description of Artificial Sequence: Synthetic oligonucleotide
agttatggcatgcac

SEQ ID NO: 5298 - protein, 5 aa, Artificial Sequence
  Description of Artificial Sequence: Synthetic peptide
SYGMH

SEQ ID NO: 5299 - DNA, 15 bp, Artificial Sequence
  Description of Artificial Sequence: Synthetic oligonucleotide
ggctaccatatgcac

SEQ ID NO: 5300 - protein, 5 aa, Artificial Sequence
  Description of Artificial Sequence: Synthetic peptide
GYHMH

SEQ ID NO: 5301 - DNA, 15 bp, Artificial Sequence
  Description of Artificial Sequence: Synthetic oligonucleotide
agctatgccatgagc

SEQ ID NO: 5302 - protein, 5 aa, Artificial Sequence
  Description of Artificial Sequence: Synthetic peptide
SYAMS

SEQ ID NO: 5303 - DNA, 15 bp, Artificial Sequence
  Description of Artificial Sequence: Synthetic oligonucleotide
gactactacatgaac

SEQ ID NO: 5304 - protein, 5 aa, Artificial Sequence
  Description of Artificial Sequence: Synthetic peptide
DYYMN

SEQ ID NO: 5305 - DNA, 15 bp, Artificial Sequence
  Description of Artificial Sequence: Synthetic oligonucleotide
agttatgccatgagc

SEQ ID NO: 5306 - protein, 5 aa, Artificial Sequence
  Description of Artificial Sequence: Synthetic peptide
SYAMS

SEQ ID NO: 5307 - DNA, 15 bp, Artificial Sequence
  Description of Artificial Sequence: Synthetic oligonucleotide
agctatagcatgaac

SEQ ID NO: 5308 - protein, 5 aa, Artificial Sequence
  Description of Artificial Sequence: Synthetic peptide
SYSMN

SEQ ID NO: 5309 - DNA, 15 bp, Artificial Sequence
  Description of Artificial Sequence: Synthetic oligonucleotide
agttatgccatgagc

SEQ ID NO: 5310 - protein, 5 aa, Artificial Sequence
  Description of Artificial Sequence: Synthetic peptide
SYAMS

SEQ ID NO: 5311 - DNA, 15 bp, Artificial Sequence
  Description of Artificial Sequence: Synthetic oligonucleotide
ggccactatataaac

SEQ ID NO: 5312 - protein, 5 aa, Artificial Sequence
  Description of Artificial Sequence: Synthetic peptide
GHYIN

SEQ ID NO: 5313 - DNA, 15 bp, Artificial Sequence
  Description of Artificial Sequence: Synthetic oligonucleotide
agccatagcatgaac

SEQ ID NO: 5314 - protein, 5 aa, Artificial Sequence
  Description of Artificial Sequence: Synthetic peptide
SHSMN

SEQ ID NO: 5315 - DNA, 15 bp, Artificial Sequence
  Description of Artificial Sequence: Synthetic oligonucleotide
agctatggcatgcac

SEQ ID NO: 5316 - protein, 5 aa, Artificial Sequence
  Description of Artificial Sequence: Synthetic peptide
SYGMH

SEQ ID NO: 5317 - DNA, 15 bp, Artificial Sequence
  Description of Artificial Sequence: Synthetic oligonucleotide
agctatgtcatgagc

SEQ ID NO: 5318 - protein, 5 aa, Artificial Sequence
  Description of Artificial Sequence: Synthetic peptide
SYVMS

SEQ ID NO: 5319 - DNA, 15 bp, Artificial Sequence
  Description of Artificial Sequence: Synthetic oligonucleotide
agctatggcatgcac

SEQ ID NO: 5320 - protein, 5 aa, Artificial Sequence
  Description of Artificial Sequence: Synthetic peptide
SYGMH

SEQ ID NO: 5321 - DNA, 15 bp, Artificial Sequence
  Description of Artificial Sequence: Synthetic oligonucleotide
agctatgtcatgagc

SEQ ID NO: 5322 - protein, 5 aa, Artificial Sequence
  Description of Artificial Sequence: Synthetic peptide
SYVMS

SEQ ID NO: 5323 - DNA, 15 bp, Artificial Sequence
  Description of Artificial Sequence: Synthetic oligonucleotide
aactatgccatgacc

SEQ ID NO: 5324 - protein, 5 aa, Artificial Sequence
  Description of Artificial Sequence: Synthetic peptide
NYAMT

SEQ ID NO: 5325 - DNA, 15 bp, Artificial Sequence
  Description of Artificial Sequence: Synthetic oligonucleotide
agctatagcatgaac

SEQ ID NO: 5326 - protein, 5 aa, Artificial Sequence
  Description of Artificial Sequence: Synthetic peptide
SYSMN

SEQ ID NO: 5327 - DNA, 15 bp, Artificial Sequence
  Description of Artificial Sequence: Synthetic oligonucleotide
ggctaccatatgcac

SEQ ID NO: 5328 - protein, 5 aa, Artificial Sequence
  Description of Artificial Sequence: Synthetic peptide
GYHMH

SEQ ID NO: 5329 - DNA, 15 bp, Artificial Sequence
  Description of Artificial Sequence: Synthetic oligonucleotide
ggccactatatgaac

SEQ ID NO: 5330 - protein, 5 aa, Artificial Sequence
  Description of Artificial Sequence: Synthetic peptide
GHYMN

SEQ ID NO: 5331 - DNA, 15 bp, Artificial Sequence
  Description of Artificial Sequence: Synthetic oligonucleotide
ggctaccatatacac

SEQ ID NO: 5332 - protein, 5 aa, Artificial Sequence
  Description of Artificial Sequence: Synthetic peptide
GYHIH

SEQ ID NO: 5333 - DNA, 15 bp, Artificial Sequence
  Description of Artificial Sequence: Synthetic oligonucleotide
gactatggcatgcac

SEQ ID NO: 5334 - protein, 5 aa, Artificial Sequence
  Description of Artificial Sequence: Synthetic peptide
DYGMH

SEQ ID NO: 5335 - DNA, 15 bp, Artificial Sequence
  Description of Artificial Sequence: Synthetic oligonucleotide
agctatgccatgagc

SEQ ID NO: 5336 - protein, 5 aa, Artificial Sequence
  Description of Artificial Sequence: Synthetic peptide
SYAMS

SEQ ID NO: 5337 - DNA, 15 bp, Artificial Sequence
  Description of Artificial Sequence: Synthetic oligonucleotide
gactatggcatgcac

SEQ ID NO: 5338 - protein, 5 aa, Artificial Sequence
  Description of Artificial Sequence: Synthetic peptide
DYGMH

SEQ ID NO: 5339 - DNA, 15 bp, Artificial Sequence
  Description of Artificial Sequence: Synthetic oligonucleotide
aactttggcatgcac

SEQ ID NO: 5340 - protein, 5 aa, Artificial Sequence
  Description of Artificial Sequence: Synthetic peptide
NFGMH

SEQ ID NO: 5341 - DNA, 15 bp, Artificial Sequence
  Description of Artificial Sequence: Synthetic oligonucleotide
ggctatcatatgcag

SEQ ID NO: 5342 - protein, 5 aa, Artificial Sequence
  Description of Artificial Sequence: Synthetic peptide
GYHMQ

SEQ ID NO: 5343 - DNA, 15 bp, Artificial Sequence
  Description of Artificial Sequence: Synthetic oligonucleotide
aactatggcatgcac

SEQ ID NO: 5344 - protein, 5 aa, Artificial Sequence
  Description of Artificial Sequence: Synthetic peptide
NYGMH

SEQ ID NO: 5345 - DNA, 15 bp, Artificial Sequence
  Description of Artificial Sequence: Synthetic oligonucleotide
agaaatgccatgagc

SEQ ID NO: 5346 - protein, 5 aa, Artificial Sequence
  Description of Artificial Sequence: Synthetic peptide
RNAMS

SEQ ID NO: 5347 - DNA, 15 bp, Artificial Sequence
  Description of Artificial Sequence: Synthetic oligonucleotide
agctataaaatgaac

SEQ ID NO: 5348 - protein, 5 aa, Artificial Sequence
  Description of Artificial Sequence: Synthetic peptide
SYKMN

SEQ ID NO: 5349 - DNA, 15 bp, Artificial Sequence
  Description of Artificial Sequence: Synthetic oligonucleotide
agctatggcatgcac

SEQ ID NO: 5350 - protein, 5 aa, Artificial Sequence
  Description of Artificial Sequence: Synthetic peptide
SYGMH

SEQ ID NO: 5351 - DNA, 15 bp, Artificial Sequence
  Description of Artificial Sequence: Synthetic oligonucleotide
gactatggcatgcac

SEQ ID NO: 5352 - protein, 5 aa, Artificial Sequence
  Description of Artificial Sequence: Synthetic peptide
DYGMH

SEQ ID NO: 5353 - DNA, 15 bp, Artificial Sequence
  Description of Artificial Sequence: Synthetic oligonucleotide
agttatggcatgcac

SEQ ID NO: 5354 - protein, 5 aa, Artificial Sequence
  Description of Artificial Sequence: Synthetic peptide
SYGMH

SEQ ID NO: 5355 - DNA, 15 bp, Artificial Sequence
  Description of Artificial Sequence: Synthetic oligonucleotide
ttctatggcatgcac

SEQ ID NO: 5356 - protein, 5 aa, Artificial Sequence
  Description of Artificial Sequence: Synthetic peptide
FYGMH

SEQ ID NO: 5357 - DNA, 15 bp, Artificial Sequence
  Description of Artificial Sequence: Synthetic oligonucleotide
ggctaccatatgcag

SEQ ID NO: 5358 - protein, 5 aa, Artificial Sequence
  Description of Artificial Sequence: Synthetic peptide
GYHMQ

SEQ ID NO: 5359 - DNA, 15 bp, Artificial Sequence
  Description of Artificial Sequence: Synthetic oligonucleotide
agctatagcatgaac

SEQ ID NO: 5360 - protein, 5 aa, Artificial Sequence
  Description of Artificial Sequence: Synthetic peptide
SYSMN

SEQ ID NO: 5361 - DNA, 15 bp, Artificial Sequence
  Description of Artificial Sequence: Synthetic oligonucleotide
agctatagcatgaac

SEQ ID NO: 5362 - protein, 5 aa, Artificial Sequence
  Description of Artificial Sequence: Synthetic peptide
SYSMN

SEQ ID NO: 5363 - DNA, 15 bp, Artificial Sequence
  Description of Artificial Sequence: Synthetic oligonucleotide
aactatggcatgcac

SEQ ID NO: 5364 - protein, 5 aa, Artificial Sequence
  Description of Artificial Sequence: Synthetic peptide
NYGMH

SEQ ID NO: 5365 - DNA, 15 bp, Artificial Sequence
  Description of Artificial Sequence: Synthetic oligonucleotide
agctatgccatgagc

SEQ ID NO: 5366 - protein, 5 aa, Artificial Sequence
  Description of Artificial Sequence: Synthetic peptide
SYAMS

SEQ ID NO: 5367 - DNA, 15 bp, Artificial Sequence
  Description of Artificial Sequence: Synthetic oligonucleotide
agctatggcatgcac

SEQ ID NO: 5368 - protein, 5 aa, Artificial Sequence
  Description of Artificial Sequence: Synthetic peptide
SYGMH

SEQ ID NO: 5369 - DNA, 15 bp, Artificial Sequence
  Description of Artificial Sequence: Synthetic oligonucleotide
agctatgtcatgagc

SEQ ID NO: 5370 - protein, 5 aa, Artificial Sequence
  Description of Artificial Sequence: Synthetic peptide
SYVMS

SEQ ID NO: 5371 - DNA, 15 bp, Artificial Sequence
  Description of Artificial Sequence: Synthetic oligonucleotide
agctatgccatgaac

SEQ ID NO: 5372 - protein, 5 aa, Artificial Sequence
  Description of Artificial Sequence: Synthetic peptide
SYAMN

SEQ ID NO: 5373 - DNA, 15 bp, Artificial Sequence
  Description of Artificial Sequence: Synthetic oligonucleotide
gactatggcatccac

SEQ ID NO: 5374 - protein, 5 aa, Artificial Sequence
  Description of Artificial Sequence: Synthetic peptide
DYGIH

SEQ ID NO: 5375 - DNA, 15 bp, Artificial Sequence
  Description of Artificial Sequence: Synthetic oligonucleotide
agctatggcatgcac

SEQ ID NO: 5376 - protein, 5 aa, Artificial Sequence
  Description of Artificial Sequence: Synthetic peptide
SYGMH

SEQ ID NO: 5377 - DNA, 15 bp, Artificial Sequence
  Description of Artificial Sequence: Synthetic oligonucleotide
ggctaccatatgcac

SEQ ID NO: 5378 - protein, 5 aa, Artificial Sequence
  Description of Artificial Sequence: Synthetic peptide
GYHMH

SEQ ID NO: 5379 - DNA, 15 bp, Artificial Sequence
  Description of Artificial Sequence: Synthetic oligonucleotide
agctatggcatgcac

SEQ ID NO: 5380 - protein, 5 aa, Artificial Sequence
  Description of Artificial Sequence: Synthetic peptide
SYGMH

SEQ ID NO: 5381 - DNA, 15 bp, Artificial Sequence
  Description of Artificial Sequence: Synthetic oligonucleotide
aactttggcatgcac

SEQ ID NO: 5382 - protein, 5 aa, Artificial Sequence
  Description of Artificial Sequence: Synthetic peptide
NFGMH

SEQ ID NO: 5383 - DNA, 15 bp, Artificial Sequence
  Description of Artificial Sequence: Synthetic oligonucleotide
aactatggcatgcac

SEQ ID NO: 5384 - protein, 5 aa, Artificial Sequence
  Description of Artificial Sequence: Synthetic peptide
NYGMH

SEQ ID NO: 5385 - DNA, 15 bp, Artificial Sequence
  Description of Artificial Sequence: Synthetic oligonucleotide
acctatgccatgagt

SEQ ID NO: 5386 - protein, 5 aa, Artificial Sequence
  Description of Artificial Sequence: Synthetic peptide
TYAMS

SEQ ID NO: 5387 - DNA, 15 bp, Artificial Sequence
  Description of Artificial Sequence: Synthetic oligonucleotide
agctatagcatgatc

SEQ ID NO: 5388 - protein, 5 aa, Artificial Sequence
  Description of Artificial Sequence: Synthetic peptide
SYSMI

SEQ ID NO: 5389 - DNA, 15 bp, Artificial Sequence
  Description of Artificial Sequence: Synthetic oligonucleotide
agctatggcatgcac

SEQ ID NO: 5390 - protein, 5 aa, Artificial Sequence
  Description of Artificial Sequence: Synthetic peptide
SYGMH

SEQ ID NO: 5391 - DNA, 15 bp, Artificial Sequence
  Description of Artificial Sequence: Synthetic oligonucleotide
gactatggcatccac

SEQ ID NO: 5392 - protein, 5 aa, Artificial Sequence
  Description of Artificial Sequence: Synthetic peptide
DYGIH

SEQ ID NO: 5393 - DNA, 15 bp, Artificial Sequence
  Description of Artificial Sequence: Synthetic oligonucleotide
aactatggcatgcac

SEQ ID NO: 5394 - protein, 5 aa, Artificial Sequence
  Description of Artificial Sequence: Synthetic peptide
NYGMH

SEQ ID NO: 5395 - DNA, 15 bp, Artificial Sequence
  Description of Artificial Sequence: Synthetic oligonucleotide
ggctactatttccac

SEQ ID NO: 5396 - protein, 5 aa, Artificial Sequence
  Description of Artificial Sequence: Synthetic peptide
GYYFH

SEQ ID NO: 5397 - DNA, 15 bp, Artificial Sequence
  Description of Artificial Sequence: Synthetic oligonucleotide
agctatgccatgagc

SEQ ID NO: 5398 - protein, 5 aa, Artificial Sequence
  Description of Artificial Sequence: Synthetic peptide
SYAMS

SEQ ID NO: 5399 - DNA, 15 bp, Artificial Sequence
  Description of Artificial Sequence: Synthetic oligonucleotide
agctatggcatgcac

SEQ ID NO: 5400 - protein, 5 aa, Artificial Sequence
  Description of Artificial Sequence: Synthetic peptide
SYGMH

SEQ ID NO: 5401 - DNA, 15 bp, Artificial Sequence
  Description of Artificial Sequence: Synthetic oligonucleotide
agttatggcatgcac

SEQ ID NO: 5402 - protein, 5 aa, Artificial Sequence
  Description of Artificial Sequence: Synthetic peptide
SYGMH

SEQ ID NO: 5403 - DNA, 15 bp, Artificial Sequence
  Description of Artificial Sequence: Synthetic oligonucleotide
agctatggcatgcac

SEQ ID NO: 5404 - protein, 5 aa, Artificial Sequence
  Description of Artificial Sequence: Synthetic peptide
SYGMH

SEQ ID NO: 5405 - DNA, 15 bp, Artificial Sequence
  Description of Artificial Sequence: Synthetic oligonucleotide
agttataggatgaac

SEQ ID NO: 5406 - protein, 5 aa, Artificial Sequence
  Description of Artificial Sequence: Synthetic peptide
SYRMN

SEQ ID NO: 5407 - DNA, 15 bp, Artificial Sequence
  Description of Artificial Sequence: Synthetic oligonucleotide
gactatggcatgcac

SEQ ID NO: 5408 - protein, 5 aa, Artificial Sequence
  Description of Artificial Sequence: Synthetic peptide
DYGMH

SEQ ID NO: 5409 - DNA, 15 bp, Artificial Sequence
  Description of Artificial Sequence: Synthetic oligonucleotide
agctatggcatgcac

SEQ ID NO: 5410 - protein, 5 aa, Artificial Sequence
  Description of Artificial Sequence: Synthetic peptide
SYGMH

SEQ ID NO: 5411 - DNA, 15 bp, Artificial Sequence
  Description of Artificial Sequence: Synthetic oligonucleotide
agctatggcatgcac

SEQ ID NO: 5412 - protein, 5 aa, Artificial Sequence
  Description of Artificial Sequence: Synthetic peptide
SYGMH

SEQ ID NO: 5413 - DNA, 15 bp, Artificial Sequence
  Description of Artificial Sequence: Synthetic oligonucleotide
agctatggcatgcac

SEQ ID NO: 5414 - protein, 5 aa, Artificial Sequence
  Description of Artificial Sequence: Synthetic peptide
SYGMH

SEQ ID NO: 5415 - DNA, 15 bp, Artificial Sequence
  Description of Artificial Sequence: Synthetic oligonucleotide
acctatgccatgacc

SEQ ID NO: 5416 - protein, 5 aa, Artificial Sequence
  Description of Artificial Sequence: Synthetic peptide
TYAMT

SEQ ID NO: 5417 - DNA, 15 bp, Artificial Sequence
  Description of Artificial Sequence: Synthetic oligonucleotide
gactatggcatgcac

SEQ ID NO: 5418 - protein, 5 aa, Artificial Sequence
  Description of Artificial Sequence: Synthetic peptide
DYGMH

SEQ ID NO: 5419 - DNA, 15 bp, Artificial Sequence
  Description of Artificial Sequence: Synthetic oligonucleotide
agttactatatacac

SEQ ID NO: 5420 - protein, 5 aa, Artificial Sequence
  Description of Artificial Sequence: Synthetic peptide
SYYIH

SEQ ID NO: 5421 - DNA, 15 bp, Artificial Sequence
  Description of Artificial Sequence: Synthetic oligonucleotide
agctatggcatgcac

SEQ ID NO: 5422 - protein, 5 aa, Artificial Sequence
  Description of Artificial Sequence: Synthetic peptide
SYGMH

SEQ ID NO: 5423 - DNA, 15 bp, Artificial Sequence
  Description of Artificial Sequence: Synthetic oligonucleotide
aattatgatatcaac

SEQ ID NO: 5424 - protein, 5 aa, Artificial Sequence
  Description of Artificial Sequence: Synthetic peptide
NYDIN

SEQ ID NO: 5425 - DNA, 15 bp, Artificial Sequence
  Description of Artificial Sequence: Synthetic oligonucleotide
agctatagcatgaac

SEQ ID NO: 5426 - protein, 5 aa, Artificial Sequence
  Description of Artificial Sequence: Synthetic peptide
SYSMN

SEQ ID NO: 5427 - DNA, 15 bp, Artificial Sequence
  Description of Artificial Sequence: Synthetic oligonucleotide
agctatgccatgagc

SEQ ID NO: 5428 - protein, 5 aa, Artificial Sequence
  Description of Artificial Sequence: Synthetic peptide
SYAMS

SEQ ID NO: 5429 - DNA, 15 bp, Artificial Sequence
  Description of Artificial Sequence: Synthetic oligonucleotide
agctatagcatgaac

SEQ ID NO: 5430 - protein, 5 aa, Artificial Sequence
  Description of Artificial Sequence: Synthetic peptide
SYSMN

SEQ ID NO: 5431 - DNA, 15 bp, Artificial Sequence
  Description of Artificial Sequence: Synthetic oligonucleotide
ggctaccatatgcac

SEQ ID NO: 5432 - protein, 5 aa, Artificial Sequence
  Description of Artificial Sequence: Synthetic peptide
GYHMH

SEQ ID NO: 5433 - DNA, 15 bp, Artificial Sequence
  Description of Artificial Sequence: Synthetic oligonucleotide
agctatggcatgcac

SEQ ID NO: 5434 - protein, 5 aa, Artificial Sequence
  Description of Artificial Sequence: Synthetic peptide
SYGMH

SEQ ID NO: 5435 - DNA, 15 bp, Artificial Sequence
  Description of Artificial Sequence: Synthetic oligonucleotide
gactaccatatgcac

SEQ ID NO: 5436 - protein, 5 aa, Artificial Sequence
  Description of Artificial Sequence: Synthetic peptide
DYHMH

SEQ ID NO: 5437 - DNA, 15 bp, Artificial Sequence
  Description of Artificial Sequence: Synthetic oligonucleotide
gactactatatgcac

SEQ ID NO: 5438 - protein, 5 aa, Artificial Sequence
  Description of Artificial Sequence: Synthetic peptide
DYYMH

SEQ ID NO: 5439 - DNA, 15 bp, Artificial Sequence
  Description of Artificial Sequence: Synthetic oligonucleotide
ggccactatataaac

SEQ ID NO: 5440 - protein, 5 aa, Artificial Sequence
  Description of Artificial Sequence: Synthetic peptide
GHYIN

SEQ ID NO: 5441 - DNA, 15 bp, Artificial Sequence
  Description of Artificial Sequence: Synthetic oligonucleotide
aactatggcatgcac

SEQ ID NO: 5442 - protein, 5 aa, Artificial Sequence
  Description of Artificial Sequence: Synthetic peptide
NYGMH

SEQ ID NO: 5443 - DNA, 15 bp, Artificial Sequence
  Description of Artificial Sequence: Synthetic oligonucleotide
agctatggcatgcac

SEQ ID NO: 5444 - protein, 5 aa, Artificial Sequence
  Description of Artificial Sequence: Synthetic peptide
SYGMH

SEQ ID NO: 5445 - DNA, 15 bp, Artificial Sequence
  Description of Artificial Sequence: Synthetic oligonucleotide
gactatggcatgcac

SEQ ID NO: 5446 - protein, 5 aa, Artificial Sequence
  Description of Artificial Sequence: Synthetic peptide
DYGMH

SEQ ID NO: 5447 - DNA, 15 bp, Artificial Sequence
  Description of Artificial Sequence: Synthetic oligonucleotide
agttatggcatgcac

SEQ ID NO: 5448 - protein, 5 aa, Artificial Sequence
  Description of Artificial Sequence: Synthetic peptide
SYGMH

SEQ ID NO: 5449 - DNA, 15 bp, Artificial Sequence
  Description of Artificial Sequence: Synthetic oligonucleotide
agctatggcatgcac

SEQ ID NO: 5450 - protein, 5 aa, Artificial Sequence
  Description of Artificial Sequence: Synthetic peptide
SYGMH

SEQ ID NO: 5451 - DNA, 15 bp, Artificial Sequence
  Description of Artificial Sequence: Synthetic oligonucleotide
ggccactatatacac

SEQ ID NO: 5452 - protein, 5 aa, Artificial Sequence
  Description of Artificial Sequence: Synthetic peptide
GHYIH

SEQ ID NO: 5453 - DNA, 15 bp, Artificial Sequence
  Description of Artificial Sequence: Synthetic oligonucleotide
aattatgatatcaac

SEQ ID NO: 5454 - protein, 5 aa, Artificial Sequence
  Description of Artificial Sequence: Synthetic peptide
NYDIN

SEQ ID NO: 5455 - DNA, 15 bp, Artificial Sequence
  Description of Artificial Sequence: Synthetic oligonucleotide
agctatgtcatgagc

SEQ ID NO: 5456 - protein, 5 aa, Artificial Sequence
  Description of Artificial Sequence: Synthetic peptide
SYVMS

SEQ ID NO: 5457 - DNA, 15 bp, Artificial Sequence
  Description of Artificial Sequence: Synthetic oligonucleotide
agctatgtcatgagc

SEQ ID NO: 5458 - protein, 5 aa, Artificial Sequence
  Description of Artificial Sequence: Synthetic peptide
SYVMS

SEQ ID NO: 5459 - DNA, 21 bp, Artificial Sequence
  Description of Artificial Sequence: Synthetic oligonucleotide
aggagtagttactactggggc

SEQ ID NO: 5460 - protein, 7 aa, Artificial Sequence
  Description of Artificial Sequence: Synthetic peptide
RSSYYWG

SEQ ID NO: 5461 - DNA, 15 bp, Artificial Sequence
  Description of Artificial Sequence: Synthetic oligonucleotide
agctatgccatgagc

SEQ ID NO: 5462 - protein, 5 aa, Artificial Sequence
  Description of Artificial Sequence: Synthetic peptide
SYAMS

SEQ ID NO: 5463 - DNA, 15 bp, Artificial Sequence
  Description of Artificial Sequence: Synthetic oligonucleotide
aactatgccatgacc

SEQ ID NO: 5464 - protein, 5 aa, Artificial Sequence
  Description of Artificial Sequence: Synthetic peptide
NYAMT

SEQ ID NO: 5465 - DNA, 15 bp, Artificial Sequence
  Description of Artificial Sequence: Synthetic oligonucleotide
agctatggcatgcac

SEQ ID NO: 5466 - protein, 5 aa, Artificial Sequence
  Description of Artificial Sequence: Synthetic peptide
SYGMH

SEQ ID NO: 5467 - DNA, 15 bp, Artificial Sequence
  Description of Artificial Sequence: Synthetic oligonucleotide
agttacttctggagc

SEQ ID NO: 5468 - protein, 5 aa, Artificial Sequence
  Description of Artificial Sequence: Synthetic peptide
SYFWS

SEQ ID NO: 5469 - DNA, 15 bp, Artificial Sequence
  Description of Artificial Sequence: Synthetic oligonucleotide
agtcacttctggagc

SEQ ID NO: 5470 - protein, 5 aa, Artificial Sequence
  Description of Artificial Sequence: Synthetic peptide
SHFWS

SEQ ID NO: 5471 - DNA, 15 bp, Artificial Sequence
  Description of Artificial Sequence: Synthetic oligonucleotide
gactatggcatgcac

SEQ ID NO: 5472 - protein, 5 aa, Artificial Sequence
  Description of Artificial Sequence: Synthetic peptide
DYGMH

SEQ ID NO: 5473 - DNA, 15 bp, Artificial Sequence
  Description of Artificial Sequence: Synthetic oligonucleotide
agctatggcatgcac

SEQ ID NO: 5474 - protein, 5 aa, Artificial Sequence
  Description of Artificial Sequence: Synthetic peptide
SYGMH

SEQ ID NO: 5475 - DNA, 15 bp, Artificial Sequence
  Description of Artificial Sequence: Synthetic oligonucleotide
agctatggcatgcac

SEQ ID NO: 5476 - protein, 5 aa, Artificial Sequence
  Description of Artificial Sequence: Synthetic peptide
SYGMH

SEQ ID NO: 5477 - DNA, 15 bp, Artificial Sequence
  Description of Artificial Sequence: Synthetic oligonucleotide
aattatgatatcaac

SEQ ID NO: 5478 - protein, 5 aa, Artificial Sequence
  Description of Artificial Sequence: Synthetic peptide
NYDIN

SEQ ID NO: 5479 - DNA, 15 bp, Artificial Sequence
  Description of Artificial Sequence: Synthetic oligonucleotide
aattatgatatcaac

SEQ ID NO: 5480 - protein, 5 aa, Artificial Sequence
  Description of Artificial Sequence: Synthetic peptide
NYDIN

SEQ ID NO: 5481 - DNA, 15 bp, Artificial Sequence
  Description of Artificial Sequence: Synthetic oligonucleotide
agctatgccatgagt

SEQ ID NO: 5482 - protein, 5 aa, Artificial Sequence
  Description of Artificial Sequence: Synthetic peptide
SYAMS

SEQ ID NO: 5483 - DNA, 15 bp, Artificial Sequence
  Description of Artificial Sequence: Synthetic oligonucleotide
agctatgccatgagc

SEQ ID NO: 5484 - protein, 5 aa, Artificial Sequence
  Description of Artificial Sequence: Synthetic peptide
SYAMS

SEQ ID NO: 5485 - DNA, 15 bp, Artificial Sequence
  Description of Artificial Sequence: Synthetic oligonucleotide
agctatagcatgaac

SEQ ID NO: 5486 - protein, 5 aa, Artificial Sequence
  Description of Artificial Sequence: Synthetic peptide
SYSMN

SEQ ID NO: 5487 - DNA, 15 bp, Artificial Sequence
  Description of Artificial Sequence: Synthetic oligonucleotide
agctatggcatgcac

SEQ ID NO: 5488 - protein, 5 aa, Artificial Sequence
  Description of Artificial Sequence: Synthetic peptide
SYGMH

SEQ ID NO: 5489 - DNA, 15 bp, Artificial Sequence
  Description of Artificial Sequence: Synthetic oligonucleotide
agctatggcatgcac

SEQ ID NO: 5490 - protein, 5 aa, Artificial Sequence
  Description of Artificial Sequence: Synthetic peptide
SYGMH

SEQ ID NO: 5491 - DNA, 21 bp, Artificial Sequence
  Description of Artificial Sequence: Synthetic oligonucleotide
agaagtagttactactggggc

SEQ ID NO: 5492 - protein, 7 aa, Artificial Sequence
  Description of Artificial Sequence: Synthetic peptide
RSSYYWG

SEQ ID NO: 5493 - DNA, 15 bp, Artificial Sequence
  Description of Artificial Sequence: Synthetic oligonucleotide
agctatagcatgaac

SEQ ID NO: 5494 - protein, 5 aa, Artificial Sequence
  Description of Artificial Sequence: Synthetic peptide
SYSMN

SEQ ID NO: 5495 - DNA, 15 bp, Artificial Sequence
  Description of Artificial Sequence: Synthetic oligonucleotide
gactatggcatgcac

SEQ ID NO: 5496 - protein, 5 aa, Artificial Sequence
  Description of Artificial Sequence: Synthetic peptide
DYGMH

SEQ ID NO: 5497 - DNA, 15 bp, Artificial Sequence
  Description of Artificial Sequence: Synthetic oligonucleotide
tcctatggcatgcac

SEQ ID NO: 5498 - protein, 5 aa, Artificial Sequence
  Description of Artificial Sequence: Synthetic peptide
SYGMH

SEQ ID NO: 5499 - DNA, 15 bp, Artificial Sequence
  Description of Artificial Sequence: Synthetic oligonucleotide
agctatgttatgagc

SEQ ID NO: 5500 - protein, 5 aa, Artificial Sequence
  Description of Artificial Sequence: Synthetic peptide
SYVMS

SEQ ID NO: 5501 - DNA, 15 bp, Artificial Sequence
  Description of Artificial Sequence: Synthetic oligonucleotide
ggctactatatgcac

SEQ ID NO: 5502 - protein, 5 aa, Artificial Sequence
  Description of Artificial Sequence: Synthetic peptide
GYYMH

SEQ ID NO: 5503 - DNA, 15 bp, Artificial Sequence
  Description of Artificial Sequence: Synthetic oligonucleotide
agctatgtcttaaac

SEQ ID NO: 5504 - protein, 5 aa, Artificial Sequence
  Description of Artificial Sequence: Synthetic peptide
SYVLN

SEQ ID NO: 5505 - DNA, 15 bp, Artificial Sequence
  Description of Artificial Sequence: Synthetic oligonucleotide
agctatagcatgaac

SEQ ID NO: 5506 - protein, 5 aa, Artificial Sequence
  Description of Artificial Sequence: Synthetic peptide
SYSMN

SEQ ID NO: 5507 - DNA, 15 bp, Artificial Sequence
  Description of Artificial Sequence: Synthetic oligonucleotide
agctatagcatgaac

SEQ ID NO: 5508 - protein, 5 aa, Artificial Sequence
  Description of Artificial Sequence: Synthetic peptide
SYSMN

SEQ ID NO: 5509 - DNA, 15 bp, Artificial Sequence
  Description of Artificial Sequence: Synthetic oligonucleotide
agttactactggagc

SEQ ID NO: 5510 - protein, 5 aa, Artificial Sequence
  Description of Artificial Sequence: Synthetic peptide
SYYWS

SEQ ID NO: 5511 - DNA, 15 bp, Artificial Sequence
  Description of Artificial Sequence: Synthetic oligonucleotide
agctatggcatgcac

SEQ ID NO: 5512 - protein, 5 aa, Artificial Sequence
  Description of Artificial Sequence: Synthetic peptide
SYGMH

SEQ ID NO: 5513 - DNA, 15 bp, Artificial Sequence
  Description of Artificial Sequence: Synthetic oligonucleotide
gactatggcatgcac

SEQ ID NO: 5514 - protein, 5 aa, Artificial Sequence
  Description of Artificial Sequence: Synthetic peptide
DYGMH

SEQ ID NO: 5515 - DNA, 15 bp, Artificial Sequence
  Description of Artificial Sequence: Synthetic oligonucleotide
agctatgccatgagc

SEQ ID NO: 5516 - protein, 5 aa, Artificial Sequence
  Description of Artificial Sequence: Synthetic peptide
SYAMS

SEQ ID NO: 5517 - DNA, 15 bp, Artificial Sequence
  Description of Artificial Sequence: Synthetic oligonucleotide
gactactacatgaac

SEQ ID NO: 5518 - protein, 5 aa, Artificial Sequence
  Description of Artificial Sequence: Synthetic peptide
DYYMN

SEQ ID NO: 5519 - DNA, 15 bp, Artificial Sequence
  Description of Artificial Sequence: Synthetic oligonucleotide
ggctaccatatacac

SEQ ID NO: 5520 - protein, 5 aa, Artificial Sequence
  Description of Artificial Sequence: Synthetic peptide
GYHIH

SEQ ID NO: 5521 - DNA, 15 bp, Artificial Sequence
  Description of Artificial Sequence: Synthetic oligonucleotide
agctatgccatgagc

SEQ ID NO: 5522 - protein, 5 aa, Artificial Sequence
  Description of Artificial Sequence: Synthetic peptide
SYAMS

SEQ ID NO: 5523 - DNA, 15 bp, Artificial Sequence
  Description of Artificial Sequence: Synthetic oligonucleotide
agctatgccatgagc

SEQ ID NO: 5524 - protein, 5 aa, Artificial Sequence
  Description of Artificial Sequence: Synthetic peptide
SYAMS

SEQ ID NO: 5525 - DNA, 15 bp, Artificial Sequence
  Description of Artificial Sequence: Synthetic oligonucleotide
aactatgccatgagc

SEQ ID NO: 5526 - protein, 5 aa, Artificial Sequence
  Description of Artificial Sequence: Synthetic peptide
NYAMS

SEQ ID NO: 5527 - DNA, 15 bp, Artificial Sequence
  Description of Artificial Sequence: Synthetic oligonucleotide
aattatgatatcaac

SEQ ID NO: 5528 - protein, 5 aa, Artificial Sequence
  Description of Artificial Sequence: Synthetic peptide
NYDIN

SEQ ID NO: 5529 - DNA, 15 bp, Artificial Sequence
  Description of Artificial Sequence: Synthetic oligonucleotide
aattatgatatcaac

SEQ ID NO: 5530 - protein, 5 aa, Artificial Sequence
  Description of Artificial Sequence: Synthetic peptide
NYDIN

SEQ ID NO: 5531 - DNA, 15 bp, Artificial Sequence
  Description of Artificial Sequence: Synthetic oligonucleotide
agctacgccatgagc

SEQ ID NO: 5532 - protein, 5 aa, Artificial Sequence
  Description of Artificial Sequence: Synthetic peptide
SYAMS

SEQ ID NO: 5533 - DNA, 15 bp, Artificial Sequence
  Description of Artificial Sequence: Synthetic oligonucleotide
agctacgccatgagc

SEQ ID NO: 5534 - protein, 5 aa, Artificial Sequence
  Description of Artificial Sequence: Synthetic peptide
SYAMS

SEQ ID NO: 5535 - DNA, 15 bp, Artificial Sequence
  Description of Artificial Sequence: Synthetic oligonucleotide
gactatggcatgcac

SEQ ID NO: 5536 - protein, 5 aa, Artificial Sequence
  Description of Artificial Sequence: Synthetic peptide
DYGMH

SEQ ID NO: 5537 - DNA, 15 bp, Artificial Sequence
  Description of Artificial Sequence: Synthetic oligonucleotide
aattatgatatcaac

SEQ ID NO: 5538 - protein, 5 aa, Artificial Sequence
  Description of Artificial Sequence: Synthetic peptide
NYDIN

SEQ ID NO: 5539 - DNA, 15 bp, Artificial Sequence
  Description of Artificial Sequence: Synthetic oligonucleotide
agctatgccatgagc

SEQ ID NO: 5540 - protein, 5 aa, Artificial Sequence
  Description of Artificial Sequence: Synthetic peptide
SYAMS

SEQ ID NO: 5541 - DNA, 15 bp, Artificial Sequence
  Description of Artificial Sequence: Synthetic oligonucleotide
gactatgacatacac

SEQ ID NO: 5542 - protein, 5 aa, Artificial Sequence
  Description of Artificial Sequence: Synthetic peptide
DYDIH

SEQ ID NO: 5543 - DNA, 15 bp, Artificial Sequence
  Description of Artificial Sequence: Synthetic oligonucleotide
agctatgccatgagc

SEQ ID NO: 5544 - protein, 5 aa, Artificial Sequence
  Description of Artificial Sequence: Synthetic peptide
SYAMS

SEQ ID NO: 5545 - DNA, 15 bp, Artificial Sequence
  Description of Artificial Sequence: Synthetic oligonucleotide
agctatggcatgcac

SEQ ID NO: 5546 - protein, 5 aa, Artificial Sequence
  Description of Artificial Sequence: Synthetic peptide
SYGMH

SEQ ID NO: 5547 - DNA, 15 bp, Artificial Sequence
  Description of Artificial Sequence: Synthetic oligonucleotide
aattatgatatcaac

SEQ ID NO: 5548 - protein, 5 aa, Artificial Sequence
  Description of Artificial Sequence: Synthetic peptide
NYDIN

SEQ ID NO: 5549 - DNA, 15 bp, Artificial Sequence
  Description of Artificial Sequence: Synthetic oligonucleotide
ggctactatatacac

SEQ ID NO: 5550 - protein, 5 aa, Artificial Sequence
  Description of Artificial Sequence: Synthetic peptide
GYYIH

SEQ ID NO: 5551 - DNA, 15 bp, Artificial Sequence
  Description of Artificial Sequence: Synthetic oligonucleotide
agctatgccatgaac

SEQ ID NO: 5552 - protein, 5 aa, Artificial Sequence
  Description of Artificial Sequence: Synthetic peptide
SYAMN

SEQ ID NO: 5553 - DNA, 15 bp, Artificial Sequence
  Description of Artificial Sequence: Synthetic oligonucleotide
agctatggcatgcac

SEQ ID NO: 5554 - protein, 5 aa, Artificial Sequence
  Description of Artificial Sequence: Synthetic peptide
SYGMH

SEQ ID NO: 5555 - DNA, 21 bp, Artificial Sequence
  Description of Artificial Sequence: Synthetic oligonucleotide
agaagtagttactactggggc

SEQ ID NO: 5556 - protein, 7 aa, Artificial Sequence
  Description of Artificial Sequence: Synthetic peptide
RSSYYWG

SEQ ID NO: 5557 - DNA, 15 bp, Artificial Sequence
  Description of Artificial Sequence: Synthetic oligonucleotide
ggccactatatacac

SEQ ID NO: 5558 - protein, 5 aa, Artificial Sequence
  Description of Artificial Sequence: Synthetic peptide
GHYIH

SEQ ID NO: 5559 - DNA, 15 bp, Artificial Sequence
  Description of Artificial Sequence: Synthetic oligonucleotide
agctatagcatgaat

SEQ ID NO: 5560 - protein, 5 aa, Artificial Sequence
  Description of Artificial Sequence: Synthetic peptide
SYSMN

SEQ ID NO: 5561 - DNA, 15 bp, Artificial Sequence
  Description of Artificial Sequence: Synthetic oligonucleotide
ggcaattatatacac

SEQ ID NO: 5562 - protein, 5 aa, Artificial Sequence
  Description of Artificial Sequence: Synthetic peptide
GNYIH

SEQ ID NO: 5563 - DNA, 15 bp, Artificial Sequence
  Description of Artificial Sequence: Synthetic oligonucleotide
aattatgatatcaac

SEQ ID NO: 5564 - protein, 5 aa, Artificial Sequence
  Description of Artificial Sequence: Synthetic peptide
NYDIN

SEQ ID NO: 5565 - DNA, 15 bp, Artificial Sequence
  Description of Artificial Sequence: Synthetic oligonucleotide
acctatggcatgcac

SEQ ID NO: 5566 - protein, 5 aa, Artificial Sequence
  Description of Artificial Sequence: Synthetic peptide
TYGMH

SEQ ID NO: 5567 - DNA, 15 bp, Artificial Sequence
  Description of Artificial Sequence: Synthetic oligonucleotide
agctatggcatgcac

SEQ ID NO: 5568 - protein, 5 aa, Artificial Sequence
  Description of Artificial Sequence: Synthetic peptide
SYGMH

SEQ ID NO: 5569 - DNA, 15 bp, Artificial Sequence
  Description of Artificial Sequence: Synthetic oligonucleotide
agctataacatgaac

SEQ ID NO: 5570 - protein, 5 aa, Artificial Sequence
  Description of Artificial Sequence: Synthetic peptide
SYNMN

SEQ ID NO: 5571 - DNA, 15 bp, Artificial Sequence
  Description of Artificial Sequence: Synthetic oligonucleotide
ggctactatatgcac

SEQ ID NO: 5572 - protein, 5 aa, Artificial Sequence
  Description of Artificial Sequence: Synthetic peptide
GYYMH

SEQ ID NO: 5573 - DNA, 15 bp, Artificial Sequence
  Description of Artificial Sequence: Synthetic oligonucleotide
agctatggcatgcac

SEQ ID NO: 5574 - protein, 5 aa, Artificial Sequence
  Description of Artificial Sequence: Synthetic peptide
SYGMH

SEQ ID NO: 5575 - DNA, 15 bp, Artificial Sequence
  Description of Artificial Sequence: Synthetic oligonucleotide
agctatggcatgcac

SEQ ID NO: 5576 - protein, 5 aa, Artificial Sequence
  Description of Artificial Sequence: Synthetic peptide
SYGMH

SEQ ID NO: 5577 - DNA, 15 bp, Artificial Sequence
  Description of Artificial Sequence: Synthetic oligonucleotide
gattatgtcatgcac

SEQ ID NO: 5578 - protein, 5 aa, Artificial Sequence
  Description of Artificial Sequence: Synthetic peptide
DYVMH

SEQ ID NO: 5579 - DNA, 15 bp, Artificial Sequence
  Description of Artificial Sequence: Synthetic oligonucleotide
agttacttctggagc

SEQ ID NO: 5580 - protein, 5 aa, Artificial Sequence
  Description of Artificial Sequence: Synthetic peptide
SYFWS

SEQ ID NO: 5581 - DNA, 15 bp, Artificial Sequence
  Description of Artificial Sequence: Synthetic oligonucleotide
gactatgtcatgcac

SEQ ID NO: 5582 - protein, 5 aa, Artificial Sequence
  Description of Artificial Sequence: Synthetic peptide
DYVMH

SEQ ID NO: 5583 - DNA, 15 bp, Artificial Sequence
  Description of Artificial Sequence: Synthetic oligonucleotide
acctatggcatgcac

SEQ ID NO: 5584 - protein, 5 aa, Artificial Sequence
  Description of Artificial Sequence: Synthetic peptide
TYGMH

SEQ ID NO: 5585 - DNA, 15 bp, Artificial Sequence
  Description of Artificial Sequence: Synthetic oligonucleotide
ggctactatatgcac

SEQ ID NO: 5586 - protein, 5 aa, Artificial Sequence
  Description of Artificial Sequence: Synthetic peptide
GYYMH

SEQ ID NO: 5587 - DNA, 15 bp, Artificial Sequence
  Description of Artificial Sequence: Synthetic oligonucleotide
agctatggcatgcac

SEQ ID NO: 5588 - protein, 5 aa, Artificial Sequence
  Description of Artificial Sequence: Synthetic peptide
SYGMH

SEQ ID NO: 5589 - DNA, 21 bp, Artificial Sequence
  Description of Artificial Sequence: Synthetic oligonucleotide
agaagtagttactactggggc

SEQ ID NO: 5590 - protein, 7 aa, Artificial Sequence
  Description of Artificial Sequence: Synthetic peptide
RSSYYWG

SEQ ID NO: 5591 - DNA, 15 bp, Artificial Sequence
  Description of Artificial Sequence: Synthetic oligonucleotide
agtaatgccatgagc

SEQ ID NO: 5592 - protein, 5 aa, Artificial Sequence
  Description of Artificial Sequence: Synthetic peptide
SNAMS

SEQ ID NO: 5593 - DNA, 15 bp, Artificial Sequence
  Description of Artificial Sequence: Synthetic oligonucleotide
gactatggcatgcac

SEQ ID NO: 5594 - protein, 5 aa, Artificial Sequence
  Description of Artificial Sequence: Synthetic peptide
DYGMH

SEQ ID NO: 5595 - DNA, 15 bp, Artificial Sequence
  Description of Artificial Sequence: Synthetic oligonucleotide
ggctactatatacac

SEQ ID NO: 5596 - protein, 5 aa, Artificial Sequence
  Description of Artificial Sequence: Synthetic peptide
GYYIH

SEQ ID NO: 5597 - DNA, 15 bp, Artificial Sequence
  Description of Artificial Sequence: Synthetic oligonucleotide
agctatggtatcagt

SEQ ID NO: 5598 - protein, 5 aa, Artificial Sequence
  Description of Artificial Sequence: Synthetic peptide
SYGIS

SEQ ID NO: 5599 - DNA, 15 bp, Artificial Sequence
  Description of Artificial Sequence: Synthetic oligonucleotide
aactatggcatgcac

SEQ ID NO: 5600 - protein, 5 aa, Artificial Sequence
  Description of Artificial Sequence: Synthetic peptide
NYGMH

SEQ ID NO: 5601 - DNA, 15 bp, Artificial Sequence
  Description of Artificial Sequence: Synthetic oligonucleotide
agctataggatgaac

SEQ ID NO: 5602 - protein, 5 aa, Artificial Sequence
  Description of Artificial Sequence: Synthetic peptide
SYRMN

SEQ ID NO: 5603 - DNA, 15 bp, Artificial Sequence
  Description of Artificial Sequence: Synthetic oligonucleotide
ggctactatatgcac

SEQ ID NO: 5604 - protein, 5 aa, Artificial Sequence
  Description of Artificial Sequence: Synthetic peptide
GYYMH

SEQ ID NO: 5605 - DNA, 15 bp, Artificial Sequence
  Description of Artificial Sequence: Synthetic oligonucleotide
ggctactatatgcac

SEQ ID NO: 5606 - protein, 5 aa, Artificial Sequence
  Description of Artificial Sequence: Synthetic peptide
GYYMH

SEQ ID NO: 5607 - DNA, 15 bp, Artificial Sequence
  Description of Artificial Sequence: Synthetic oligonucleotide
gactatggcatgcac

SEQ ID NO: 5608 - protein, 5 aa, Artificial Sequence
  Description of Artificial Sequence: Synthetic peptide
DYGMH

SEQ ID NO: 5609 - DNA, 15 bp, Artificial Sequence
  Description of Artificial Sequence: Synthetic oligonucleotide
agctatggcatgcac

SEQ ID NO: 5610 - protein, 5 aa, Artificial Sequence
  Description of Artificial Sequence: Synthetic peptide
SYGMH

SEQ ID NO: 5611 - DNA, 15 bp, Artificial Sequence
  Description of Artificial Sequence: Synthetic oligonucleotide
agctatagcatgaac

SEQ ID NO: 5612 - protein, 5 aa, Artificial Sequence
  Description of Artificial Sequence: Synthetic peptide
SYSMN

SEQ ID NO: 5613 - DNA, 15 bp, Artificial Sequence
  Description of Artificial Sequence: Synthetic oligonucleotide
agctatgttatgagc

SEQ ID NO: 5614 - protein, 5 aa, Artificial Sequence
  Description of Artificial Sequence: Synthetic peptide
SYVMS

SEQ ID NO: 5615 - DNA, 15 bp, Artificial Sequence
  Description of Artificial Sequence: Synthetic oligonucleotide
agttatggcatgcac

SEQ ID NO: 5616 - protein, 5 aa, Artificial Sequence
  Description of Artificial Sequence: Synthetic peptide
SYGMH

SEQ ID NO: 5617 - DNA, 15 bp, Artificial Sequence
  Description of Artificial Sequence: Synthetic oligonucleotide
ggctaccatatgcac

SEQ ID NO: 5618 - protein, 5 aa, Artificial Sequence
  Description of Artificial Sequence: Synthetic peptide
GYHMH

SEQ ID NO: 5619 - DNA, 15 bp, Artificial Sequence
  Description of Artificial Sequence: Synthetic oligonucleotide
agttatggcatgcac

SEQ ID NO: 5620 - protein, 5 aa, Artificial Sequence
  Description of Artificial Sequence: Synthetic peptide
SYGMH

SEQ ID NO: 5621 - DNA, 15 bp, Artificial Sequence
  Description of Artificial Sequence: Synthetic oligonucleotide
ggctactatatgcac

SEQ ID NO: 5622 - protein, 5 aa, Artificial Sequence
  Description of Artificial Sequence: Synthetic peptide
GYYMH

SEQ ID NO: 5623 - DNA, 15 bp, Artificial Sequence
  Description of Artificial Sequence: Synthetic oligonucleotide
aactatggcatgcac

SEQ ID NO: 5624 - protein, 5 aa, Artificial Sequence
  Description of Artificial Sequence: Synthetic peptide
NYGMH

SEQ ID NO: 5625 - DNA, 15 bp, Artificial Sequence
  Description of Artificial Sequence: Synthetic oligonucleotide
agctttggcatgaac

SEQ ID NO: 5626 - protein, 5 aa, Artificial Sequence
  Description of Artificial Sequence: Synthetic peptide
SFGMN

SEQ ID NO: 5627 - DNA, 15 bp, Artificial Sequence
  Description of Artificial Sequence: Synthetic oligonucleotide
agctatagcatgaac

SEQ ID NO: 5628 - protein, 5 aa, Artificial Sequence
  Description of Artificial Sequence: Synthetic peptide
SYSMN

SEQ ID NO: 5629 - DNA, 15 bp, Artificial Sequence
  Description of Artificial Sequence: Synthetic oligonucleotide
gactatggcatgcac

SEQ ID NO: 5630 - protein, 5 aa, Artificial Sequence
  Description of Artificial Sequence: Synthetic peptide
DYGMH

SEQ ID NO: 5631 - DNA, 21 bp, Artificial Sequence
  Description of Artificial Sequence: Synthetic oligonucleotide
agaagtagttactactggggc

SEQ ID NO: 5632 - protein, 7 aa, Artificial Sequence
  Description of Artificial Sequence: Synthetic peptide
RSSYYWG

SEQ ID NO: 5633 - DNA, 15 bp, Artificial Sequence
  Description of Artificial Sequence: Synthetic oligonucleotide
aactatgccatgcac

SEQ ID NO: 5634 - protein, 5 aa, Artificial Sequence
  Description of Artificial Sequence: Synthetic peptide
NYAMH

SEQ ID NO: 5635 - DNA, 15 bp, Artificial Sequence
  Description of Artificial Sequence: Synthetic oligonucleotide
ggctaccatatgcac

SEQ ID NO: 5636 - protein, 5 aa, Artificial Sequence
  Description of Artificial Sequence: Synthetic peptide
GYHMH

SEQ ID NO: 5637 - DNA, 15 bp, Artificial Sequence
  Description of Artificial Sequence: Synthetic oligonucleotide
agctatggcatgcac

SEQ ID NO: 5638 - protein, 5 aa, Artificial Sequence
  Description of Artificial Sequence: Synthetic peptide
SYGMH

SEQ ID NO: 5639 - DNA, 15 bp, Artificial Sequence
  Description of Artificial Sequence: Synthetic oligonucleotide
ggctactatatgcac

SEQ ID NO: 5640 - protein, 5 aa, Artificial Sequence
  Description of Artificial Sequence: Synthetic peptide
GYYMH

SEQ ID NO: 5641 - DNA, 15 bp, Artificial Sequence
  Description of Artificial Sequence: Synthetic oligonucleotide
agttatggcatgcac

SEQ ID NO: 5642 - protein, 5 aa, Artificial Sequence
  Description of Artificial Sequence: Synthetic peptide
SYGMH

SEQ ID NO: 5643 - DNA, 15 bp, Artificial Sequence
  Description of Artificial Sequence: Synthetic oligonucleotide
aattatgatatcaac

SEQ ID NO: 5644 - protein, 5 aa, Artificial Sequence
  Description of Artificial Sequence: Synthetic peptide
NYDIN

SEQ ID NO: 5645 - DNA, 15 bp, Artificial Sequence
  Description of Artificial Sequence: Synthetic oligonucleotide
agctatggcatgctc

SEQ ID NO: 5646 - protein, 5 aa, Artificial Sequence
  Description of Artificial Sequence: Synthetic peptide
SYGML

SEQ ID NO: 5647 - DNA, 15 bp, Artificial Sequence
  Description of Artificial Sequence: Synthetic oligonucleotide
ggctactatatgcac

SEQ ID NO: 5648 - protein, 5 aa, Artificial Sequence
  Description of Artificial Sequence: Synthetic peptide
GYYMH

SEQ ID NO: 5649 - DNA, 15 bp, Artificial Sequence
  Description of Artificial Sequence: Synthetic oligonucleotide
ggctactatatgcac

SEQ ID NO: 5650 - protein, 5 aa, Artificial Sequence
  Description of Artificial Sequence: Synthetic peptide
GYYMH

SEQ ID NO: 5651 - DNA, 15 bp, Artificial Sequence
  Description of Artificial Sequence: Synthetic oligonucleotide
agctatagcatgaac

SEQ ID NO: 5652 - protein, 5 aa, Artificial Sequence
  Description of Artificial Sequence: Synthetic peptide
SYSMN

SEQ ID NO: 5653 - DNA, 15 bp, Artificial Sequence
  Description of Artificial Sequence: Synthetic oligonucleotide
gactatggcatgcac

SEQ ID NO: 5654 - protein, 5 aa, Artificial Sequence
  Description of Artificial Sequence: Synthetic peptide
DYGMH

SEQ ID NO: 5655 - DNA, 15 bp, Artificial Sequence
  Description of Artificial Sequence: Synthetic oligonucleotide
aattatgatatcaac

SEQ ID NO: 5656 - protein, 5 aa, Artificial Sequence
  Description of Artificial Sequence: Synthetic peptide
NYDIN

SEQ ID NO: 5657 - DNA, 15 bp, Artificial Sequence
  Description of Artificial Sequence: Synthetic oligonucleotide
aactatggcatgcac

SEQ ID NO: 5658 - protein, 5 aa, Artificial Sequence
  Description of Artificial Sequence: Synthetic peptide
NYGMH

SEQ ID NO: 5659 - DNA, 15 bp, Artificial Sequence
  Description of Artificial Sequence: Synthetic oligonucleotide
agctatagcatgaac

SEQ ID NO: 5660 - protein, 5 aa, Artificial Sequence
  Description of Artificial Sequence: Synthetic peptide
SYSMN

SEQ ID NO: 5661 - DNA, 15 bp, Artificial Sequence
  Description of Artificial Sequence: Synthetic oligonucleotide
ggctactatatgcac

SEQ ID NO: 5662 - protein, 5 aa, Artificial Sequence
  Description of Artificial Sequence: Synthetic peptide
GYYMH

SEQ ID NO: 5663 - DNA, 15 bp, Artificial Sequence
  Description of Artificial Sequence: Synthetic oligonucleotide
gactatggcatgcac

SEQ ID NO: 5664 - protein, 5 aa, Artificial Sequence
  Description of Artificial Sequence: Synthetic peptide
DYGMH

SEQ ID NO: 5665 - DNA, 15 bp, Artificial Sequence
  Description of Artificial Sequence: Synthetic oligonucleotide
agctatgccatgatc

SEQ ID NO: 5666 - protein, 5 aa, Artificial Sequence
  Description of Artificial Sequence: Synthetic peptide
SYAMI

SEQ ID NO: 5667 - DNA, 15 bp, Artificial Sequence
  Description of Artificial Sequence: Synthetic oligonucleotide
agctatggcatgcac

SEQ ID NO: 5668 - protein, 5 aa, Artificial Sequence
  Description of Artificial Sequence: Synthetic peptide
SYGMH

SEQ ID NO: 5669 - DNA, 15 bp, Artificial Sequence
  Description of Artificial Sequence: Synthetic oligonucleotide
ggctactatatgcac

SEQ ID NO: 5670 - protein, 5 aa, Artificial Sequence
  Description of Artificial Sequence: Synthetic peptide
GYYMH

SEQ ID NO: 5671 - DNA, 15 bp, Artificial Sequence
  Description of Artificial Sequence: Synthetic oligonucleotide
ggctactatatgcac

SEQ ID NO: 5672 - protein, 5 aa, Artificial Sequence
  Description of Artificial Sequence: Synthetic peptide
GYYMH

SEQ ID NO: 5673 - DNA, 15 bp, Artificial Sequence
  Description of Artificial Sequence: Synthetic oligonucleotide
tactatggcatgcac

SEQ ID NO: 5674 - protein, 5 aa, Artificial Sequence
  Description of Artificial Sequence: Synthetic peptide
YYGMH

SEQ ID NO: 5675 - DNA, 15 bp, Artificial Sequence
  Description of Artificial Sequence: Synthetic oligonucleotide
agcaatgccatgagc

SEQ ID NO: 5676 - protein, 5 aa, Artificial Sequence
  Description of Artificial Sequence: Synthetic peptide
SNAMS

SEQ ID NO: 5677 - DNA, 15 bp, Artificial Sequence
  Description of Artificial Sequence: Synthetic oligonucleotide
aattatgtcatgcac

SEQ ID NO: 5678 - protein, 5 aa, Artificial Sequence
  Description of Artificial Sequence: Synthetic peptide
NYVMH

SEQ ID NO: 5679 - DNA, 15 bp, Artificial Sequence
  Description of Artificial Sequence: Synthetic oligonucleotide
ggttcctactggagc

SEQ ID NO: 5680 - protein, 5 aa, Artificial Sequence
  Description of Artificial Sequence: Synthetic peptide
GSYWS

SEQ ID NO: 5681 - DNA, 15 bp, Artificial Sequence
  Description of Artificial Sequence: Synthetic oligonucleotide
ggttgctactggagc

SEQ ID NO: 5682 - protein, 5 aa, Artificial Sequence
  Description of Artificial Sequence: Synthetic peptide
GCYWS

SEQ ID NO: 5683 - DNA, 15 bp, Artificial Sequence
  Description of Artificial Sequence: Synthetic oligonucleotide
aattatgatatcaac

SEQ ID NO: 5684 - protein, 5 aa, Artificial Sequence
  Description of Artificial Sequence: Synthetic peptide
NYDIN

SEQ ID NO: 5685 - DNA, 15 bp, Artificial Sequence
  Description of Artificial Sequence: Synthetic oligonucleotide
aattatgatatcaac

SEQ ID NO: 5686 - protein, 5 aa, Artificial Sequence
  Description of Artificial Sequence: Synthetic peptide
NYDIN

SEQ ID NO: 5687 - DNA, 15 bp, Artificial Sequence
  Description of Artificial Sequence: Synthetic oligonucleotide
aattatgatatcaac

SEQ ID NO: 5688 - protein, 5 aa, Artificial Sequence
  Description of Artificial Sequence: Synthetic peptide
NYDIN

SEQ ID NO: 5689 - DNA, 15 bp, Artificial Sequence
  Description of Artificial Sequence: Synthetic oligonucleotide
aattatgatatcaac

SEQ ID NO: 5690 - protein, 5 aa, Artificial Sequence
  Description of Artificial Sequence: Synthetic peptide
NYDIN

SEQ ID NO: 5691 - DNA, 15 bp, Artificial Sequence
  Description of Artificial Sequence: Synthetic oligonucleotide
aattatgatatcaac

SEQ ID NO: 5692 - protein, 5 aa, Artificial Sequence
  Description of Artificial Sequence: Synthetic peptide
NYDIN

SEQ ID NO: 5693 - DNA, 15 bp, Artificial Sequence
  Description of Artificial Sequence: Synthetic oligonucleotide
agctatggcatgcac

SEQ ID NO: 5694 - protein, 5 aa, Artificial Sequence
  Description of Artificial Sequence: Synthetic peptide
SYGMH

SEQ ID NO: 5695 - DNA, 15 bp, Artificial Sequence
  Description of Artificial Sequence: Synthetic oligonucleotide
aattatgatatcaac

SEQ ID NO: 5696 - protein, 5 aa, Artificial Sequence
  Description of Artificial Sequence: Synthetic peptide
NYDIN

SEQ ID NO: 5697 - DNA, 21 bp, Artificial Sequence
  Description of Artificial Sequence: Synthetic oligonucleotide
agtagtaattactactggggc

SEQ ID NO: 5698 - protein, 7 aa, Artificial Sequence
  Description of Artificial Sequence: Synthetic peptide
SSNYYWG

SEQ ID NO: 5699 - DNA, 15 bp, Artificial Sequence
  Description of Artificial Sequence: Synthetic oligonucleotide
aattatgatatcaac

SEQ ID NO: 5700 - protein, 5 aa, Artificial Sequence
  Description of Artificial Sequence: Synthetic peptide
NYDIN

SEQ ID NO: 5701 - DNA, 15 bp, Artificial Sequence
  Description of Artificial Sequence: Synthetic oligonucleotide
ggtccctactggagc

SEQ ID NO: 5702 - protein, 5 aa, Artificial Sequence
  Description of Artificial Sequence: Synthetic peptide
GPYWS

SEQ ID NO: 5703 - DNA, 15 bp, Artificial Sequence
  Description of Artificial Sequence: Synthetic oligonucleotide
ggttgctactggagc

SEQ ID NO: 5704 - protein, 5 aa, Artificial Sequence
  Description of Artificial Sequence: Synthetic peptide
GCYWS

SEQ ID NO: 5705 - DNA, 15 bp, Artificial Sequence
  Description of Artificial Sequence: Synthetic oligonucleotide
ggttgctactggagc

SEQ ID NO: 5706 - protein, 5 aa, Artificial Sequence
  Description of Artificial Sequence: Synthetic peptide
GCYWS

SEQ ID NO: 5707 - DNA, 21 bp, Artificial Sequence
  Description of Artificial Sequence: Synthetic oligonucleotide
agaagtagttactactggggc

SEQ ID NO: 5708 - protein, 7 aa, Artificial Sequence
  Description of Artificial Sequence: Synthetic peptide
RSSYYWG

SEQ ID NO: 5709 - DNA, 15 bp, Artificial Sequence
  Description of Artificial Sequence: Synthetic oligonucleotide
ggttgctactggagc

SEQ ID NO: 5710 - protein, 5 aa, Artificial Sequence
  Description of Artificial Sequence: Synthetic peptide
GCYWS

SEQ ID NO: 5711 - DNA, 15 bp, Artificial Sequence
  Description of Artificial Sequence: Synthetic oligonucleotide
aattatgatatcaac

SEQ ID NO: 5712 - protein, 5 aa, Artificial Sequence
  Description of Artificial Sequence: Synthetic peptide
NYDIN

SEQ ID NO: 5713 - DNA, 15 bp, Artificial Sequence
  Description of Artificial Sequence: Synthetic oligonucleotide
aattatgatatcaac

SEQ ID NO: 5714 - protein, 5 aa, Artificial Sequence
  Description of Artificial Sequence: Synthetic peptide
NYDIN

SEQ ID NO: 5715 - DNA, 15 bp, Artificial Sequence
  Description of Artificial Sequence: Synthetic oligonucleotide
aattatgatatcaac

SEQ ID NO: 5716 - protein, 5 aa, Artificial Sequence
  Description of Artificial Sequence: Synthetic peptide
NYDIN

SEQ ID NO: 5717 - DNA, 15 bp, Artificial Sequence
  Description of Artificial Sequence: Synthetic oligonucleotide
aattatgatatcaac

SEQ ID NO: 5718 - protein, 5 aa, Artificial Sequence
  Description of Artificial Sequence: Synthetic peptide
NYDIN

SEQ ID NO: 5719 - DNA, 15 bp, Artificial Sequence
  Description of Artificial Sequence: Synthetic oligonucleotide
ggttgctactggagc

SEQ ID NO: 5720 - protein, 5 aa, Artificial Sequence
  Description of Artificial Sequence: Synthetic peptide
GCYWS

SEQ ID NO: 5721 - DNA, 15 bp, Artificial Sequence
  Description of Artificial Sequence: Synthetic oligonucleotide
ggttcctactggagc

SEQ ID NO: 5722 - protein, 5 aa, Artificial Sequence
  Description of Artificial Sequence: Synthetic peptide
GSYWS

SEQ ID NO: 5723 - DNA, 15 bp, Artificial Sequence
  Description of Artificial Sequence: Synthetic oligonucleotide
ggttgctactggagc

SEQ ID NO: 5724 - protein, 5 aa, Artificial Sequence
  Description of Artificial Sequence: Synthetic peptide
GCYWS

SEQ ID NO: 5725 - DNA, 15 bp, Artificial Sequence
  Description of Artificial Sequence: Synthetic oligonucleotide
aattatgatatcaac

SEQ ID NO: 5726 - protein, 5 aa, Artificial Sequence
  Description of Artificial Sequence: Synthetic peptide
NYDIN

SEQ ID NO: 5727 - DNA, 15 bp, Artificial Sequence
  Description of Artificial Sequence: Synthetic oligonucleotide
aattatgatatcaac

SEQ ID NO: 5728 - protein, 5 aa, Artificial Sequence
  Description of Artificial Sequence: Synthetic peptide
NYDIN

SEQ ID NO: 5729 - DNA, 15 bp, Artificial Sequence
  Description of Artificial Sequence: Synthetic oligonucleotide
aacgcctggatgaac

SEQ ID NO: 5730 - protein, 5 aa, Artificial Sequence
  Description of Artificial Sequence: Synthetic peptide
NAWMN

SEQ ID NO: 5731 - DNA, 15 bp, Artificial Sequence
  Description of Artificial Sequence: Synthetic oligonucleotide
ggtccctactggagc

SEQ ID NO: 5732 - protein, 5 aa, Artificial Sequence
  Description of Artificial Sequence: Synthetic peptide
GPYWS

SEQ ID NO: 5733 - DNA, 15 bp, Artificial Sequence
  Description of Artificial Sequence: Synthetic oligonucleotide
agctatggcatgcac

SEQ ID NO: 5734 - protein, 5 aa, Artificial Sequence
  Description of Artificial Sequence: Synthetic peptide
SYGMH

SEQ ID NO: 5735 - DNA, 15 bp, Artificial Sequence
  Description of Artificial Sequence: Synthetic oligonucleotide
agctatggcatgcac

SEQ ID NO: 5736 - protein, 5 aa, Artificial Sequence
  Description of Artificial Sequence: Synthetic peptide
SYGMH

SEQ ID NO: 5737 - DNA, 15 bp, Artificial Sequence
  Description of Artificial Sequence: Synthetic oligonucleotide
gattactactggagc

SEQ ID NO: 5738 - protein, 5 aa, Artificial Sequence
  Description of Artificial Sequence: Synthetic peptide
DYYWS

SEQ ID NO: 5739 - DNA, 15 bp, Artificial Sequence
  Description of Artificial Sequence: Synthetic oligonucleotide
ggttgctactggagc

SEQ ID NO: 5740 - protein, 5 aa, Artificial Sequence
  Description of Artificial Sequence: Synthetic peptide
GCYWS

SEQ ID NO: 5741 - DNA, 15 bp, Artificial Sequence
  Description of Artificial Sequence: Synthetic oligonucleotide
aattatgatatcaac

SEQ ID NO: 5742 - protein, 5 aa, Artificial Sequence
  Description of Artificial Sequence: Synthetic peptide
NYDIN

SEQ ID NO: 5743 - DNA, 15 bp, Artificial Sequence
  Description of Artificial Sequence: Synthetic oligonucleotide
aattatgatatcaac

SEQ ID NO: 5744 - protein, 5 aa, Artificial Sequence
  Description of Artificial Sequence: Synthetic peptide
NYDIN

SEQ ID NO: 5745 - DNA, 15 bp, Artificial Sequence
  Description of Artificial Sequence: Synthetic oligonucleotide
ggttgctactggagc

SEQ ID NO: 5746 - protein, 5 aa, Artificial Sequence
  Description of Artificial Sequence: Synthetic peptide
GCYWS

SEQ ID NO: 5747 - DNA, 15 bp, Artificial Sequence
  Description of Artificial Sequence: Synthetic oligonucleotide
ggttgctactggagc

SEQ ID NO: 5748 - protein, 5 aa, Artificial Sequence
  Description of Artificial Sequence: Synthetic peptide
GCYWS

SEQ ID NO: 5749 - DNA, 15 bp, Artificial Sequence
  Description of Artificial Sequence: Synthetic oligonucleotide
aactacgacatgcac

SEQ ID NO: 5750 - protein, 5 aa, Artificial Sequence
  Description of Artificial Sequence: Synthetic peptide
NYDMH

SEQ ID NO: 5751 - DNA, 15 bp, Artificial Sequence
  Description of Artificial Sequence: Synthetic oligonucleotide
ggttactactggagc

SEQ ID NO: 5752 - protein, 5 aa, Artificial Sequence
  Description of Artificial Sequence: Synthetic peptide
GYYWS

SEQ ID NO: 5753 - DNA, 15 bp, Artificial Sequence
  Description of Artificial Sequence: Synthetic oligonucleotide
aattatggcatgcac

SEQ ID NO: 5754 - protein, 5 aa, Artificial Sequence
  Description of Artificial Sequence: Synthetic peptide
NYGMH

SEQ ID NO: 5755 - DNA, 15 bp, Artificial Sequence
  Description of Artificial Sequence: Synthetic oligonucleotide
ggttgctactggagc

SEQ ID NO: 5756 - protein, 5 aa, Artificial Sequence
  Description of Artificial Sequence: Synthetic peptide
GCYWS

SEQ ID NO: 5757 - DNA, 15 bp, Artificial Sequence
  Description of Artificial Sequence: Synthetic oligonucleotide
agctatggcatgcac

SEQ ID NO: 5758 - protein, 5 aa, Artificial Sequence
  Description of Artificial Sequence: Synthetic peptide
SYGMH

SEQ ID NO: 5759 - DNA, 15 bp, Artificial Sequence
  Description of Artificial Sequence: Synthetic oligonucleotide
aattatgatatcaac

SEQ ID NO: 5760 - protein, 5 aa, Artificial Sequence
  Description of Artificial Sequence: Synthetic peptide
NYDIN

SEQ ID NO: 5761 - DNA, 15 bp, Artificial Sequence
  Description of Artificial Sequence: Synthetic oligonucleotide
ggttgctactggagc

SEQ ID NO: 5762 - protein, 5 aa, Artificial Sequence
  Description of Artificial Sequence: Synthetic peptide
GCYWS

SEQ ID NO: 5763 - DNA, 15 bp, Artificial Sequence
  Description of Artificial Sequence: Synthetic oligonucleotide
ggttgctactggagc

SEQ ID NO: 5764 - protein, 5 aa, Artificial Sequence
  Description of Artificial Sequence: Synthetic peptide
GCYWS

SEQ ID NO: 5765 - DNA, 15 bp, Artificial Sequence
  Description of Artificial Sequence: Synthetic oligonucleotide
aattatgatatcaac

SEQ ID NO: 5766 - protein, 5 aa, Artificial Sequence
  Description of Artificial Sequence: Synthetic peptide
NYDIN

SEQ ID NO: 5767 - DNA, 15 bp, Artificial Sequence
  Description of Artificial Sequence: Synthetic oligonucleotide
ggttgctactggagc

SEQ ID NO: 5768 - protein, 5 aa, Artificial Sequence
  Description of Artificial Sequence: Synthetic peptide
GCYWS

SEQ ID NO: 5769 - DNA, 15 bp, Artificial Sequence
  Description of Artificial Sequence: Synthetic oligonucleotide
aattatgatatcaac

SEQ ID NO: 5770 - protein, 5 aa, Artificial Sequence
  Description of Artificial Sequence: Synthetic peptide
NYDIN

SEQ ID NO: 5771 - DNA, 15 bp, Artificial Sequence
  Description of Artificial Sequence: Synthetic oligonucleotide
ggttgctactggagc

SEQ ID NO: 5772 - protein, 5 aa, Artificial Sequence
  Description of Artificial Sequence: Synthetic peptide
GCYWS

SEQ ID NO: 5773 - DNA, 15 bp, Artificial Sequence
  Description of Artificial Sequence: Synthetic oligonucleotide
aattatgatatcaac

SEQ ID NO: 5774 - protein, 5 aa, Artificial Sequence
  Description of Artificial Sequence: Synthetic peptide
NYDIN

SEQ ID NO: 5775 - DNA, 15 bp, Artificial Sequence
  Description of Artificial Sequence: Synthetic oligonucleotide
aattatgatatcaac

SEQ ID NO: 5776 - protein, 5 aa, Artificial Sequence
  Description of Artificial Sequence: Synthetic peptide
NYDIN

SEQ ID NO: 5777 - DNA, 15 bp, Artificial Sequence
  Description of Artificial Sequence: Synthetic oligonucleotide
ggttcctactggagc

SEQ ID NO: 5778 - protein, 5 aa, Artificial Sequence
  Description of Artificial Sequence: Synthetic peptide
GSYWS

SEQ ID NO: 5779 - DNA, 15 bp, Artificial Sequence
  Description of Artificial Sequence: Synthetic oligonucleotide
aattatgatatcaac

SEQ ID NO: 5780 - protein, 5 aa, Artificial Sequence
  Description of Artificial Sequence: Synthetic peptide
NYDIN

SEQ ID NO: 5781 - DNA, 15 bp, Artificial Sequence
  Description of Artificial Sequence: Synthetic oligonucleotide
agctatggcatgcac

SEQ ID NO: 5782 - protein, 5 aa, Artificial Sequence
  Description of Artificial Sequence: Synthetic peptide
SYGMH

SEQ ID NO: 5783 - DNA, 15 bp, Artificial Sequence
  Description of Artificial Sequence: Synthetic oligonucleotide
aattatgatatcaac

SEQ ID NO: 5784 - protein, 5 aa, Artificial Sequence
  Description of Artificial Sequence: Synthetic peptide
NYDIN

SEQ ID NO: 5785 - DNA, 15 bp, Artificial Sequence
  Description of Artificial Sequence: Synthetic oligonucleotide
aattatgatatcaac

SEQ ID NO: 5786 - protein, 5 aa, Artificial Sequence
  Description of Artificial Sequence: Synthetic peptide
NYDIN

SEQ ID NO: 5787 - DNA, 15 bp, Artificial Sequence
  Description of Artificial Sequence: Synthetic oligonucleotide
agctatggcatgcac

SEQ ID NO: 5788 - protein, 5 aa, Artificial Sequence
  Description of Artificial Sequence: Synthetic peptide
SYGMH

SEQ ID NO: 5789 - DNA, 15 bp, Artificial Sequence
  Description of Artificial Sequence: Synthetic oligonucleotide
agctttggcatgcac

SEQ ID NO: 5790 - protein, 5 aa, Artificial Sequence
  Description of Artificial Sequence: Synthetic peptide
SFGMH

SEQ ID NO: 5791 - DNA, 15 bp, Artificial Sequence
  Description of Artificial Sequence: Synthetic oligonucleotide
aacgcctggatgaac

SEQ ID NO: 5792 - protein, 5 aa, Artificial Sequence
  Description of Artificial Sequence: Synthetic peptide
NAWMN

SEQ ID NO: 5793 - DNA, 15 bp, Artificial Sequence
  Description of Artificial Sequence: Synthetic oligonucleotide
aattatgatatcaac

SEQ ID NO: 5794 - protein, 5 aa, Artificial Sequence
  Description of Artificial Sequence: Synthetic peptide
NYDIN

SEQ ID NO: 5795 - DNA, 15 bp, Artificial Sequence
  Description of Artificial Sequence: Synthetic oligonucleotide
ggttcctactggagc

SEQ ID NO: 5796 - protein, 5 aa, Artificial Sequence
  Description of Artificial Sequence: Synthetic peptide
GSYWS

SEQ ID NO: 5797 - DNA, 15 bp, Artificial Sequence
  Description of Artificial Sequence: Synthetic oligonucleotide
aattatgatatcaac

SEQ ID NO: 5798 - protein, 5 aa, Artificial Sequence
  Description of Artificial Sequence: Synthetic peptide
NYDIN

SEQ ID NO: 5799 - DNA, 15 bp, Artificial Sequence
  Description of Artificial Sequence: Synthetic oligonucleotide
aattatgatatcaac

SEQ ID NO: 5800 - protein, 5 aa, Artificial Sequence
  Description of Artificial Sequence: Synthetic peptide
NYDIN

SEQ ID NO: 5801 - DNA, 15 bp, Artificial Sequence
  Description of Artificial Sequence: Synthetic oligonucleotide
aattatgatatcaac

SEQ ID NO: 5802 - protein, 5 aa, Artificial Sequence
  Description of Artificial Sequence: Synthetic peptide
NYDIN

SEQ ID NO: 5803 - DNA, 15 bp, Artificial Sequence
  Description of Artificial Sequence: Synthetic oligonucleotide
aattatgatatcaac

SEQ ID NO: 5804 - protein, 5 aa, Artificial Sequence
  Description of Artificial Sequence: Synthetic peptide
NYDIN

SEQ ID NO: 5805 - DNA, 15 bp, Artificial Sequence
  Description of Artificial Sequence: Synthetic oligonucleotide
ggttgctactggagc

SEQ ID NO: 5806 - protein, 5 aa, Artificial Sequence
  Description of Artificial Sequence: Synthetic peptide
GCYWS

SEQ ID NO: 5807 - DNA, 15 bp, Artificial Sequence
  Description of Artificial Sequence: Synthetic oligonucleotide
ggttgctactggagc

SEQ ID NO: 5808 - protein, 5 aa, Artificial Sequence
  Description of Artificial Sequence: Synthetic peptide
GCYWS

SEQ ID NO: 5809 - DNA, 15 bp, Artificial Sequence
  Description of Artificial Sequence: Synthetic oligonucleotide
aattatgatgtcaac

SEQ ID NO: 5810 - protein, 5 aa, Artificial Sequence
  Description of Artificial Sequence: Synthetic peptide
NYDVN

SEQ ID NO: 5811 - DNA, 15 bp, Artificial Sequence
  Description of Artificial Sequence: Synthetic oligonucleotide
aactatggcatgcac

SEQ ID NO: 5812 - protein, 5 aa, Artificial Sequence
  Description of Artificial Sequence: Synthetic peptide
NYGMH

SEQ ID NO: 5813 - DNA, 15 bp, Artificial Sequence
  Description of Artificial Sequence: Synthetic oligonucleotide
aacgcctggatgaac

SEQ ID NO: 5814 - protein, 5 aa, Artificial Sequence
  Description of Artificial Sequence: Synthetic peptide
NAWMN

SEQ ID NO: 5815 - DNA, 15 bp, Artificial Sequence
  Description of Artificial Sequence: Synthetic oligonucleotide
agctatggcatgcac

SEQ ID NO: 5816 - protein, 5 aa, Artificial Sequence
  Description of Artificial Sequence: Synthetic peptide
SYGMH

SEQ ID NO: 5817 - DNA, 15 bp, Artificial Sequence
  Description of Artificial Sequence: Synthetic oligonucleotide
aattatgatatcaac

SEQ ID NO: 5818 - protein, 5 aa, Artificial Sequence
  Description of Artificial Sequence: Synthetic peptide
NYDIN

SEQ ID NO: 5819 - DNA, 15 bp, Artificial Sequence
  Description of Artificial Sequence: Synthetic oligonucleotide
aattatgatatcaac

SEQ ID NO: 5820 - protein, 5 aa, Artificial Sequence
  Description of Artificial Sequence: Synthetic peptide
NYDIN

SEQ ID NO: 5821 - DNA, 15 bp, Artificial Sequence
  Description of Artificial Sequence: Synthetic oligonucleotide
aattatgatatcaac

SEQ ID NO: 5822 - protein, 5 aa, Artificial Sequence
  Description of Artificial Sequence: Synthetic peptide
NYDIN

SEQ ID NO: 5823 - DNA, 15 bp, Artificial Sequence
  Description of Artificial Sequence: Synthetic oligonucleotide
ggttgctactggagc

SEQ ID NO: 5824 - protein, 5 aa, Artificial Sequence
  Description of Artificial Sequence: Synthetic peptide
GCYWS

SEQ ID NO: 5825 - DNA, 15 bp, Artificial Sequence
  Description of Artificial Sequence: Synthetic oligonucleotide
aattatgatatcaac

SEQ ID NO: 5826 - protein, 5 aa, Artificial Sequence
  Description of Artificial Sequence: Synthetic peptide
NYDIN

SEQ ID NO: 5827 - DNA, 15 bp, Artificial Sequence
  Description of Artificial Sequence: Synthetic oligonucleotide
ggttcctactggagc

SEQ ID NO: 5828 - protein, 5 aa, Artificial Sequence
  Description of Artificial Sequence: Synthetic peptide
GSYWS

SEQ ID NO: 5829 - DNA, 15 bp, Artificial Sequence
  Description of Artificial Sequence: Synthetic oligonucleotide
ggttgctactggagc

SEQ ID NO: 5830 - protein, 5 aa, Artificial Sequence
  Description of Artificial Sequence: Synthetic peptide
GCYWS

SEQ ID NO: 5831 - DNA, 15 bp, Artificial Sequence
  Description of Artificial Sequence: Synthetic oligonucleotide
aattatgatatcaac

SEQ ID NO: 5832 - protein, 5 aa, Artificial Sequence
  Description of Artificial Sequence: Synthetic peptide
NYDIN

SEQ ID NO: 5833 - DNA, 15 bp, Artificial Sequence
  Description of Artificial Sequence: Synthetic oligonucleotide
ggttgctactggagc

SEQ ID NO: 5834 - protein, 5 aa, Artificial Sequence
  Description of Artificial Sequence: Synthetic peptide
GCYWS

SEQ ID NO: 5835 - DNA, 15 bp, Artificial Sequence
  Description of Artificial Sequence: Synthetic oligonucleotide
ggttgctactggagc

SEQ ID NO: 5836 - protein, 5 aa, Artificial Sequence
  Description of Artificial Sequence: Synthetic peptide
GCYWS

SEQ ID NO: 5837 - DNA, 15 bp, Artificial Sequence
  Description of Artificial Sequence: Synthetic oligonucleotide
ggttgctactggagc

SEQ ID NO: 5838 - protein, 5 aa, Artificial Sequence
  Description of Artificial Sequence: Synthetic peptide
GCYWS

SEQ ID NO: 5839 - DNA, 15 bp, Artificial Sequence
  Description of Artificial Sequence: Synthetic oligonucleotide
aattatgatatcaac

SEQ ID NO: 5840 - protein, 5 aa, Artificial Sequence
  Description of Artificial Sequence: Synthetic peptide
NYDIN

SEQ ID NO: 5841 - DNA, 15 bp, Artificial Sequence
  Description of Artificial Sequence: Synthetic oligonucleotide
aattatgatatcaac

SEQ ID NO: 5842 - protein, 5 aa, Artificial Sequence
  Description of Artificial Sequence: Synthetic peptide
NYDIN

SEQ ID NO: 5843 - DNA, 15 bp, Artificial Sequence
  Description of Artificial Sequence: Synthetic oligonucleotide
ggttgctactggagc

SEQ ID NO: 5844 - protein, 5 aa, Artificial Sequence
  Description of Artificial Sequence: Synthetic peptide
GCYWS

SEQ ID NO: 5845 - DNA, 15 bp, Artificial Sequence
  Description of Artificial Sequence: Synthetic oligonucleotide
aattatgatatcaac

SEQ ID NO: 5846 - protein, 5 aa, Artificial Sequence
  Description of Artificial Sequence: Synthetic peptide
NYDIN

SEQ ID NO: 5847 - DNA, 15 bp, Artificial Sequence
  Description of Artificial Sequence: Synthetic oligonucleotide
ggtccctactggagc

SEQ ID NO: 5848 - protein, 5 aa, Artificial Sequence
  Description of Artificial Sequence: Synthetic peptide
GPYWS

SEQ ID NO: 5849 - DNA, 15 bp, Artificial Sequence
  Description of Artificial Sequence: Synthetic oligonucleotide
ggttgctactggagc

SEQ ID NO: 5850 - protein, 5 aa, Artificial Sequence
  Description of Artificial Sequence: Synthetic peptide
GCYWS

SEQ ID NO: 5851 - DNA, 15 bp, Artificial Sequence
  Description of Artificial Sequence: Synthetic oligonucleotide
ggttcctactggagc

SEQ ID NO: 5852 - protein, 5 aa, Artificial Sequence
  Description of Artificial Sequence: Synthetic peptide
GSYWS

SEQ ID NO: 5853 - DNA, 15 bp, Artificial Sequence
  Description of Artificial Sequence: Synthetic oligonucleotide
aattatgatatcaac

SEQ ID NO: 5854 - protein, 5 aa, Artificial Sequence
  Description of Artificial Sequence: Synthetic peptide
NYDIN

SEQ ID NO: 5855 - DNA, 15 bp, Artificial Sequence
  Description of Artificial Sequence: Synthetic oligonucleotide
aattatgatatcaac

SEQ ID NO: 5856 - protein, 5 aa, Artificial Sequence
  Description of Artificial Sequence: Synthetic peptide
NYDIN

SEQ ID NO: 5857 - DNA, 15 bp, Artificial Sequence
  Description of Artificial Sequence: Synthetic oligonucleotide
ggttgctactggagc

SEQ ID NO: 5858 - protein, 5 aa, Artificial Sequence
  Description of Artificial Sequence: Synthetic peptide
GCYWS

SEQ ID NO: 5859 - DNA, 15 bp, Artificial Sequence
  Description of Artificial Sequence: Synthetic oligonucleotide
agctatggcatgcac

SEQ ID NO: 5860 - protein, 5 aa, Artificial Sequence
  Description of Artificial Sequence: Synthetic peptide
SYGMH

SEQ ID NO: 5861 - DNA, 15 bp, Artificial Sequence
  Description of Artificial Sequence: Synthetic oligonucleotide
agctatggcatgcac

SEQ ID NO: 5862 - protein, 5 aa, Artificial Sequence
  Description of Artificial Sequence: Synthetic peptide
SYGMH

SEQ ID NO: 5863 - DNA, 15 bp, Artificial Sequence
  Description of Artificial Sequence: Synthetic oligonucleotide
ggttgctactggagc

SEQ ID NO: 5864 - protein, 5 aa, Artificial Sequence
  Description of Artificial Sequence: Synthetic peptide
GCYWS

SEQ ID NO: 5865 - DNA, 15 bp, Artificial Sequence
  Description of Artificial Sequence: Synthetic oligonucleotide
aattatgatatcaac

SEQ ID NO: 5866 - protein, 5 aa, Artificial Sequence
  Description of Artificial Sequence: Synthetic peptide
NYDIN

SEQ ID NO: 5867 - DNA, 15 bp, Artificial Sequence
  Description of Artificial Sequence: Synthetic oligonucleotide
ggttgctactggagc

SEQ ID NO: 5868 - protein, 5 aa, Artificial Sequence
  Description of Artificial Sequence: Synthetic peptide
GCYWS

SEQ ID NO: 5869 - DNA, 15 bp, Artificial Sequence
  Description of Artificial Sequence: Synthetic oligonucleotide
ggttgctactggagc

SEQ ID NO: 5870 - protein, 5 aa, Artificial Sequence
  Description of Artificial Sequence: Synthetic peptide
GCYWS

SEQ ID NO: 5871 - DNA, 15 bp, Artificial Sequence
  Description of Artificial Sequence: Synthetic oligonucleotide
aattatgatatcaac

SEQ ID NO: 5872 - protein, 5 aa, Artificial Sequence
  Description of Artificial Sequence: Synthetic peptide
NYDIN

SEQ ID NO: 5873 - DNA, 15 bp, Artificial Sequence
  Description of Artificial Sequence: Synthetic oligonucleotide
aattatgatatcaac

SEQ ID NO: 5874 - protein, 5 aa, Artificial Sequence
  Description of Artificial Sequence: Synthetic peptide
NYDIN

SEQ ID NO: 5875 - DNA, 15 bp, Artificial Sequence
  Description of Artificial Sequence: Synthetic oligonucleotide
ggtccctactggagc

SEQ ID NO: 5876 - protein, 5 aa, Artificial Sequence
  Description of Artificial Sequence: Synthetic peptide
GPYWS

SEQ ID NO: 5877 - DNA, 15 bp, Artificial Sequence
  Description of Artificial Sequence: Synthetic oligonucleotide
ggttgctactggagc

SEQ ID NO: 5878 - protein, 5 aa, Artificial Sequence
  Description of Artificial Sequence: Synthetic peptide
GCYWS

SEQ ID NO: 5879 - DNA, 15 bp, Artificial Sequence
  Description of Artificial Sequence: Synthetic oligonucleotide
aattatgatatcaac

SEQ ID NO: 5880 - protein, 5 aa, Artificial Sequence
  Description of Artificial Sequence: Synthetic peptide
NYDIN

SEQ ID NO: 5881 - DNA, 15 bp, Artificial Sequence
  Description of Artificial Sequence: Synthetic oligonucleotide
aattatgatatcaac

SEQ ID NO: 5882 - protein, 5 aa, Artificial Sequence
  Description of Artificial Sequence: Synthetic peptide
NYDIN

SEQ ID NO: 5883 - DNA, 15 bp, Artificial Sequence
  Description of Artificial Sequence: Synthetic oligonucleotide
aattatgatatcaac

SEQ ID NO: 5884 - protein, 5 aa, Artificial Sequence
  Description of Artificial Sequence: Synthetic peptide
NYDIN

SEQ ID NO: 5885 - DNA, 15 bp, Artificial Sequence
  Description of Artificial Sequence: Synthetic oligonucleotide
ggttgctactggagc

SEQ ID NO: 5886 - protein, 5 aa, Artificial Sequence
  Description of Artificial Sequence: Synthetic peptide
GCYWS

SEQ ID NO: 5887 - DNA, 15 bp, Artificial Sequence
  Description of Artificial Sequence: Synthetic oligonucleotide
aattatgatatcaac

SEQ ID NO: 5888 - protein, 5 aa, Artificial Sequence
  Description of Artificial Sequence: Synthetic peptide
NYDIN

SEQ ID NO: 5889 - DNA, 15 bp, Artificial Sequence
  Description of Artificial Sequence: Synthetic oligonucleotide
agttatgatatcaac

SEQ ID NO: 5890 - protein, 5 aa, Artificial Sequence
  Description of Artificial Sequence: Synthetic peptide
SYDIN

SEQ ID NO: 5891 - DNA, 15 bp, Artificial Sequence
  Description of Artificial Sequence: Synthetic oligonucleotide
ggttgctactggagc

SEQ ID NO: 5892 - protein, 5 aa, Artificial Sequence
  Description of Artificial Sequence: Synthetic peptide
GCYWS

SEQ ID NO: 5893 - DNA, 15 bp, Artificial Sequence
  Description of Artificial Sequence: Synthetic oligonucleotide
aattatgatatcaac

SEQ ID NO: 5894 - protein, 5 aa, Artificial Sequence
  Description of Artificial Sequence: Synthetic peptide
NYDIN

SEQ ID NO: 5895 - DNA, 15 bp, Artificial Sequence
  Description of Artificial Sequence: Synthetic oligonucleotide
aattatgatatcaac

SEQ ID NO: 5896 - protein, 5 aa, Artificial Sequence
  Description of Artificial Sequence: Synthetic peptide
NYDIN

SEQ ID NO: 5897 - DNA, 15 bp, Artificial Sequence
  Description of Artificial Sequence: Synthetic oligonucleotide
aattatgatatcaac

SEQ ID NO: 5898 - protein, 5 aa, Artificial Sequence
  Description of Artificial Sequence: Synthetic peptide
NYDIN

SEQ ID NO: 5899 - DNA, 15 bp, Artificial Sequence
  Description of Artificial Sequence: Synthetic oligonucleotide
aattatgatatcaac

SEQ ID NO: 5900 - protein, 5 aa, Artificial Sequence
  Description of Artificial Sequence: Synthetic peptide
NYDIN

SEQ ID NO: 5901 - DNA, 15 bp, Artificial Sequence
  Description of Artificial Sequence: Synthetic oligonucleotide
ggttgttactggagc

SEQ ID NO: 5902 - protein, 5 aa, Artificial Sequence
  Description of Artificial Sequence: Synthetic peptide
GCYWS

SEQ ID NO: 5903 - DNA, 15 bp, Artificial Sequence
  Description of Artificial Sequence: Synthetic oligonucleotide
ggttgctactggagc

SEQ ID NO: 5904 - protein, 5 aa, Artificial Sequence
  Description of Artificial Sequence: Synthetic peptide
GCYWS

SEQ ID NO: 5905 - DNA, 15 bp, Artificial Sequence
  Description of Artificial Sequence: Synthetic oligonucleotide
aattatgatatcaac

SEQ ID NO: 5906 - protein, 5 aa, Artificial Sequence
  Description of Artificial Sequence: Synthetic peptide
NYDIN

SEQ ID NO: 5907 - DNA, 15 bp, Artificial Sequence
  Description of Artificial Sequence: Synthetic oligonucleotide
ggttactactggagc

SEQ ID NO: 5908 - protein, 5 aa, Artificial Sequence
  Description of Artificial Sequence: Synthetic peptide
GYYWS

SEQ ID NO: 5909 - DNA, 15 bp, Artificial Sequence
  Description of Artificial Sequence: Synthetic oligonucleotide
aattatgatatcaac

SEQ ID NO: 5910 - protein, 5 aa, Artificial Sequence
  Description of Artificial Sequence: Synthetic peptide
NYDIN

SEQ ID NO: 5911 - DNA, 15 bp, Artificial Sequence
  Description of Artificial Sequence: Synthetic oligonucleotide
aattatgatatcaac

SEQ ID NO: 5912 - protein, 5 aa, Artificial Sequence
  Description of Artificial Sequence: Synthetic peptide
NYDIN

SEQ ID NO: 5913 - DNA, 15 bp, Artificial Sequence
  Description of Artificial Sequence: Synthetic oligonucleotide
agctatggcatgcac

SEQ ID NO: 5914 - protein, 5 aa, Artificial Sequence
  Description of Artificial Sequence: Synthetic peptide
SYGMH

SEQ ID NO: 5915 - DNA, 15 bp, Artificial Sequence
  Description of Artificial Sequence: Synthetic oligonucleotide
ggttcctactggagc

SEQ ID NO: 5916 - protein, 5 aa, Artificial Sequence
  Description of Artificial Sequence: Synthetic peptide
GSYWS

SEQ ID NO: 5917 - DNA, 15 bp, Artificial Sequence
  Description of Artificial Sequence: Synthetic oligonucleotide
agctatggcatacac

SEQ ID NO: 5918 - protein, 5 aa, Artificial Sequence
  Description of Artificial Sequence: Synthetic peptide
SYGIH

SEQ ID NO: 5919 - DNA, 15 bp, Artificial Sequence
  Description of Artificial Sequence: Synthetic oligonucleotide
aattatgatatcaac

SEQ ID NO: 5920 - protein, 5 aa, Artificial Sequence
  Description of Artificial Sequence: Synthetic peptide
NYDIN

SEQ ID NO: 5921 - DNA, 15 bp, Artificial Sequence
  Description of Artificial Sequence: Synthetic oligonucleotide
ggttgctactggagc

SEQ ID NO: 5922 - protein, 5 aa, Artificial Sequence
  Description of Artificial Sequence: Synthetic peptide
GCYWS

SEQ ID NO: 5923 - DNA, 15 bp, Artificial Sequence
  Description of Artificial Sequence: Synthetic oligonucleotide
ggttgctactggagc

SEQ ID NO: 5924 - protein, 5 aa, Artificial Sequence
  Description of Artificial Sequence: Synthetic peptide
GCYWS

SEQ ID NO: 5925 - DNA, 15 bp, Artificial Sequence
  Description of Artificial Sequence: Synthetic oligonucleotide
aattatgatatcaac

SEQ ID NO: 5926 - protein, 5 aa, Artificial Sequence
  Description of Artificial Sequence: Synthetic peptide
NYDIN

SEQ ID NO: 5927 - DNA, 15 bp, Artificial Sequence
  Description of Artificial Sequence: Synthetic oligonucleotide
ggttgctactggagc

SEQ ID NO: 5928 - protein, 5 aa, Artificial Sequence
  Description of Artificial Sequence: Synthetic peptide
GCYWS

SEQ ID NO: 5929 - DNA, 15 bp, Artificial Sequence
  Description of Artificial Sequence: Synthetic oligonucleotide
gattgctactggagc

SEQ ID NO: 5930 - protein, 5 aa, Artificial Sequence
  Description of Artificial Sequence: Synthetic peptide
DCYWS

SEQ ID NO: 5931 - DNA, 15 bp, Artificial Sequence
  Description of Artificial Sequence: Synthetic oligonucleotide
ggtccctactggagc

SEQ ID NO: 5932 - protein, 5 aa, Artificial Sequence
  Description of Artificial Sequence: Synthetic peptide
GPYWS

SEQ ID NO: 5933 - DNA, 15 bp, Artificial Sequence
  Description of Artificial Sequence: Synthetic oligonucleotide
ggttgctactggagc

SEQ ID NO: 5934 - protein, 5 aa, Artificial Sequence
  Description of Artificial Sequence: Synthetic peptide
GCYWS

SEQ ID NO: 5935 - DNA, 15 bp, Artificial Sequence
  Description of Artificial Sequence: Synthetic oligonucleotide
aattatgatatcaac

SEQ ID NO: 5936 - protein, 5 aa, Artificial Sequence
  Description of Artificial Sequence: Synthetic peptide
NYDIN

SEQ ID NO: 5937 - DNA, 15 bp, Artificial Sequence
  Description of Artificial Sequence: Synthetic oligonucleotide
ggttgttactggagc

SEQ ID NO: 5938 - protein, 5 aa, Artificial Sequence
  Description of Artificial Sequence: Synthetic peptide
GCYWS

SEQ ID NO: 5939 - DNA, 15 bp, Artificial Sequence
  Description of Artificial Sequence: Synthetic oligonucleotide
aattatgatatcaac

SEQ ID NO: 5940 - protein, 5 aa, Artificial Sequence
  Description of Artificial Sequence: Synthetic peptide
NYDIN

SEQ ID NO: 5941 - DNA, 15 bp, Artificial Sequence
  Description of Artificial Sequence: Synthetic oligonucleotide
aattatgatatcaac

SEQ ID NO: 5942 - protein, 5 aa, Artificial Sequence
  Description of Artificial Sequence: Synthetic peptide
NYDIN

SEQ ID NO: 5943 - DNA, 15 bp, Artificial Sequence
  Description of Artificial Sequence: Synthetic oligonucleotide
ggttgctactggagc

SEQ ID NO: 5944 - protein, 5 aa, Artificial Sequence
  Description of Artificial Sequence: Synthetic peptide
GCYWS

SEQ ID NO: 5945 - DNA, 15 bp, Artificial Sequence
  Description of Artificial Sequence: Synthetic oligonucleotide
ggttgctactggagc

SEQ ID NO: 5946 - protein, 5 aa, Artificial Sequence
  Description of Artificial Sequence: Synthetic peptide
GCYWS

SEQ ID NO: 5947 - DNA, 15 bp, Artificial Sequence
  Description of Artificial Sequence: Synthetic oligonucleotide
aattatgatatcaac

SEQ ID NO: 5948 - protein, 5 aa, Artificial Sequence
  Description of Artificial Sequence: Synthetic peptide
NYDIN

SEQ ID NO: 5949 - DNA, 15 bp, Artificial Sequence
  Description of Artificial Sequence: Synthetic oligonucleotide
ggttgctactggagc

SEQ ID NO: 5950 - protein, 5 aa, Artificial Sequence
  Description of Artificial Sequence: Synthetic peptide
GCYWS

SEQ ID NO: 5951 - DNA, 15 bp, Artificial Sequence
  Description of Artificial Sequence: Synthetic oligonucleotide
ggttactactggagc

SEQ ID NO: 5952 - protein, 5 aa, Artificial Sequence
  Description of Artificial Sequence: Synthetic peptide
GYYWS

SEQ ID NO: 5953 - DNA, 15 bp, Artificial Sequence
  Description of Artificial Sequence: Synthetic oligonucleotide
ggttgctactggagc

SEQ ID NO: 5954 - protein, 5 aa, Artificial Sequence
  Description of Artificial Sequence: Synthetic peptide
GCYWS

SEQ ID NO: 5955 - DNA, 15 bp, Artificial Sequence
  Description of Artificial Sequence: Synthetic oligonucleotide
agctatggcatgcac

SEQ ID NO: 5956 - protein, 5 aa, Artificial Sequence
  Description of Artificial Sequence: Synthetic peptide
SYGMH

SEQ ID NO: 5957 - DNA, 15 bp, Artificial Sequence
  Description of Artificial Sequence: Synthetic oligonucleotide
ggttgctactggagc

SEQ ID NO: 5958 - protein, 5 aa, Artificial Sequence
  Description of Artificial Sequence: Synthetic peptide
GCYWS

SEQ ID NO: 5959 - DNA, 15 bp, Artificial Sequence
  Description of Artificial Sequence: Synthetic oligonucleotide
aattatgatatcaac

SEQ ID NO: 5960 - protein, 5 aa, Artificial Sequence
  Description of Artificial Sequence: Synthetic peptide
NYDIN

SEQ ID NO: 5961 - DNA, 15 bp, Artificial Sequence
  Description of Artificial Sequence: Synthetic oligonucleotide
aattatgatatcaac

SEQ ID NO: 5962 - protein, 5 aa, Artificial Sequence
  Description of Artificial Sequence: Synthetic peptide
NYDIN

SEQ ID NO: 5963 - DNA, 15 bp, Artificial Sequence
  Description of Artificial Sequence: Synthetic oligonucleotide
ggttgctactggagc

SEQ ID NO: 5964 - protein, 5 aa, Artificial Sequence
  Description of Artificial Sequence: Synthetic peptide
GCYWS

SEQ ID NO: 5965 - DNA, 15 bp, Artificial Sequence
  Description of Artificial Sequence: Synthetic oligonucleotide
aattatgatatcaac

SEQ ID NO: 5966 - protein, 5 aa, Artificial Sequence
  Description of Artificial Sequence: Synthetic peptide
NYDIN

SEQ ID NO: 5967 - DNA, 15 bp, Artificial Sequence
  Description of Artificial Sequence: Synthetic oligonucleotide
ggttgctactggagc

SEQ ID NO: 5968 - protein, 5 aa, Artificial Sequence
  Description of Artificial Sequence: Synthetic peptide
GCYWS

SEQ ID NO: 5969 - DNA, 15 bp, Artificial Sequence
  Description of Artificial Sequence: Synthetic oligonucleotide
aattatgatatcaac

SEQ ID NO: 5970 - protein, 5 aa, Artificial Sequence
  Description of Artificial Sequence: Synthetic peptide
NYDIN

SEQ ID NO: 5971 - DNA, 15 bp, Artificial Sequence
  Description of Artificial Sequence: Synthetic oligonucleotide
aattatgatatcaac

SEQ ID NO: 5972 - protein, 5 aa, Artificial Sequence
  Description of Artificial Sequence: Synthetic peptide
NYDIN

SEQ ID NO: 5973 - DNA, 15 bp, Artificial Sequence
  Description of Artificial Sequence: Synthetic oligonucleotide
agttatgatatcaac

SEQ ID NO: 5974 - protein, 5 aa, Artificial Sequence
  Description of Artificial Sequence: Synthetic peptide
SYDIN

SEQ ID NO: 5975 - DNA, 15 bp, Artificial Sequence
  Description of Artificial Sequence: Synthetic oligonucleotide
ggttgctactggagc

SEQ ID NO: 5976 - protein, 5 aa, Artificial Sequence
  Description of Artificial Sequence: Synthetic peptide
GCYWS

SEQ ID NO: 5977 - DNA, 15 bp, Artificial Sequence
  Description of Artificial Sequence: Synthetic oligonucleotide
ggttgctactggagc

SEQ ID NO: 5978 - protein, 5 aa, Artificial Sequence
  Description of Artificial Sequence: Synthetic peptide
GCYWS

SEQ ID NO: 5979 - DNA, 15 bp, Artificial Sequence
  Description of Artificial Sequence: Synthetic oligonucleotide
ggttgctactggagc

SEQ ID NO: 5980 - protein, 5 aa, Artificial Sequence
  Description of Artificial Sequence: Synthetic peptide
GCYWS

SEQ ID NO: 5981 - DNA, 15 bp, Artificial Sequence
  Description of Artificial Sequence: Synthetic oligonucleotide
aattatgatatcaac

SEQ ID NO: 5982 - protein, 5 aa, Artificial Sequence
  Description of Artificial Sequence: Synthetic peptide
NYDIN

SEQ ID NO: 5983 - DNA, 15 bp, Artificial Sequence
  Description of Artificial Sequence: Synthetic oligonucleotide
ggttgctactggagc

SEQ ID NO: 5984 - protein, 5 aa, Artificial Sequence
  Description of Artificial Sequence: Synthetic peptide
GCYWS

SEQ ID NO: 5985 - DNA, 15 bp, Artificial Sequence
  Description of Artificial Sequence: Synthetic oligonucleotide
agctacgacatgcac

SEQ ID NO: 5986 - protein, 5 aa, Artificial Sequence
  Description of Artificial Sequence: Synthetic peptide
SYDMH

SEQ ID NO: 5987 - DNA, 15 bp, Artificial Sequence
  Description of Artificial Sequence: Synthetic oligonucleotide
ggttgctactggagc

SEQ ID NO: 5988 - protein, 5 aa, Artificial Sequence
  Description of Artificial Sequence: Synthetic peptide
GCYWS

SEQ ID NO: 5989 - DNA, 15 bp, Artificial Sequence
  Description of Artificial Sequence: Synthetic oligonucleotide
ggttgctactggagc

SEQ ID NO: 5990 - protein, 5 aa, Artificial Sequence
  Description of Artificial Sequence: Synthetic peptide
GCYWS

SEQ ID NO: 5991 - DNA, 15 bp, Artificial Sequence
  Description of Artificial Sequence: Synthetic oligonucleotide
ggttgctactggagc

SEQ ID NO: 5992 - protein, 5 aa, Artificial Sequence
  Description of Artificial Sequence: Synthetic peptide
GCYWS

SEQ ID NO: 5993 - DNA, 15 bp, Artificial Sequence
  Description of Artificial Sequence: Synthetic oligonucleotide
ggttactactggagc

SEQ ID NO: 5994 - protein, 5 aa, Artificial Sequence
  Description of Artificial Sequence: Synthetic peptide
GYYWS

SEQ ID NO: 5995 - DNA, 15 bp, Artificial Sequence
  Description of Artificial Sequence: Synthetic oligonucleotide
ggttgctactggagc

SEQ ID NO: 5996 - protein, 5 aa, Artificial Sequence
  Description of Artificial Sequence: Synthetic peptide
GCYWS

SEQ ID NO: 5997 - DNA, 15 bp, Artificial Sequence
  Description of Artificial Sequence: Synthetic oligonucleotide
ggttgctactggagc

SEQ ID NO: 5998 - protein, 5 aa, Artificial Sequence
  Description of Artificial Sequence: Synthetic peptide
GCYWS

SEQ ID NO: 5999 - DNA, 15 bp, Artificial Sequence
  Description of Artificial Sequence: Synthetic oligonucleotide
ggttgctactggagc

SEQ ID NO: 6000 - protein, 5 aa, Artificial Sequence
  Description of Artificial Sequence: Synthetic peptide
GCYWS

SEQ ID NO: 6001 - DNA, 15 bp, Artificial Sequence
  Description of Artificial Sequence: Synthetic oligonucleotide
gactatggcatgcac

SEQ ID NO: 6002 - protein, 5 aa, Artificial Sequence
  Description of Artificial Sequence: Synthetic peptide
DYGMH

SEQ ID NO: 6003 - DNA, 15 bp, Artificial Sequence
  Description of Artificial Sequence: Synthetic oligonucleotide
aattatgatatcaac

SEQ ID NO: 6004 - protein, 5 aa, Artificial Sequence
  Description of Artificial Sequence: Synthetic peptide
NYDIN

SEQ ID NO: 6005 - DNA, 15 bp, Artificial Sequence
  Description of Artificial Sequence: Synthetic oligonucleotide
aattatgatatcaac

SEQ ID NO: 6006 - protein, 5 aa, Artificial Sequence
  Description of Artificial Sequence: Synthetic peptide
NYDIN

SEQ ID NO: 6007 - DNA, 15 bp, Artificial Sequence
  Description of Artificial Sequence: Synthetic oligonucleotide
ggttgctactggagc

SEQ ID NO: 6008 - protein, 5 aa, Artificial Sequence
  Description of Artificial Sequence: Synthetic peptide
GCYWS

SEQ ID NO: 6009 - DNA, 15 bp, Artificial Sequence
  Description of Artificial Sequence: Synthetic oligonucleotide
aactacgacatgcac

SEQ ID NO: 6010 - protein, 5 aa, Artificial Sequence
  Description of Artificial Sequence: Synthetic peptide
NYDMH

SEQ ID NO: 6011 - DNA, 15 bp, Artificial Sequence
  Description of Artificial Sequence: Synthetic oligonucleotide
aattatgatatcaac

SEQ ID NO: 6012 - protein, 5 aa, Artificial Sequence
  Description of Artificial Sequence: Synthetic peptide
NYDIN

SEQ ID NO: 6013 - DNA, 15 bp, Artificial Sequence
  Description of Artificial Sequence: Synthetic oligonucleotide
ggttgctactggagc

SEQ ID NO: 6014 - protein, 5 aa, Artificial Sequence
  Description of Artificial Sequence: Synthetic peptide
GCYWS

SEQ ID NO: 6015 - DNA, 15 bp, Artificial Sequence
  Description of Artificial Sequence: Synthetic oligonucleotide
ggttgctactggagc

SEQ ID NO: 6016 - protein, 5 aa, Artificial Sequence
  Description of Artificial Sequence: Synthetic peptide
GCYWS

SEQ ID NO: 6017 - DNA, 15 bp, Artificial Sequence
  Description of Artificial Sequence: Synthetic oligonucleotide
ggttgctactggagc

SEQ ID NO: 6018 - protein, 5 aa, Artificial Sequence
  Description of Artificial Sequence: Synthetic peptide
GCYWS

SEQ ID NO: 6019 - DNA, 15 bp, Artificial Sequence
  Description of Artificial Sequence: Synthetic oligonucleotide
ggttgctactggagc

SEQ ID NO: 6020 - protein, 5 aa, Artificial Sequence
  Description of Artificial Sequence: Synthetic peptide
GCYWS

SEQ ID NO: 6021 - DNA, 15 bp, Artificial Sequence
  Description of Artificial Sequence: Synthetic oligonucleotide
aattatgatatcaac

SEQ ID NO: 6022 - protein, 5 aa, Artificial Sequence
  Description of Artificial Sequence: Synthetic peptide
NYDIN

SEQ ID NO: 6023 - DNA, 15 bp, Artificial Sequence
  Description of Artificial Sequence: Synthetic oligonucleotide
ggttgctactggagc

SEQ ID NO: 6024 - protein, 5 aa, Artificial Sequence
  Description of Artificial Sequence: Synthetic peptide
GCYWS

SEQ ID NO: 6025 - DNA, 15 bp, Artificial Sequence
  Description of Artificial Sequence: Synthetic oligonucleotide
ggttcctactggagc

SEQ ID NO: 6026 - protein, 5 aa, Artificial Sequence
  Description of Artificial Sequence: Synthetic peptide
GSYWS

SEQ ID NO: 6027 - DNA, 15 bp, Artificial Sequence
  Description of Artificial Sequence: Synthetic oligonucleotide
aactacgacatgcac

SEQ ID NO: 6028 - protein, 5 aa, Artificial Sequence
  Description of Artificial Sequence: Synthetic peptide
NYDMH

SEQ ID NO: 6029 - DNA, 15 bp, Artificial Sequence
  Description of Artificial Sequence: Synthetic oligonucleotide
agctatggcatgcac

SEQ ID NO: 6030 - protein, 5 aa, Artificial Sequence
  Description of Artificial Sequence: Synthetic peptide
SYGMH

SEQ ID NO: 6031 - DNA, 15 bp, Artificial Sequence
  Description of Artificial Sequence: Synthetic oligonucleotide
ggttgctactggagc

SEQ ID NO: 6032 - protein, 5 aa, Artificial Sequence
  Description of Artificial Sequence: Synthetic peptide
GCYWS

SEQ ID NO: 6033 - DNA, 15 bp, Artificial Sequence
  Description of Artificial Sequence: Synthetic oligonucleotide
aattatgatatcaac

SEQ ID NO: 6034 - protein, 5 aa, Artificial Sequence
  Description of Artificial Sequence: Synthetic peptide
NYDIN

SEQ ID NO: 6035 - DNA, 15 bp, Artificial Sequence
  Description of Artificial Sequence: Synthetic oligonucleotide
ggttgctactggagc

SEQ ID NO: 6036 - protein, 5 aa, Artificial Sequence
  Description of Artificial Sequence: Synthetic peptide
GCYWS

SEQ ID NO: 6037 - DNA, 15 bp, Artificial Sequence
  Description of Artificial Sequence: Synthetic oligonucleotide
aattatgatatcaac

SEQ ID NO: 6038 - protein, 5 aa, Artificial Sequence
  Description of Artificial Sequence: Synthetic peptide
NYDIN

SEQ ID NO: 6039 - DNA, 15 bp, Artificial Sequence
  Description of Artificial Sequence: Synthetic oligonucleotide
ggttgctactggagc

SEQ ID NO: 6040 - protein, 5 aa, Artificial Sequence
  Description of Artificial Sequence: Synthetic peptide
GCYWS

SEQ ID NO: 6041 - DNA, 15 bp, Artificial Sequence
  Description of Artificial Sequence: Synthetic oligonucleotide
ggttgctactggagc

SEQ ID NO: 6042 - protein, 5 aa, Artificial Sequence
  Description of Artificial Sequence: Synthetic peptide
GCYWS

SEQ ID NO: 6043 - DNA, 15 bp, Artificial Sequence
  Description of Artificial Sequence: Synthetic oligonucleotide
ggttgctactggagc

SEQ ID NO: 6044 - protein, 5 aa, Artificial Sequence
  Description of Artificial Sequence: Synthetic peptide
GCYWS

SEQ ID NO: 6045 - DNA, 15 bp, Artificial Sequence
  Description of Artificial Sequence: Synthetic oligonucleotide
ggttgctactggagc

SEQ ID NO: 6046 - protein, 5 aa, Artificial Sequence
  Description of Artificial Sequence: Synthetic peptide
GCYWS

SEQ ID NO: 6047 - DNA, 15 bp, Artificial Sequence
  Description of Artificial Sequence: Synthetic oligonucleotide
aacgatatcatgcac

SEQ ID NO: 6048 - protein, 5 aa, Artificial Sequence
  Description of Artificial Sequence: Synthetic peptide
NDIMH

SEQ ID NO: 6049 - DNA, 15 bp, Artificial Sequence
  Description of Artificial Sequence: Synthetic oligonucleotide
aattatgatatcaac

SEQ ID NO: 6050 - protein, 5 aa, Artificial Sequence
  Description of Artificial Sequence: Synthetic peptide
NYDIN

SEQ ID NO: 6051 - DNA, 15 bp, Artificial Sequence
  Description of Artificial Sequence: Synthetic oligonucleotide
aattatgatatcaac

SEQ ID NO: 6052 - protein, 5 aa, Artificial Sequence
  Description of Artificial Sequence: Synthetic peptide
NYDIN

SEQ ID NO: 6053 - DNA, 15 bp, Artificial Sequence
  Description of Artificial Sequence: Synthetic oligonucleotide
aattatgatatcaac

SEQ ID NO: 6054 - protein, 5 aa, Artificial Sequence
  Description of Artificial Sequence: Synthetic peptide
NYDIN

SEQ ID NO: 6055 - DNA, 15 bp, Artificial Sequence
  Description of Artificial Sequence: Synthetic oligonucleotide
aattatgatatcaac

SEQ ID NO: 6056 - protein, 5 aa, Artificial Sequence
  Description of Artificial Sequence: Synthetic peptide
NYDIN

SEQ ID NO: 6057 - DNA, 15 bp, Artificial Sequence
  Description of Artificial Sequence: Synthetic oligonucleotide
ggttgctactggagc

SEQ ID NO: 6058 - protein, 5 aa, Artificial Sequence
  Description of Artificial Sequence: Synthetic peptide
GCYWS

SEQ ID NO: 6059 - DNA, 15 bp, Artificial Sequence
  Description of Artificial Sequence: Synthetic oligonucleotide
ggttgctactggagc

SEQ ID NO: 6060 - protein, 5 aa, Artificial Sequence
  Description of Artificial Sequence: Synthetic peptide
GCYWS

SEQ ID NO: 6061 - DNA, 15 bp, Artificial Sequence
  Description of Artificial Sequence: Synthetic oligonucleotide
agctatggcatgcac

SEQ ID NO: 6062 - protein, 5 aa, Artificial Sequence
  Description of Artificial Sequence: Synthetic peptide
SYGMH

SEQ ID NO: 6063 - DNA, 15 bp, Artificial Sequence
  Description of Artificial Sequence: Synthetic oligonucleotide
aattatgatatcaac

SEQ ID NO: 6064 - protein, 5 aa, Artificial Sequence
  Description of Artificial Sequence: Synthetic peptide
NYDIN

SEQ ID NO: 6065 - DNA, 15 bp, Artificial Sequence
  Description of Artificial Sequence: Synthetic oligonucleotide
ggttgctactggagc

SEQ ID NO: 6066 - protein, 5 aa, Artificial Sequence
  Description of Artificial Sequence: Synthetic peptide
GCYWS

SEQ ID NO: 6067 - DNA, 15 bp, Artificial Sequence
  Description of Artificial Sequence: Synthetic oligonucleotide
ggttgctactggagc

SEQ ID NO: 6068 - protein, 5 aa, Artificial Sequence
  Description of Artificial Sequence: Synthetic peptide
GCYWS

SEQ ID NO: 6069 - DNA, 15 bp, Artificial Sequence
  Description of Artificial Sequence: Synthetic oligonucleotide
ggttgctactggagc

SEQ ID NO: 6070 - protein, 5 aa, Artificial Sequence
  Description of Artificial Sequence: Synthetic peptide
GCYWS

SEQ ID NO: 6071 - DNA, 15 bp, Artificial Sequence
  Description of Artificial Sequence: Synthetic oligonucleotide
aattatgatatcaac

SEQ ID NO: 6072 - protein, 5 aa, Artificial Sequence
  Description of Artificial Sequence: Synthetic peptide
NYDIN

SEQ ID NO: 6073 - DNA, 15 bp, Artificial Sequence
  Description of Artificial Sequence: Synthetic oligonucleotide
aattatgatatcaac

SEQ ID NO: 6074 - protein, 5 aa, Artificial Sequence
  Description of Artificial Sequence: Synthetic peptide
NYDIN

SEQ ID NO: 6075 - DNA, 15 bp, Artificial Sequence
  Description of Artificial Sequence: Synthetic oligonucleotide
aattatgatatcaac

SEQ ID NO: 6076 - protein, 5 aa, Artificial Sequence
  Description of Artificial Sequence: Synthetic peptide
NYDIN

SEQ ID NO: 6077 - DNA, 21 bp, Artificial Sequence
  Description of Artificial Sequence: Synthetic oligonucleotide
agtagtaattactactggggc

SEQ ID NO: 6078 - protein, 7 aa, Artificial Sequence
  Description of Artificial Sequence: Synthetic peptide
SSNYYWG

SEQ ID NO: 6079 - DNA, 15 bp, Artificial Sequence
  Description of Artificial Sequence: Synthetic oligonucleotide
agttatgatatcaac

SEQ ID NO: 6080 - protein, 5 aa, Artificial Sequence
  Description of Artificial Sequence: Synthetic peptide
SYDIN

SEQ ID NO: 6081 - DNA, 15 bp, Artificial Sequence
  Description of Artificial Sequence: Synthetic oligonucleotide
aattatgatatcaac

SEQ ID NO: 6082 - protein, 5 aa, Artificial Sequence
  Description of Artificial Sequence: Synthetic peptide
NYDIN

SEQ ID NO: 6083 - DNA, 15 bp, Artificial Sequence
  Description of Artificial Sequence: Synthetic oligonucleotide
aattatgatatcaac

SEQ ID NO: 6084 - protein, 5 aa, Artificial Sequence
  Description of Artificial Sequence: Synthetic peptide
NYDIN

SEQ ID NO: 6085 - DNA, 15 bp, Artificial Sequence
  Description of Artificial Sequence: Synthetic oligonucleotide
agttatgatatcaac

SEQ ID NO: 6086 - protein, 5 aa, Artificial Sequence
  Description of Artificial Sequence: Synthetic peptide
SYDIN

SEQ ID NO: 6087 - DNA, 15 bp, Artificial Sequence
  Description of Artificial Sequence: Synthetic oligonucleotide
aattatgatatcaac

SEQ ID NO: 6088 - protein, 5 aa, Artificial Sequence
  Description of Artificial Sequence: Synthetic peptide
NYDIN

SEQ ID NO: 6089 - DNA, 15 bp, Artificial Sequence
  Description of Artificial Sequence: Synthetic oligonucleotide
ggttgctactggagc

SEQ ID NO: 6090 - protein, 5 aa, Artificial Sequence
  Description of Artificial Sequence: Synthetic peptide
GCYWS

SEQ ID NO: 6091 - DNA, 15 bp, Artificial Sequence
  Description of Artificial Sequence: Synthetic oligonucleotide
aattatgatatcaac

SEQ ID NO: 6092 - protein, 5 aa, Artificial Sequence
  Description of Artificial Sequence: Synthetic peptide
NYDIN

SEQ ID NO: 6093 - DNA, 15 bp, Artificial Sequence
  Description of Artificial Sequence: Synthetic oligonucleotide
ggttgctactggagc

SEQ ID NO: 6094 - protein, 5 aa, Artificial Sequence
  Description of Artificial Sequence: Synthetic peptide
GCYWS

SEQ ID NO: 6095 - DNA, 15 bp, Artificial Sequence
  Description of Artificial Sequence: Synthetic oligonucleotide
agctatggcatgcac

SEQ ID NO: 6096 - protein, 5 aa, Artificial Sequence
  Description of Artificial Sequence: Synthetic peptide
SYGMH

SEQ ID NO: 6097 - DNA, 21 bp, Artificial Sequence
  Description of Artificial Sequence: Synthetic oligonucleotide
agaagtagttactactggggc

SEQ ID NO: 6098 - protein, 7 aa, Artificial Sequence
  Description of Artificial Sequence: Synthetic peptide
RSSYYWG

SEQ ID NO: 6099 - DNA, 15 bp, Artificial Sequence
  Description of Artificial Sequence: Synthetic oligonucleotide
agctatgccatgagc

SEQ ID NO: 6100 - protein, 5 aa, Artificial Sequence
  Description of Artificial Sequence: Synthetic peptide
SYAMS

SEQ ID NO: 6101 - DNA, 15 bp, Artificial Sequence
  Description of Artificial Sequence: Synthetic oligonucleotide
agctatggcatgcac

SEQ ID NO: 6102 - protein, 5 aa, Artificial Sequence
  Description of Artificial Sequence: Synthetic peptide
SYGMH

SEQ ID NO: 6103 - DNA, 15 bp, Artificial Sequence
  Description of Artificial Sequence: Synthetic oligonucleotide
aattatgatatcaac

SEQ ID NO: 6104 - protein, 5 aa, Artificial Sequence
  Description of Artificial Sequence: Synthetic peptide
NYDIN

SEQ ID NO: 6105 - DNA, 21 bp, Artificial Sequence
  Description of Artificial Sequence: Synthetic oligonucleotide
aacagtggttactactggagc

SEQ ID NO: 6106 - protein, 7 aa, Artificial Sequence
  Description of Artificial Sequence: Synthetic peptide
NSGYYWS

SEQ ID NO: 6107 - DNA, 15 bp, Artificial Sequence
  Description of Artificial Sequence: Synthetic oligonucleotide
agctatgccatgaac

SEQ ID NO: 6108 - protein, 5 aa, Artificial Sequence
  Description of Artificial Sequence: Synthetic peptide
SYAMN

SEQ ID NO: 6109 - DNA, 15 bp, Artificial Sequence
  Description of Artificial Sequence: Synthetic oligonucleotide
aattatgatatcaac

SEQ ID NO: 6110 - protein, 5 aa, Artificial Sequence
  Description of Artificial Sequence: Synthetic peptide
NYDIN

SEQ ID NO: 6111 - DNA, 15 bp, Artificial Sequence
  Description of Artificial Sequence: Synthetic oligonucleotide
agctatgccatgagc

SEQ ID NO: 6112 - protein, 5 aa, Artificial Sequence
  Description of Artificial Sequence: Synthetic peptide
SYAMS

SEQ ID NO: 6113 - DNA, 15 bp, Artificial Sequence
  Description of Artificial Sequence: Synthetic oligonucleotide
aattatgatatcaac

SEQ ID NO: 6114 - protein, 5 aa, Artificial Sequence
  Description of Artificial Sequence: Synthetic peptide
NYDIN

SEQ ID NO: 6115 - DNA, 15 bp, Artificial Sequence
  Description of Artificial Sequence: Synthetic oligonucleotide
agctatggcatgcac

SEQ ID NO: 6116 - protein, 5 aa, Artificial Sequence
  Description of Artificial Sequence: Synthetic peptide
SYGMH

SEQ ID NO: 6117 - DNA, 15 bp, Artificial Sequence
  Description of Artificial Sequence: Synthetic oligonucleotide
agctatagcatgaac

SEQ ID NO: 6118 - protein, 5 aa, Artificial Sequence
  Description of Artificial Sequence: Synthetic peptide
SYSMN

SEQ ID NO: 6119 - DNA, 15 bp, Artificial Sequence
  Description of Artificial Sequence: Synthetic oligonucleotide
agctatggcatgcac

SEQ ID NO: 6120 - protein, 5 aa, Artificial Sequence
  Description of Artificial Sequence: Synthetic peptide
SYGMH

SEQ ID NO: 6121 - DNA, 21 bp, Artificial Sequence
  Description of Artificial Sequence: Synthetic oligonucleotide
agtggtgattactactggaac

SEQ ID NO: 6122 - protein, 7 aa, Artificial Sequence
  Description of Artificial Sequence: Synthetic peptide
SGDYYWN

SEQ ID NO: 6123 - DNA, 21 bp, Artificial Sequence
  Description of Artificial Sequence: Synthetic oligonucleotide
aatagtggttactactatagc

SEQ ID NO: 6124 - protein, 7 aa, Artificial Sequence
  Description of Artificial Sequence: Synthetic peptide
NSGYYYS

SEQ ID NO: 6125 - DNA, 15 bp, Artificial Sequence
  Description of Artificial Sequence: Synthetic oligonucleotide
aattatgatatcaac

SEQ ID NO: 6126 - protein, 5 aa, Artificial Sequence
  Description of Artificial Sequence: Synthetic peptide
NYDIN

SEQ ID NO: 6127 - DNA, 15 bp, Artificial Sequence
  Description of Artificial Sequence: Synthetic oligonucleotide
aattatgatatcaac

SEQ ID NO: 6128 - protein, 5 aa, Artificial Sequence
  Description of Artificial Sequence: Synthetic peptide
NYDIN

SEQ ID NO: 6129 - DNA, 15 bp, Artificial Sequence
  Description of Artificial Sequence: Synthetic oligonucleotide
gactatggcatgcac

SEQ ID NO: 6130 - protein, 5 aa, Artificial Sequence
  Description of Artificial Sequence: Synthetic peptide
DYGMH

SEQ ID NO: 6131 - DNA, 15 bp, Artificial Sequence
  Description of Artificial Sequence: Synthetic oligonucleotide
aattatgatatcaac

SEQ ID NO: 6132 - protein, 5 aa, Artificial Sequence
  Description of Artificial Sequence: Synthetic peptide
NYDIN

SEQ ID NO: 6133 - DNA, 15 bp, Artificial Sequence
  Description of Artificial Sequence: Synthetic oligonucleotide
agctatggcatgcac

SEQ ID NO: 6134 - protein, 5 aa, Artificial Sequence
  Description of Artificial Sequence: Synthetic peptide
SYGMH

SEQ ID NO: 6135 - DNA, 15 bp, Artificial Sequence
  Description of Artificial Sequence: Synthetic oligonucleotide
gcttactactggagc

SEQ ID NO: 6136 - protein, 5 aa, Artificial Sequence
  Description of Artificial Sequence: Synthetic peptide
AYYWS

SEQ ID NO: 6137 - DNA, 15 bp, Artificial Sequence
  Description of Artificial Sequence: Synthetic oligonucleotide
agctatagcatgaac

SEQ ID NO: 6138 - protein, 5 aa, Artificial Sequence
  Description of Artificial Sequence: Synthetic peptide
SYSMN

SEQ ID NO: 6139 - DNA, 15 bp, Artificial Sequence
  Description of Artificial Sequence: Synthetic oligonucleotide
agctatgccatgagc

SEQ ID NO: 6140 - protein, 5 aa, Artificial Sequence
  Description of Artificial Sequence: Synthetic peptide
SYAMS

SEQ ID NO: 6141 - DNA, 15 bp, Artificial Sequence
  Description of Artificial Sequence: Synthetic oligonucleotide
agctatgccatgagc

SEQ ID NO: 6142 - protein, 5 aa, Artificial Sequence
  Description of Artificial Sequence: Synthetic peptide
SYAMS

SEQ ID NO: 6143 - DNA, 15 bp, Artificial Sequence
  Description of Artificial Sequence: Synthetic oligonucleotide
agctatggcatgcac

SEQ ID NO: 6144 - protein, 5 aa, Artificial Sequence
  Description of Artificial Sequence: Synthetic peptide
SYGMH

SEQ ID NO: 6145 - DNA, 15 bp, Artificial Sequence
  Description of Artificial Sequence: Synthetic oligonucleotide
agctatgccatgagc

SEQ ID NO: 6146 - protein, 5 aa, Artificial Sequence
  Description of Artificial Sequence: Synthetic peptide
SYAMS

SEQ ID NO: 6147 - DNA, 15 bp, Artificial Sequence
  Description of Artificial Sequence: Synthetic oligonucleotide
aattatgatatcaac

SEQ ID NO: 6148 - protein, 5 aa, Artificial Sequence
  Description of Artificial Sequence: Synthetic peptide
NYDIN

SEQ ID NO: 6149 - DNA, 15 bp, Artificial Sequence
  Description of Artificial Sequence: Synthetic oligonucleotide
agctatgccatgaac

SEQ ID NO: 6150 - protein, 5 aa, Artificial Sequence
  Description of Artificial Sequence: Synthetic peptide
SYAMN

SEQ ID NO: 6151 - DNA, 15 bp, Artificial Sequence
  Description of Artificial Sequence: Synthetic oligonucleotide
agctatggcatgcac

SEQ ID NO: 6152 - protein, 5 aa, Artificial Sequence
  Description of Artificial Sequence: Synthetic peptide
SYGMH

SEQ ID NO: 6153 - DNA, 15 bp, Artificial Sequence
  Description of Artificial Sequence: Synthetic oligonucleotide
ggctactatatgcac

SEQ ID NO: 6154 - protein, 5 aa, Artificial Sequence
  Description of Artificial Sequence: Synthetic peptide
GYYMH

SEQ ID NO: 6155 - DNA, 15 bp, Artificial Sequence
  Description of Artificial Sequence: Synthetic oligonucleotide
aattatgatatcaac

SEQ ID NO: 6156 - protein, 5 aa, Artificial Sequence
  Description of Artificial Sequence: Synthetic peptide
NYDIN

SEQ ID NO: 6157 - DNA, 15 bp, Artificial Sequence
  Description of Artificial Sequence: Synthetic oligonucleotide
agctatgccatgagc

SEQ ID NO: 6158 - protein, 5 aa, Artificial Sequence
  Description of Artificial Sequence: Synthetic peptide
SYAMS

SEQ ID NO: 6159 - DNA, 15 bp, Artificial Sequence
  Description of Artificial Sequence: Synthetic oligonucleotide
agctatggcatgcac

SEQ ID NO: 6160 - protein, 5 aa, Artificial Sequence
  Description of Artificial Sequence: Synthetic peptide
SYGMH

SEQ ID NO: 6161 - DNA, 15 bp, Artificial Sequence
  Description of Artificial Sequence: Synthetic oligonucleotide
agctatggcatgcac

SEQ ID NO: 6162 - protein, 5 aa, Artificial Sequence
  Description of Artificial Sequence: Synthetic peptide
SYGMH

SEQ ID NO: 6163 - DNA, 21 bp, Artificial Sequence
  Description of Artificial Sequence: Synthetic oligonucleotide
agaagtagttactactggggc

SEQ ID NO: 6164 - protein, 7 aa, Artificial Sequence
  Description of Artificial Sequence: Synthetic peptide
RSSYYWG

SEQ ID NO: 6165 - DNA, 21 bp, Artificial Sequence
  Description of Artificial Sequence: Synthetic oligonucleotide
aatggtggttactactggaac

SEQ ID NO: 6166 - protein, 7 aa, Artificial Sequence
  Description of Artificial Sequence: Synthetic peptide
NGGYYWN

SEQ ID NO: 6167 - DNA, 15 bp, Artificial Sequence
  Description of Artificial Sequence: Synthetic oligonucleotide
agctatggcatgcac

SEQ ID NO: 6168 - protein, 5 aa, Artificial Sequence
  Description of Artificial Sequence: Synthetic peptide
SYGMH

SEQ ID NO: 6169 - DNA, 15 bp, Artificial Sequence
  Description of Artificial Sequence: Synthetic oligonucleotide
gactatggcatgcac

SEQ ID NO: 6170 - protein, 5 aa, Artificial Sequence
  Description of Artificial Sequence: Synthetic peptide
DYGMH

SEQ ID NO: 6171 - DNA, 15 bp, Artificial Sequence
  Description of Artificial Sequence: Synthetic oligonucleotide
aattatgatatcaac

SEQ ID NO: 6172 - protein, 5 aa, Artificial Sequence
  Description of Artificial Sequence: Synthetic peptide
NYDIN

SEQ ID NO: 6173 - DNA, 15 bp, Artificial Sequence
  Description of Artificial Sequence: Synthetic oligonucleotide
aactatgccatgacc

SEQ ID NO: 6174 - protein, 5 aa, Artificial Sequence
  Description of Artificial Sequence: Synthetic peptide
NYAMT

SEQ ID NO: 6175 - DNA, 15 bp, Artificial Sequence
  Description of Artificial Sequence: Synthetic oligonucleotide
aattatgatatcaac

SEQ ID NO: 6176 - protein, 5 aa, Artificial Sequence
  Description of Artificial Sequence: Synthetic peptide
NYDIN

SEQ ID NO: 6177 - DNA, 15 bp, Artificial Sequence
  Description of Artificial Sequence: Synthetic oligonucleotide
aattatgatatcaac

SEQ ID NO: 6178 - protein, 5 aa, Artificial Sequence
  Description of Artificial Sequence: Synthetic peptide
NYDIN

SEQ ID NO: 6179 - DNA, 21 bp, Artificial Sequence
  Description of Artificial Sequence: Synthetic oligonucleotide
aatggtggttactactggaac

SEQ ID NO: 6180 - protein, 7 aa, Artificial Sequence
  Description of Artificial Sequence: Synthetic peptide
NGGYYWN

SEQ ID NO: 6181 - DNA, 15 bp, Artificial Sequence
  Description of Artificial Sequence: Synthetic oligonucleotide
agctatgccatgagc

SEQ ID NO: 6182 - protein, 5 aa, Artificial Sequence
  Description of Artificial Sequence: Synthetic peptide
SYAMS

SEQ ID NO: 6183 - DNA, 15 bp, Artificial Sequence
  Description of Artificial Sequence: Synthetic oligonucleotide
agctatgccatgagc

SEQ ID NO: 6184 - protein, 5 aa, Artificial Sequence
  Description of Artificial Sequence: Synthetic peptide
SYAMS

SEQ ID NO: 6185 - DNA, 21 bp, Artificial Sequence
  Description of Artificial Sequence: Synthetic oligonucleotide
aacagtggttactactggagc

SEQ ID NO: 6186 - protein, 7 aa, Artificial Sequence
  Description of Artificial Sequence: Synthetic peptide
NSGYYWS

SEQ ID NO: 6187 - DNA, 15 bp, Artificial Sequence
  Description of Artificial Sequence: Synthetic oligonucleotide
agctatgccatgagc

SEQ ID NO: 6188 - protein, 5 aa, Artificial Sequence
  Description of Artificial Sequence: Synthetic peptide
SYAMS

SEQ ID NO: 6189 - DNA, 15 bp, Artificial Sequence
  Description of Artificial Sequence: Synthetic oligonucleotide
gactatggcatgcac

SEQ ID NO: 6190 - protein, 5 aa, Artificial Sequence
  Description of Artificial Sequence: Synthetic peptide
DYGMH

SEQ ID NO: 6191 - DNA, 15 bp, Artificial Sequence
  Description of Artificial Sequence: Synthetic oligonucleotide
agctatgccatgagc

SEQ ID NO: 6192 - protein, 5 aa, Artificial Sequence
  Description of Artificial Sequence: Synthetic peptide
SYAMS

SEQ ID NO: 6193 - DNA, 15 bp, Artificial Sequence
  Description of Artificial Sequence: Synthetic oligonucleotide
gactatggcatgcac

SEQ ID NO: 6194 - protein, 5 aa, Artificial Sequence
  Description of Artificial Sequence: Synthetic peptide
DYGMH

SEQ ID NO: 6195 - DNA, 15 bp, Artificial Sequence
  Description of Artificial Sequence: Synthetic oligonucleotide
aattatgatatcaac

SEQ ID NO: 6196 - protein, 5 aa, Artificial Sequence
  Description of Artificial Sequence: Synthetic peptide
NYDIN

SEQ ID NO: 6197 - DNA, 15 bp, Artificial Sequence
  Description of Artificial Sequence: Synthetic oligonucleotide
agctatgtcatgcac

SEQ ID NO: 6198 - protein, 5 aa, Artificial Sequence
  Description of Artificial Sequence: Synthetic peptide
SYVMH

SEQ ID NO: 6199 - DNA, 15 bp, Artificial Sequence
  Description of Artificial Sequence: Synthetic oligonucleotide
agctatgccatgagc

SEQ ID NO: 6200 - protein, 5 aa, Artificial Sequence
  Description of Artificial Sequence: Synthetic peptide
SYAMS

SEQ ID NO: 6201 - DNA, 15 bp, Artificial Sequence
  Description of Artificial Sequence: Synthetic oligonucleotide
aattatgatatcaac

SEQ ID NO: 6202 - protein, 5 aa, Artificial Sequence
  Description of Artificial Sequence: Synthetic peptide
NYDIN

SEQ ID NO: 6203 - DNA, 15 bp, Artificial Sequence
  Description of Artificial Sequence: Synthetic oligonucleotide
gactatggcatgcac

SEQ ID NO: 6204 - protein, 5 aa, Artificial Sequence
  Description of Artificial Sequence: Synthetic peptide
DYGMH

SEQ ID NO: 6205 - DNA, 15 bp, Artificial Sequence
  Description of Artificial Sequence: Synthetic oligonucleotide
acctatagcatgact

SEQ ID NO: 6206 - protein, 5 aa, Artificial Sequence
  Description of Artificial Sequence: Synthetic peptide
TYSMT

SEQ ID NO: 6207 - DNA, 15 bp, Artificial Sequence
  Description of Artificial Sequence: Synthetic oligonucleotide
agctatggcatgcac

SEQ ID NO: 6208 - protein, 5 aa, Artificial Sequence
  Description of Artificial Sequence: Synthetic peptide
SYGMH

SEQ ID NO: 6209 - DNA, 15 bp, Artificial Sequence
  Description of Artificial Sequence: Synthetic oligonucleotide
agctatgccatgaac

SEQ ID NO: 6210 - protein, 5 aa, Artificial Sequence
  Description of Artificial Sequence: Synthetic peptide
SYAMN

SEQ ID NO: 6211 - DNA, 15 bp, Artificial Sequence
  Description of Artificial Sequence: Synthetic oligonucleotide
agctatggcatgcac

SEQ ID NO: 6212 - protein, 5 aa, Artificial Sequence
  Description of Artificial Sequence: Synthetic peptide
SYGMH

SEQ ID NO: 6213 - DNA, 15 bp, Artificial Sequence
  Description of Artificial Sequence: Synthetic oligonucleotide
agctatgccatgagc

SEQ ID NO: 6214 - protein, 5 aa, Artificial Sequence
  Description of Artificial Sequence: Synthetic peptide
SYAMS

SEQ ID NO: 6215 - DNA, 15 bp, Artificial Sequence
  Description of Artificial Sequence: Synthetic oligonucleotide
agctttagcatgaac

SEQ ID NO: 6216 - protein, 5 aa, Artificial Sequence
  Description of Artificial Sequence: Synthetic peptide
SFSMN

SEQ ID NO: 6217 - DNA, 15 bp, Artificial Sequence
  Description of Artificial Sequence: Synthetic oligonucleotide
agctatggcatgcac

SEQ ID NO: 6218 - protein, 5 aa, Artificial Sequence
  Description of Artificial Sequence: Synthetic peptide
SYGMH

SEQ ID NO: 6219 - DNA, 15 bp, Artificial Sequence
  Description of Artificial Sequence: Synthetic oligonucleotide
agctatgccatgaac

SEQ ID NO: 6220 - protein, 5 aa, Artificial Sequence
  Description of Artificial Sequence: Synthetic peptide
SYAMN

SEQ ID NO: 6221 - DNA, 15 bp, Artificial Sequence
  Description of Artificial Sequence: Synthetic oligonucleotide
agctatggcatgcac

SEQ ID NO: 6222 - protein, 5 aa, Artificial Sequence
  Description of Artificial Sequence: Synthetic peptide
SYGMH

SEQ ID NO: 6223 - DNA, 15 bp, Artificial Sequence
  Description of Artificial Sequence: Synthetic oligonucleotide
aactatggcatgcac

SEQ ID NO: 6224 - protein, 5 aa, Artificial Sequence
  Description of Artificial Sequence: Synthetic peptide
NYGMH

SEQ ID NO: 6225 - DNA, 15 bp, Artificial Sequence
  Description of Artificial Sequence: Synthetic oligonucleotide
agctatgccatgagc

SEQ ID NO: 6226 - protein, 5 aa, Artificial Sequence
  Description of Artificial Sequence: Synthetic peptide
SYAMS

SEQ ID NO: 6227 - DNA, 15 bp, Artificial Sequence
  Description of Artificial Sequence: Synthetic oligonucleotide
aattatgatatcaac

SEQ ID NO: 6228 - protein, 5 aa, Artificial Sequence
  Description of Artificial Sequence: Synthetic peptide
NYDIN

SEQ ID NO: 6229 - DNA, 15 bp, Artificial Sequence
  Description of Artificial Sequence: Synthetic oligonucleotide
aattatgatatcaac

SEQ ID NO: 6230 - protein, 5 aa, Artificial Sequence
  Description of Artificial Sequence: Synthetic peptide
NYDIN

SEQ ID NO: 6231 - DNA, 15 bp, Artificial Sequence
  Description of Artificial Sequence: Synthetic oligonucleotide
aattatgatatcaac

SEQ ID NO: 6232 - protein, 5 aa, Artificial Sequence
  Description of Artificial Sequence: Synthetic peptide
NYDIN

SEQ ID NO: 6233 - DNA, 15 bp, Artificial Sequence
  Description of Artificial Sequence: Synthetic oligonucleotide
agctatgccatgagc

SEQ ID NO: 6234 - protein, 5 aa, Artificial Sequence
  Description of Artificial Sequence: Synthetic peptide
SYAMS

SEQ ID NO: 6235 - DNA, 15 bp, Artificial Sequence
  Description of Artificial Sequence: Synthetic oligonucleotide
agctatggcatgcac

SEQ ID NO: 6236 - protein, 5 aa, Artificial Sequence
  Description of Artificial Sequence: Synthetic peptide
SYGMH

SEQ ID NO: 6237 - DNA, 21 bp, Artificial Sequence
  Description of Artificial Sequence: Synthetic oligonucleotide
aacagtggttactactggagc

SEQ ID NO: 6238 - protein, 7 aa, Artificial Sequence
  Description of Artificial Sequence: Synthetic peptide
NSGYYWS

SEQ ID NO: 6239 - DNA, 15 bp, Artificial Sequence
  Description of Artificial Sequence: Synthetic oligonucleotide
agctatatcatgcac

SEQ ID NO: 6240 - protein, 5 aa, Artificial Sequence
  Description of Artificial Sequence: Synthetic peptide
SYIMH

SEQ ID NO: 6241 - DNA, 15 bp, Artificial Sequence
  Description of Artificial Sequence: Synthetic oligonucleotide
agctatgccatgaac

SEQ ID NO: 6242 - protein, 5 aa, Artificial Sequence
  Description of Artificial Sequence: Synthetic peptide
SYAMN

SEQ ID NO: 6243 - DNA, 21 bp, Artificial Sequence
  Description of Artificial Sequence: Synthetic oligonucleotide
agaagtagttactactggggc

SEQ ID NO: 6244 - protein, 7 aa, Artificial Sequence
  Description of Artificial Sequence: Synthetic peptide
RSSYYWG

SEQ ID NO: 6245 - DNA, 15 bp, Artificial Sequence
  Description of Artificial Sequence: Synthetic oligonucleotide
aattactactggagc

SEQ ID NO: 6246 - protein, 5 aa, Artificial Sequence
  Description of Artificial Sequence: Synthetic peptide
NYYWS

SEQ ID NO: 6247 - DNA, 15 bp, Artificial Sequence
  Description of Artificial Sequence: Synthetic oligonucleotide
agctatgccatgagc

SEQ ID NO: 6248 - protein, 5 aa, Artificial Sequence
  Description of Artificial Sequence: Synthetic peptide
SYAMS

SEQ ID NO: 6249 - DNA, 15 bp, Artificial Sequence
  Description of Artificial Sequence: Synthetic oligonucleotide
agctatgccatgaac

SEQ ID NO: 6250 - protein, 5 aa, Artificial Sequence
  Description of Artificial Sequence: Synthetic peptide
SYAMN

SEQ ID NO: 6251 - DNA, 15 bp, Artificial Sequence
  Description of Artificial Sequence: Synthetic oligonucleotide
aactatggcatgcac

SEQ ID NO: 6252 - protein, 5 aa, Artificial Sequence
  Description of Artificial Sequence: Synthetic peptide
NYGMH

SEQ ID NO: 6253 - DNA, 15 bp, Artificial Sequence
  Description of Artificial Sequence: Synthetic oligonucleotide
aattatgatatcaac

SEQ ID NO: 6254 - protein, 5 aa, Artificial Sequence
  Description of Artificial Sequence: Synthetic peptide
NYDIN

SEQ ID NO: 6255 - DNA, 15 bp, Artificial Sequence
  Description of Artificial Sequence: Synthetic oligonucleotide
agctatgtcatgagt

SEQ ID NO: 6256 - protein, 5 aa, Artificial Sequence
  Description of Artificial Sequence: Synthetic peptide
SYVMS

SEQ ID NO: 6257 - DNA, 15 bp, Artificial Sequence
  Description of Artificial Sequence: Synthetic oligonucleotide
agctatggcatgcac

SEQ ID NO: 6258 - protein, 5 aa, Artificial Sequence
  Description of Artificial Sequence: Synthetic peptide
SYGMH

SEQ ID NO: 6259 - DNA, 21 bp, Artificial Sequence
  Description of Artificial Sequence: Synthetic oligonucleotide
aacagtggttactactggagc

SEQ ID NO: 6260 - protein, 7 aa, Artificial Sequence
  Description of Artificial Sequence: Synthetic peptide
NSGYYWS

SEQ ID NO: 6261 - DNA, 15 bp, Artificial Sequence
  Description of Artificial Sequence: Synthetic oligonucleotide
agttactactggagc

SEQ ID NO: 6262 - protein, 5 aa, Artificial Sequence
  Description of Artificial Sequence: Synthetic peptide
SYYWS

SEQ ID NO: 6263 - DNA, 15 bp, Artificial Sequence
  Description of Artificial Sequence: Synthetic oligonucleotide
agctatggcatgcac

SEQ ID NO: 6264 - protein, 5 aa, Artificial Sequence
  Description of Artificial Sequence: Synthetic peptide
SYGMH

SEQ ID NO: 6265 - DNA, 15 bp, Artificial Sequence
  Description of Artificial Sequence: Synthetic oligonucleotide
aattatgatatcaac

SEQ ID NO: 6266 - protein, 5 aa, Artificial Sequence
  Description of Artificial Sequence: Synthetic peptide
NYDIN

SEQ ID NO: 6267 - DNA, 15 bp, Artificial Sequence
  Description of Artificial Sequence: Synthetic oligonucleotide
aattatgatatcaac

SEQ ID NO: 6268 - protein, 5 aa, Artificial Sequence
  Description of Artificial Sequence: Synthetic peptide
NYDIN

SEQ ID NO: 6269 - DNA, 15 bp, Artificial Sequence
  Description of Artificial Sequence: Synthetic oligonucleotide
agctatgccatgagc

SEQ ID NO: 6270 - protein, 5 aa, Artificial Sequence
  Description of Artificial Sequence: Synthetic peptide
SYAMS

SEQ ID NO: 6271 - DNA, 15 bp, Artificial Sequence
  Description of Artificial Sequence: Synthetic oligonucleotide
aattatgatatcaac

SEQ ID NO: 6272 - protein, 5 aa, Artificial Sequence
  Description of Artificial Sequence: Synthetic peptide
NYDIN

SEQ ID NO: 6273 - DNA, 15 bp, Artificial Sequence
  Description of Artificial Sequence: Synthetic oligonucleotide
agctatgccatgagc

SEQ ID NO: 6274 - protein, 5 aa, Artificial Sequence
  Description of Artificial Sequence: Synthetic peptide
SYAMS

SEQ ID NO: 6275 - DNA, 15 bp, Artificial Sequence
  Description of Artificial Sequence: Synthetic oligonucleotide
agctatgccatgagc

SEQ ID NO: 6276 - protein, 5 aa, Artificial Sequence
  Description of Artificial Sequence: Synthetic peptide
SYAMS

SEQ ID NO: 6277 - DNA, 15 bp, Artificial Sequence
  Description of Artificial Sequence: Synthetic oligonucleotide
agctatgccatgagc

SEQ ID NO: 6278 - protein, 5 aa, Artificial Sequence
  Description of Artificial Sequence: Synthetic peptide
SYAMS

SEQ ID NO: 6279 - DNA, 15 bp, Artificial Sequence
  Description of Artificial Sequence: Synthetic oligonucleotide
agctatggcatgcac

SEQ ID NO: 6280 - protein, 5 aa, Artificial Sequence
  Description of Artificial Sequence: Synthetic peptide
SYGMH

SEQ ID NO: 6281 - DNA, 15 bp, Artificial Sequence
  Description of Artificial Sequence: Synthetic oligonucleotide
aattatgatatcaac

SEQ ID NO: 6282 - protein, 5 aa, Artificial Sequence
  Description of Artificial Sequence: Synthetic peptide
NYDIN

SEQ ID NO: 6283 - DNA, 15 bp, Artificial Sequence
  Description of Artificial Sequence: Synthetic oligonucleotide
aattatgatatcaac

SEQ ID NO: 6284 - protein, 5 aa, Artificial Sequence
  Description of Artificial Sequence: Synthetic peptide
NYDIN

SEQ ID NO: 6285 - DNA, 15 bp, Artificial Sequence
  Description of Artificial Sequence: Synthetic oligonucleotide
agctatgccatgaac

SEQ ID NO: 6286 - protein, 5 aa, Artificial Sequence
  Description of Artificial Sequence: Synthetic peptide
SYAMN

SEQ ID NO: 6287 - DNA, 21 bp, Artificial Sequence
  Description of Artificial Sequence: Synthetic oligonucleotide
agaagtagttactactggggc

SEQ ID NO: 6288 - protein, 7 aa, Artificial Sequence
  Description of Artificial Sequence: Synthetic peptide
RSSYYWG

SEQ ID NO: 6289 - DNA, 15 bp, Artificial Sequence
  Description of Artificial Sequence: Synthetic oligonucleotide
aattatgatatcaac

SEQ ID NO: 6290 - protein, 5 aa, Artificial Sequence
  Description of Artificial Sequence: Synthetic peptide
NYDIN

SEQ ID NO: 6291 - DNA, 15 bp, Artificial Sequence
  Description of Artificial Sequence: Synthetic oligonucleotide
agctatgccatgagc

SEQ ID NO: 6292 - protein, 5 aa, Artificial Sequence
  Description of Artificial Sequence: Synthetic peptide
SYAMS

SEQ ID NO: 6293 - DNA, 15 bp, Artificial Sequence
  Description of Artificial Sequence: Synthetic oligonucleotide
agctatagaatgaac

SEQ ID NO: 6294 - protein, 5 aa, Artificial Sequence
  Description of Artificial Sequence: Synthetic peptide
SYRMN

SEQ ID NO: 6295 - DNA, 15 bp, Artificial Sequence
  Description of Artificial Sequence: Synthetic oligonucleotide
agttatgccatgagg

SEQ ID NO: 6296 - protein, 5 aa, Artificial Sequence
  Description of Artificial Sequence: Synthetic peptide
SYAMR

SEQ ID NO: 6297 - DNA, 15 bp, Artificial Sequence
  Description of Artificial Sequence: Synthetic oligonucleotide
acctatggcatgcac

SEQ ID NO: 6298 - protein, 5 aa, Artificial Sequence
  Description of Artificial Sequence: Synthetic peptide
TYGMH

SEQ ID NO: 6299 - DNA, 15 bp, Artificial Sequence
  Description of Artificial Sequence: Synthetic oligonucleotide
acctatgccatgagc

SEQ ID NO: 6300 - protein, 5 aa, Artificial Sequence
  Description of Artificial Sequence: Synthetic peptide
TYAMS

SEQ ID NO: 6301 - DNA, 15 bp, Artificial Sequence
  Description of Artificial Sequence: Synthetic oligonucleotide
agctataccatgaac

SEQ ID NO: 6302 - protein, 5 aa, Artificial Sequence
  Description of Artificial Sequence: Synthetic peptide
SYTMN

SEQ ID NO: 6303 - DNA, 15 bp, Artificial Sequence
  Description of Artificial Sequence: Synthetic oligonucleotide
agttatagcatgaac

SEQ ID NO: 6304 - protein, 5 aa, Artificial Sequence
  Description of Artificial Sequence: Synthetic peptide
SYSMN

SEQ ID NO: 6305 - DNA, 15 bp, Artificial Sequence
  Description of Artificial Sequence: Synthetic oligonucleotide
agctatgtcatgagc

SEQ ID NO: 6306 - protein, 5 aa, Artificial Sequence
  Description of Artificial Sequence: Synthetic peptide
SYVMS

SEQ ID NO: 6307 - DNA, 21 bp, Artificial Sequence
  Description of Artificial Sequence: Synthetic oligonucleotide
agtggtagttactactggggc

SEQ ID NO: 6308 - protein, 7 aa, Artificial Sequence
  Description of Artificial Sequence: Synthetic peptide
SGSYYWG

SEQ ID NO: 6309 - DNA, 15 bp, Artificial Sequence
  Description of Artificial Sequence: Synthetic oligonucleotide
agttatagcatgaac

SEQ ID NO: 6310 - protein, 5 aa, Artificial Sequence
  Description of Artificial Sequence: Synthetic peptide
SYSMN

SEQ ID NO: 6311 - DNA, 15 bp, Artificial Sequence
  Description of Artificial Sequence: Synthetic oligonucleotide
agctatagcatgaac

SEQ ID NO: 6312 - protein, 5 aa, Artificial Sequence
  Description of Artificial Sequence: Synthetic peptide
SYSMN

SEQ ID NO: 6313 - DNA, 15 bp, Artificial Sequence
  Description of Artificial Sequence: Synthetic oligonucleotide
aattatggcatgcac

SEQ ID NO: 6314 - protein, 5 aa, Artificial Sequence
  Description of Artificial Sequence: Synthetic peptide
NYGMH

SEQ ID NO: 6315 - DNA, 15 bp, Artificial Sequence
  Description of Artificial Sequence: Synthetic oligonucleotide
agctatggcatgcac

SEQ ID NO: 6316 - protein, 5 aa, Artificial Sequence
  Description of Artificial Sequence: Synthetic peptide
SYGMH

SEQ ID NO: 6317 - DNA, 15 bp, Artificial Sequence
  Description of Artificial Sequence: Synthetic oligonucleotide
agctataccatgaac

SEQ ID NO: 6318 - protein, 5 aa, Artificial Sequence
  Description of Artificial Sequence: Synthetic peptide
SYTMN

SEQ ID NO: 6319 - DNA, 15 bp, Artificial Sequence
  Description of Artificial Sequence: Synthetic oligonucleotide
agctatagcatgaac

SEQ ID NO: 6320 - protein, 5 aa, Artificial Sequence
  Description of Artificial Sequence: Synthetic peptide
SYSMN

SEQ ID NO: 6321 - DNA, 15 bp, Artificial Sequence
  Description of Artificial Sequence: Synthetic oligonucleotide
agttatggcatgaac

SEQ ID NO: 6322 - protein, 5 aa, Artificial Sequence
  Description of Artificial Sequence: Synthetic peptide
SYGMN

SEQ ID NO: 6323 - DNA, 15 bp, Artificial Sequence
  Description of Artificial Sequence: Synthetic oligonucleotide
gactatgtcatgcac

SEQ ID NO: 6324 - protein, 5 aa, Artificial Sequence
  Description of Artificial Sequence: Synthetic peptide
DYVMH

SEQ ID NO: 6325 - DNA, 15 bp, Artificial Sequence
  Description of Artificial Sequence: Synthetic oligonucleotide
agtcacttctggagc

SEQ ID NO: 6326 - protein, 5 aa, Artificial Sequence
  Description of Artificial Sequence: Synthetic peptide
SHFWS

SEQ ID NO: 6327 - DNA, 15 bp, Artificial Sequence
  Description of Artificial Sequence: Synthetic oligonucleotide
agttatagcatgaac

SEQ ID NO: 6328 - protein, 5 aa, Artificial Sequence
  Description of Artificial Sequence: Synthetic peptide
SYSMN

SEQ ID NO: 6329 - DNA, 15 bp, Artificial Sequence
  Description of Artificial Sequence: Synthetic oligonucleotide
agctatagcatgaac

SEQ ID NO: 6330 - protein, 5 aa, Artificial Sequence
  Description of Artificial Sequence: Synthetic peptide
SYSMN

SEQ ID NO: 6331 - DNA, 15 bp, Artificial Sequence
  Description of Artificial Sequence: Synthetic oligonucleotide
agctatggcatgcac

SEQ ID NO: 6332 - protein, 5 aa, Artificial Sequence
  Description of Artificial Sequence: Synthetic peptide
SYGMH

SEQ ID NO: 6333 - DNA, 15 bp, Artificial Sequence
  Description of Artificial Sequence: Synthetic oligonucleotide
agctataccatgaac

SEQ ID NO: 6334 - protein, 5 aa, Artificial Sequence
  Description of Artificial Sequence: Synthetic peptide
SYTMN

SEQ ID NO: 6335 - DNA, 15 bp, Artificial Sequence
  Description of Artificial Sequence: Synthetic oligonucleotide
aattatgatatcaac

SEQ ID NO: 6336 - protein, 5 aa, Artificial Sequence
  Description of Artificial Sequence: Synthetic peptide
NYDIN

SEQ ID NO: 6337 - DNA, 15 bp, Artificial Sequence
  Description of Artificial Sequence: Synthetic oligonucleotide
agctatgtcatgagc

SEQ ID NO: 6338 - protein, 5 aa, Artificial Sequence
  Description of Artificial Sequence: Synthetic peptide
SYVMS

SEQ ID NO: 6339 - DNA, 15 bp, Artificial Sequence
  Description of Artificial Sequence: Synthetic oligonucleotide
agctatagaatgaac

SEQ ID NO: 6340 - protein, 5 aa, Artificial Sequence
  Description of Artificial Sequence: Synthetic peptide
SYRMN

SEQ ID NO: 6341 - DNA, 15 bp, Artificial Sequence
  Description of Artificial Sequence: Synthetic oligonucleotide
agttatgatatcaac

SEQ ID NO: 6342 - protein, 5 aa, Artificial Sequence
  Description of Artificial Sequence: Synthetic peptide
SYDIN

SEQ ID NO: 6343 - DNA, 15 bp, Artificial Sequence
  Description of Artificial Sequence: Synthetic oligonucleotide
aactatggcatgcac

SEQ ID NO: 6344 - protein, 5 aa, Artificial Sequence
  Description of Artificial Sequence: Synthetic peptide
NYGMH

SEQ ID NO: 6345 - DNA, 15 bp, Artificial Sequence
  Description of Artificial Sequence: Synthetic oligonucleotide
agctatggcatacac

SEQ ID NO: 6346 - protein, 5 aa, Artificial Sequence
  Description of Artificial Sequence: Synthetic peptide
SYGIH

SEQ ID NO: 6347 - DNA, 15 bp, Artificial Sequence
  Description of Artificial Sequence: Synthetic oligonucleotide
gactatgtcatgcag

SEQ ID NO: 6348 - protein, 5 aa, Artificial Sequence
  Description of Artificial Sequence: Synthetic peptide
DYVMQ

SEQ ID NO: 6349 - DNA, 15 bp, Artificial Sequence
  Description of Artificial Sequence: Synthetic oligonucleotide
aactatgtcatgcac

SEQ ID NO: 6350 - protein, 5 aa, Artificial Sequence
  Description of Artificial Sequence: Synthetic peptide
NYVMH

SEQ ID NO: 6351 - DNA, 15 bp, Artificial Sequence
  Description of Artificial Sequence: Synthetic oligonucleotide
agctataccatgaac

SEQ ID NO: 6352 - protein, 5 aa, Artificial Sequence
  Description of Artificial Sequence: Synthetic peptide
SYTMN

SEQ ID NO: 6353 - DNA, 15 bp, Artificial Sequence
  Description of Artificial Sequence: Synthetic oligonucleotide
agctatggcatgcac

SEQ ID NO: 6354 - protein, 5 aa, Artificial Sequence
  Description of Artificial Sequence: Synthetic peptide
SYGMH

SEQ ID NO: 6355 - DNA, 15 bp, Artificial Sequence
  Description of Artificial Sequence: Synthetic oligonucleotide
agctatgtcatgagc

SEQ ID NO: 6356 - protein, 5 aa, Artificial Sequence
  Description of Artificial Sequence: Synthetic peptide
SYVMS

SEQ ID NO: 6357 - DNA, 15 bp, Artificial Sequence
  Description of Artificial Sequence: Synthetic oligonucleotide
agctatcgcatgaac

SEQ ID NO: 6358 - protein, 5 aa, Artificial Sequence
  Description of Artificial Sequence: Synthetic peptide
SYRMN

SEQ ID NO: 6359 - DNA, 15 bp, Artificial Sequence
  Description of Artificial Sequence: Synthetic oligonucleotide
agttatggcatgaac

SEQ ID NO: 6360 - protein, 5 aa, Artificial Sequence
  Description of Artificial Sequence: Synthetic peptide
SYGMN

SEQ ID NO: 6361 - DNA, 15 bp, Artificial Sequence
  Description of Artificial Sequence: Synthetic oligonucleotide
agctatgtcatgagc

SEQ ID NO: 6362 - protein, 5 aa, Artificial Sequence
  Description of Artificial Sequence: Synthetic peptide
SYVMS

SEQ ID NO: 6363 - DNA, 21 bp, Artificial Sequence
  Description of Artificial Sequence: Synthetic oligonucleotide
agaagtagttactactggggc

SEQ ID NO: 6364 - protein, 7 aa, Artificial Sequence
  Description of Artificial Sequence: Synthetic peptide
RSSYYWG

SEQ ID NO: 6365 - DNA, 15 bp, Artificial Sequence
  Description of Artificial Sequence: Synthetic oligonucleotide
aattatgatatcaac

SEQ ID NO: 6366 - protein, 5 aa, Artificial Sequence
  Description of Artificial Sequence: Synthetic peptide
NYDIN

SEQ ID NO: 6367 - DNA, 15 bp, Artificial Sequence
  Description of Artificial Sequence: Synthetic oligonucleotide
gactatgtcatgcag

SEQ ID NO: 6368 - protein, 5 aa, Artificial Sequence
  Description of Artificial Sequence: Synthetic peptide
DYVMQ

SEQ ID NO: 6369 - DNA, 15 bp, Artificial Sequence
  Description of Artificial Sequence: Synthetic oligonucleotide
agttatagcatgaac

SEQ ID NO: 6370 - protein, 5 aa, Artificial Sequence
  Description of Artificial Sequence: Synthetic peptide
SYSMN

SEQ ID NO: 6371 - DNA, 15 bp, Artificial Sequence
  Description of Artificial Sequence: Synthetic oligonucleotide
agctataggatgaac

SEQ ID NO: 6372 - protein, 5 aa, Artificial Sequence
  Description of Artificial Sequence: Synthetic peptide
SYRMN

SEQ ID NO: 6373 - DNA, 21 bp, Artificial Sequence
  Description of Artificial Sequence: Synthetic oligonucleotide
agaagtagctactactggggc

SEQ ID NO: 6374 - protein, 7 aa, Artificial Sequence
  Description of Artificial Sequence: Synthetic peptide
RSSYYWG

SEQ ID NO: 6375 - DNA, 15 bp, Artificial Sequence
  Description of Artificial Sequence: Synthetic oligonucleotide
agctttggcatgcac

SEQ ID NO: 6376 - protein, 5 aa, Artificial Sequence
  Description of Artificial Sequence: Synthetic peptide
SFGMH

SEQ ID NO: 6377 - DNA, 15 bp, Artificial Sequence
  Description of Artificial Sequence: Synthetic oligonucleotide
agcaactacatgagc

SEQ ID NO: 6378 - protein, 5 aa, Artificial Sequence
  Description of Artificial Sequence: Synthetic peptide
SNYMS

SEQ ID NO: 6379 - DNA, 15 bp, Artificial Sequence
  Description of Artificial Sequence: Synthetic oligonucleotide
agctatggcatgcac

SEQ ID NO: 6380 - protein, 5 aa, Artificial Sequence
  Description of Artificial Sequence: Synthetic peptide
SYGMH

SEQ ID NO: 6381 - DNA, 15 bp, Artificial Sequence
  Description of Artificial Sequence: Synthetic oligonucleotide
gactttggcttgcac

SEQ ID NO: 6382 - protein, 5 aa, Artificial Sequence
  Description of Artificial Sequence: Synthetic peptide
DFGLH

SEQ ID NO: 6383 - DNA, 15 bp, Artificial Sequence
  Description of Artificial Sequence: Synthetic oligonucleotide
agctatggcatgcac

SEQ ID NO: 6384 - protein, 5 aa, Artificial Sequence
  Description of Artificial Sequence: Synthetic peptide
SYGMH

SEQ ID NO: 6385 - DNA, 15 bp, Artificial Sequence
  Description of Artificial Sequence: Synthetic oligonucleotide
gactttggcttgcac

SEQ ID NO: 6386 - protein, 5 aa, Artificial Sequence
  Description of Artificial Sequence: Synthetic peptide
DFGLH

SEQ ID NO: 6387 - DNA, 15 bp, Artificial Sequence
  Description of Artificial Sequence: Synthetic oligonucleotide
gactatgtcatgcag

SEQ ID NO: 6388 - protein, 5 aa, Artificial Sequence
  Description of Artificial Sequence: Synthetic peptide
DYVMQ

SEQ ID NO: 6389 - DNA, 15 bp, Artificial Sequence
  Description of Artificial Sequence: Synthetic oligonucleotide
agttatagcatgaac

SEQ ID NO: 6390 - protein, 5 aa, Artificial Sequence
  Description of Artificial Sequence: Synthetic peptide
SYSMN

SEQ ID NO: 6391 - DNA, 15 bp, Artificial Sequence
  Description of Artificial Sequence: Synthetic oligonucleotide
agttatagcatgaac

SEQ ID NO: 6392 - protein, 5 aa, Artificial Sequence
  Description of Artificial Sequence: Synthetic peptide
SYSMN

SEQ ID NO: 6393 - DNA, 15 bp, Artificial Sequence
  Description of Artificial Sequence: Synthetic oligonucleotide
aattatgatatcaac

SEQ ID NO: 6394 - protein, 5 aa, Artificial Sequence
  Description of Artificial Sequence: Synthetic peptide
NYDIN

SEQ ID NO: 6395 - DNA, 15 bp, Artificial Sequence
  Description of Artificial Sequence: Synthetic oligonucleotide
aattatgatatcaac

SEQ ID NO: 6396 - protein, 5 aa, Artificial Sequence
  Description of Artificial Sequence: Synthetic peptide
NYDIN

SEQ ID NO: 6397 - DNA, 15 bp, Artificial Sequence
  Description of Artificial Sequence: Synthetic oligonucleotide
aactatggcatgcac

SEQ ID NO: 6398 - protein, 5 aa, Artificial Sequence
  Description of Artificial Sequence: Synthetic peptide
NYGMH

SEQ ID NO: 6399 - DNA, 15 bp, Artificial Sequence
  Description of Artificial Sequence: Synthetic oligonucleotide
agctatagcatgaac

SEQ ID NO: 6400 - protein, 5 aa, Artificial Sequence
  Description of Artificial Sequence: Synthetic peptide
SYSMN

SEQ ID NO: 6401 - DNA, 15 bp, Artificial Sequence
  Description of Artificial Sequence: Synthetic oligonucleotide
agctatagcatgaac

SEQ ID NO: 6402 - protein, 5 aa, Artificial Sequence
  Description of Artificial Sequence: Synthetic peptide
SYSMN

SEQ ID NO: 6403 - DNA, 15 bp, Artificial Sequence
  Description of Artificial Sequence: Synthetic oligonucleotide
agttatagcatgagc

SEQ ID NO: 6404 - protein, 5 aa, Artificial Sequence
  Description of Artificial Sequence: Synthetic peptide
SYSMS

SEQ ID NO: 6405 - DNA, 15 bp, Artificial Sequence
  Description of Artificial Sequence: Synthetic oligonucleotide
agctatagcatgaac

SEQ ID NO: 6406 - protein, 5 aa, Artificial Sequence
  Description of Artificial Sequence: Synthetic peptide
SYSMN

SEQ ID NO: 6407 - DNA, 15 bp, Artificial Sequence
  Description of Artificial Sequence: Synthetic oligonucleotide
agctatagcatgaac

SEQ ID NO: 6408 - protein, 5 aa, Artificial Sequence
  Description of Artificial Sequence: Synthetic peptide
SYSMN

SEQ ID NO: 6409 - DNA, 15 bp, Artificial Sequence
  Description of Artificial Sequence: Synthetic oligonucleotide
cattatgatatcaac

SEQ ID NO: 6410 - protein, 5 aa, Artificial Sequence
  Description of Artificial Sequence: Synthetic peptide
HYDIN

SEQ ID NO: 6411 - DNA, 15 bp, Artificial Sequence
  Description of Artificial Sequence: Synthetic oligonucleotide
agctatagcatgagc

SEQ ID NO: 6412 - protein, 5 aa, Artificial Sequence
  Description of Artificial Sequence: Synthetic peptide
SYSMS

SEQ ID NO: 6413 - DNA, 15 bp, Artificial Sequence
  Description of Artificial Sequence: Synthetic oligonucleotide
agctttggcatgcac

SEQ ID NO: 6414 - protein, 5 aa, Artificial Sequence
  Description of Artificial Sequence: Synthetic peptide
SFGMH

SEQ ID NO: 6415 - DNA, 15 bp, Artificial Sequence
  Description of Artificial Sequence: Synthetic oligonucleotide
agctttggcatgcac

SEQ ID NO: 6416 - protein, 5 aa, Artificial Sequence
  Description of Artificial Sequence: Synthetic peptide
SFGMH

SEQ ID NO: 6417 - DNA, 15 bp, Artificial Sequence
  Description of Artificial Sequence: Synthetic oligonucleotide
agctatgtcatgagc

SEQ ID NO: 6418 - protein, 5 aa, Artificial Sequence
  Description of Artificial Sequence: Synthetic peptide
SYVMS

SEQ ID NO: 6419 - DNA, 15 bp, Artificial Sequence
  Description of Artificial Sequence: Synthetic oligonucleotide
agctatggcatgcac

SEQ ID NO: 6420 - protein, 5 aa, Artificial Sequence
  Description of Artificial Sequence: Synthetic peptide
SYGMH

SEQ ID NO: 6421 - DNA, 15 bp, Artificial Sequence
  Description of Artificial Sequence: Synthetic oligonucleotide
agttactactggagt

SEQ ID NO: 6422 - protein, 5 aa, Artificial Sequence
  Description of Artificial Sequence: Synthetic peptide
SYYWS

SEQ ID NO: 6423 - DNA, 15 bp, Artificial Sequence
  Description of Artificial Sequence: Synthetic oligonucleotide
ggccatagcatgaac

SEQ ID NO: 6424 - protein, 5 aa, Artificial Sequence
  Description of Artificial Sequence: Synthetic peptide
GHSMN

SEQ ID NO: 6425 - DNA, 15 bp, Artificial Sequence
  Description of Artificial Sequence: Synthetic oligonucleotide
acctatggcatgcac

SEQ ID NO: 6426 - protein, 5 aa, Artificial Sequence
  Description of Artificial Sequence: Synthetic peptide
TYGMH

SEQ ID NO: 6427 - DNA, 15 bp, Artificial Sequence
  Description of Artificial Sequence: Synthetic oligonucleotide
agttactactggagt

SEQ ID NO: 6428 - protein, 5 aa, Artificial Sequence
  Description of Artificial Sequence: Synthetic peptide
SYYWS

SEQ ID NO: 6429 - DNA, 15 bp, Artificial Sequence
  Description of Artificial Sequence: Synthetic oligonucleotide
ggccatagcatgaac

SEQ ID NO: 6430 - protein, 5 aa, Artificial Sequence
  Description of Artificial Sequence: Synthetic peptide
GHSMN

SEQ ID NO: 6431 - DNA, 15 bp, Artificial Sequence
  Description of Artificial Sequence: Synthetic oligonucleotide
agttactactggacc

SEQ ID NO: 6432 - protein, 5 aa, Artificial Sequence
  Description of Artificial Sequence: Synthetic peptide
SYYWT

SEQ ID NO: 6433 - DNA, 15 bp, Artificial Sequence
  Description of Artificial Sequence: Synthetic oligonucleotide
ggctactttatgcac

SEQ ID NO: 6434 - protein, 5 aa, Artificial Sequence
  Description of Artificial Sequence: Synthetic peptide
GYFMH

SEQ ID NO: 6435 - DNA, 15 bp, Artificial Sequence
  Description of Artificial Sequence: Synthetic oligonucleotide
agctatgtcatgagt

SEQ ID NO: 6436 - protein, 5 aa, Artificial Sequence
  Description of Artificial Sequence: Synthetic peptide
SYVMS

SEQ ID NO: 6437 - DNA, 15 bp, Artificial Sequence
  Description of Artificial Sequence: Synthetic oligonucleotide
gactatgtcatgcac

SEQ ID NO: 6438 - protein, 5 aa, Artificial Sequence
  Description of Artificial Sequence: Synthetic peptide
DYVMH

SEQ ID NO: 6439 - DNA, 15 bp, Artificial Sequence
  Description of Artificial Sequence: Synthetic oligonucleotide
agctatggcatgcac

SEQ ID NO: 6440 - protein, 5 aa, Artificial Sequence
  Description of Artificial Sequence: Synthetic peptide
SYGMH

SEQ ID NO: 6441 - DNA, 15 bp, Artificial Sequence
  Description of Artificial Sequence: Synthetic oligonucleotide
agctatgtcatgagt

SEQ ID NO: 6442 - protein, 5 aa, Artificial Sequence
  Description of Artificial Sequence: Synthetic peptide
SYVMS

SEQ ID NO: 6443 - DNA, 15 bp, Artificial Sequence
  Description of Artificial Sequence: Synthetic oligonucleotide
agttattactggagc

SEQ ID NO: 6444 - protein, 5 aa, Artificial Sequence
  Description of Artificial Sequence: Synthetic peptide
SYYWS

SEQ ID NO: 6445 - DNA, 15 bp, Artificial Sequence
  Description of Artificial Sequence: Synthetic oligonucleotide
gactatgtcatgcac

SEQ ID NO: 6446 - protein, 5 aa, Artificial Sequence
  Description of Artificial Sequence: Synthetic peptide
DYVMH

SEQ ID NO: 6447 - DNA, 15 bp, Artificial Sequence
  Description of Artificial Sequence: Synthetic oligonucleotide
acctatggcatgcac

SEQ ID NO: 6448 - protein, 5 aa, Artificial Sequence
  Description of Artificial Sequence: Synthetic peptide
TYGMH

SEQ ID NO: 6449 - DNA, 15 bp, Artificial Sequence
  Description of Artificial Sequence: Synthetic oligonucleotide
agctatggcatgcac

SEQ ID NO: 6450 - protein, 5 aa, Artificial Sequence
  Description of Artificial Sequence: Synthetic peptide
SYGMH

SEQ ID NO: 6451 - DNA, 15 bp, Artificial Sequence
  Description of Artificial Sequence: Synthetic oligonucleotide
acctatggcatgcac

SEQ ID NO: 6452 - protein, 5 aa, Artificial Sequence
  Description of Artificial Sequence: Synthetic peptide
TYGMH

SEQ ID NO: 6453 - DNA, 15 bp, Artificial Sequence
  Description of Artificial Sequence: Synthetic oligonucleotide
ggctactttatacac

SEQ ID NO: 6454 - protein, 5 aa, Artificial Sequence
  Description of Artificial Sequence: Synthetic peptide
GYFIH

SEQ ID NO: 6455 - DNA, 15 bp, Artificial Sequence
  Description of Artificial Sequence: Synthetic oligonucleotide
aattatgatatcaac

SEQ ID NO: 6456 - protein, 5 aa, Artificial Sequence
  Description of Artificial Sequence: Synthetic peptide
NYDIN

SEQ ID NO: 6457 - DNA, 15 bp, Artificial Sequence
  Description of Artificial Sequence: Synthetic oligonucleotide
agctatggcatgcac

SEQ ID NO: 6458 - protein, 5 aa, Artificial Sequence
  Description of Artificial Sequence: Synthetic peptide
SYGMH

SEQ ID NO: 6459 - DNA, 15 bp, Artificial Sequence
  Description of Artificial Sequence: Synthetic oligonucleotide
acctatggcatgcac

SEQ ID NO: 6460 - protein, 5 aa, Artificial Sequence
  Description of Artificial Sequence: Synthetic peptide
TYGMH

SEQ ID NO: 6461 - DNA, 15 bp, Artificial Sequence
  Description of Artificial Sequence: Synthetic oligonucleotide
acctatggcatgcac

SEQ ID NO: 6462 - protein, 5 aa, Artificial Sequence
  Description of Artificial Sequence: Synthetic peptide
TYGMH

SEQ ID NO: 6463 - DNA, 15 bp, Artificial Sequence
  Description of Artificial Sequence: Synthetic oligonucleotide
agctgtgccatgacc

SEQ ID NO: 6464 - protein, 5 aa, Artificial Sequence
  Description of Artificial Sequence: Synthetic peptide
SCAMT

SEQ ID NO: 6465 - DNA, 15 bp, Artificial Sequence
  Description of Artificial Sequence: Synthetic oligonucleotide
agctatggcatgcac

SEQ ID NO: 6466 - protein, 5 aa, Artificial Sequence
  Description of Artificial Sequence: Synthetic peptide
SYGMH

SEQ ID NO: 6467 - DNA, 15 bp, Artificial Sequence
  Description of Artificial Sequence: Synthetic oligonucleotide
agctctgccatgagc

SEQ ID NO: 6468 - protein, 5 aa, Artificial Sequence
  Description of Artificial Sequence: Synthetic peptide
SSAMS

SEQ ID NO: 6469 - DNA, 15 bp, Artificial Sequence
  Description of Artificial Sequence: Synthetic oligonucleotide
agctatgccatgact

SEQ ID NO: 6470 - protein, 5 aa, Artificial Sequence
  Description of Artificial Sequence: Synthetic peptide
SYAMT

SEQ ID NO: 6471 - DNA, 15 bp, Artificial Sequence
  Description of Artificial Sequence: Synthetic oligonucleotide
agctatagcatgaac

SEQ ID NO: 6472 - protein, 5 aa, Artificial Sequence
  Description of Artificial Sequence: Synthetic peptide
SYSMN

SEQ ID NO: 6473 - DNA, 15 bp, Artificial Sequence
  Description of Artificial Sequence: Synthetic oligonucleotide
acctatggcatgcac

SEQ ID NO: 6474 - protein, 5 aa, Artificial Sequence
  Description of Artificial Sequence: Synthetic peptide
TYGMH

SEQ ID NO: 6475 - DNA, 15 bp, Artificial Sequence
  Description of Artificial Sequence: Synthetic oligonucleotide
aactatggcatgcac

SEQ ID NO: 6476 - protein, 5 aa, Artificial Sequence
  Description of Artificial Sequence: Synthetic peptide
NYGMH

SEQ ID NO: 6477 - DNA, 15 bp, Artificial Sequence
  Description of Artificial Sequence: Synthetic oligonucleotide
acctatggcatgcac

SEQ ID NO: 6478 - protein, 5 aa, Artificial Sequence
  Description of Artificial Sequence: Synthetic peptide
TYGMH

SEQ ID NO: 6479 - DNA, 15 bp, Artificial Sequence
  Description of Artificial Sequence: Synthetic oligonucleotide
aattatgatatcaac

SEQ ID NO: 6480 - protein, 5 aa, Artificial Sequence
  Description of Artificial Sequence: Synthetic peptide
NYDIN

SEQ ID NO: 6481 - DNA, 15 bp, Artificial Sequence
  Description of Artificial Sequence: Synthetic oligonucleotide
agctatgccatgagc

SEQ ID NO: 6482 - protein, 5 aa, Artificial Sequence
  Description of Artificial Sequence: Synthetic peptide
SYAMS

SEQ ID NO: 6483 - DNA, 15 bp, Artificial Sequence
  Description of Artificial Sequence: Synthetic oligonucleotide
agctatggcatgcac

SEQ ID NO: 6484 - protein, 5 aa, Artificial Sequence
  Description of Artificial Sequence: Synthetic peptide
SYGMH

SEQ ID NO: 6485 - DNA, 15 bp, Artificial Sequence
  Description of Artificial Sequence: Synthetic oligonucleotide
agctatggcatacac

SEQ ID NO: 6486 - protein, 5 aa, Artificial Sequence
  Description of Artificial Sequence: Synthetic peptide
SYGIH

SEQ ID NO: 6487 - DNA, 15 bp, Artificial Sequence
  Description of Artificial Sequence: Synthetic oligonucleotide
agctatggcatgcac

SEQ ID NO: 6488 - protein, 5 aa, Artificial Sequence
  Description of Artificial Sequence: Synthetic peptide
SYGMH

SEQ ID NO: 6489 - DNA, 15 bp, Artificial Sequence
  Description of Artificial Sequence: Synthetic oligonucleotide
aattatgatatcaac

SEQ ID NO: 6490 - protein, 5 aa, Artificial Sequence
  Description of Artificial Sequence: Synthetic peptide
NYDIN

SEQ ID NO: 6491 - DNA, 15 bp, Artificial Sequence
  Description of Artificial Sequence: Synthetic oligonucleotide
agctctgccatgagc

SEQ ID NO: 6492 - protein, 5 aa, Artificial Sequence
  Description of Artificial Sequence: Synthetic peptide
SSAMS

SEQ ID NO: 6493 - DNA, 15 bp, Artificial Sequence
  Description of Artificial Sequence: Synthetic oligonucleotide
gactatgtcatgcac

SEQ ID NO: 6494 - protein, 5 aa, Artificial Sequence
  Description of Artificial Sequence: Synthetic peptide
DYVMH

SEQ ID NO: 6495 - DNA, 15 bp, Artificial Sequence
  Description of Artificial Sequence: Synthetic oligonucleotide
acctatggcatgcac

SEQ ID NO: 6496 - protein, 5 aa, Artificial Sequence
  Description of Artificial Sequence: Synthetic peptide
TYGMH

SEQ ID NO: 6497 - DNA, 15 bp, Artificial Sequence
  Description of Artificial Sequence: Synthetic oligonucleotide
ggctactttatgcac

SEQ ID NO: 6498 - protein, 5 aa, Artificial Sequence
  Description of Artificial Sequence: Synthetic peptide
GYFMH

SEQ ID NO: 6499 - DNA, 15 bp, Artificial Sequence
  Description of Artificial Sequence: Synthetic oligonucleotide
agctatgtcatgagc

SEQ ID NO: 6500 - protein, 5 aa, Artificial Sequence
  Description of Artificial Sequence: Synthetic peptide
SYVMS

SEQ ID NO: 6501 - DNA, 15 bp, Artificial Sequence
  Description of Artificial Sequence: Synthetic oligonucleotide
agctatgccatgagc

SEQ ID NO: 6502 - protein, 5 aa, Artificial Sequence
  Description of Artificial Sequence: Synthetic peptide
SYAMS

SEQ ID NO: 6503 - DNA, 15 bp, Artificial Sequence
  Description of Artificial Sequence: Synthetic oligonucleotide
aattatgatctcaac

SEQ ID NO: 6504 - protein, 5 aa, Artificial Sequence
  Description of Artificial Sequence: Synthetic peptide
NYDLN

SEQ ID NO: 6505 - DNA, 15 bp, Artificial Sequence
  Description of Artificial Sequence: Synthetic oligonucleotide
agctatgccatgagc

SEQ ID NO: 6506 - protein, 5 aa, Artificial Sequence
  Description of Artificial Sequence: Synthetic peptide
SYAMS

SEQ ID NO: 6507 - DNA, 15 bp, Artificial Sequence
  Description of Artificial Sequence: Synthetic oligonucleotide
agctatggcatgcac

SEQ ID NO: 6508 - protein, 5 aa, Artificial Sequence
  Description of Artificial Sequence: Synthetic peptide
SYGMH

SEQ ID NO: 6509 - DNA, 15 bp, Artificial Sequence
  Description of Artificial Sequence: Synthetic oligonucleotide
ggccatagtatgaac

SEQ ID NO: 6510 - protein, 5 aa, Artificial Sequence
  Description of Artificial Sequence: Synthetic peptide
GHSMN

SEQ ID NO: 6511 - DNA, 15 bp, Artificial Sequence
  Description of Artificial Sequence: Synthetic oligonucleotide
acctatggcatgcac

SEQ ID NO: 6512 - protein, 5 aa, Artificial Sequence
  Description of Artificial Sequence: Synthetic peptide
TYGMH

SEQ ID NO: 6513 - DNA, 15 bp, Artificial Sequence
  Description of Artificial Sequence: Synthetic oligonucleotide
gactatgtcatgcac

SEQ ID NO: 6514 - protein, 5 aa, Artificial Sequence
  Description of Artificial Sequence: Synthetic peptide
DYVMH

SEQ ID NO: 6515 - DNA, 15 bp, Artificial Sequence
  Description of Artificial Sequence: Synthetic oligonucleotide
agctatgtcatgaac

SEQ ID NO: 6516 - protein, 5 aa, Artificial Sequence
  Description of Artificial Sequence: Synthetic peptide
SYVMN

SEQ ID NO: 6517 - DNA, 15 bp, Artificial Sequence
  Description of Artificial Sequence: Synthetic oligonucleotide
gattatgtcatgcac

SEQ ID NO: 6518 - protein, 5 aa, Artificial Sequence
  Description of Artificial Sequence: Synthetic peptide
DYVMH

SEQ ID NO: 6519 - DNA, 15 bp, Artificial Sequence
  Description of Artificial Sequence: Synthetic oligonucleotide
agttatgccatgagc

SEQ ID NO: 6520 - protein, 5 aa, Artificial Sequence
  Description of Artificial Sequence: Synthetic peptide
SYAMS

SEQ ID NO: 6521 - DNA, 15 bp, Artificial Sequence
  Description of Artificial Sequence: Synthetic oligonucleotide
agctatggcatgcac

SEQ ID NO: 6522 - protein, 5 aa, Artificial Sequence
  Description of Artificial Sequence: Synthetic peptide
SYGMH

SEQ ID NO: 6523 - DNA, 15 bp, Artificial Sequence
  Description of Artificial Sequence: Synthetic oligonucleotide
aattatgatatcaac

SEQ ID NO: 6524 - protein, 5 aa, Artificial Sequence
  Description of Artificial Sequence: Synthetic peptide
NYDIN

SEQ ID NO: 6525 - DNA, 15 bp, Artificial Sequence
  Description of Artificial Sequence: Synthetic oligonucleotide
agctatgccatgacc

SEQ ID NO: 6526 - protein, 5 aa, Artificial Sequence
  Description of Artificial Sequence: Synthetic peptide
SYAMT

SEQ ID NO: 6527 - DNA, 15 bp, Artificial Sequence
  Description of Artificial Sequence: Synthetic oligonucleotide
agctatgccatgacc

SEQ ID NO: 6528 - protein, 5 aa, Artificial Sequence
  Description of Artificial Sequence: Synthetic peptide
SYAMT

SEQ ID NO: 6529 - DNA, 15 bp, Artificial Sequence
  Description of Artificial Sequence: Synthetic oligonucleotide
acctatggcatgcac

SEQ ID NO: 6530 - protein, 5 aa, Artificial Sequence
  Description of Artificial Sequence: Synthetic peptide
TYGMH

SEQ ID NO: 6531 - DNA, 15 bp, Artificial Sequence
  Description of Artificial Sequence: Synthetic oligonucleotide
acctatggcatgcac

SEQ ID NO: 6532 - protein, 5 aa, Artificial Sequence
  Description of Artificial Sequence: Synthetic peptide
TYGMH

SEQ ID NO: 6533 - DNA, 15 bp, Artificial Sequence
  Description of Artificial Sequence: Synthetic oligonucleotide
agctatgccatgacc

SEQ ID NO: 6534 - protein, 5 aa, Artificial Sequence
  Description of Artificial Sequence: Synthetic peptide
SYAMT

SEQ ID NO: 6535 - DNA, 15 bp, Artificial Sequence
  Description of Artificial Sequence: Synthetic oligonucleotide
agctatggcatgcac

SEQ ID NO: 6536 - protein, 5 aa, Artificial Sequence
  Description of Artificial Sequence: Synthetic peptide
SYGMH

SEQ ID NO: 6537 - DNA, 15 bp, Artificial Sequence
  Description of Artificial Sequence: Synthetic oligonucleotide
agctttgccatgaac

SEQ ID NO: 6538 - protein, 5 aa, Artificial Sequence
  Description of Artificial Sequence: Synthetic peptide
SFAMN

SEQ ID NO: 6539 - DNA, 15 bp, Artificial Sequence
  Description of Artificial Sequence: Synthetic oligonucleotide
gcctatggcatgcac

SEQ ID NO: 6540 - protein, 5 aa, Artificial Sequence
  Description of Artificial Sequence: Synthetic peptide
AYGMH

SEQ ID NO: 6541 - DNA, 15 bp, Artificial Sequence
  Description of Artificial Sequence: Synthetic oligonucleotide
gactatggcatgcac

SEQ ID NO: 6542 - protein, 5 aa, Artificial Sequence
  Description of Artificial Sequence: Synthetic peptide
DYGMH

SEQ ID NO: 6543 - DNA, 15 bp, Artificial Sequence
  Description of Artificial Sequence: Synthetic oligonucleotide
agctatggcatgcac

SEQ ID NO: 6544 - protein, 5 aa, Artificial Sequence
  Description of Artificial Sequence: Synthetic peptide
SYGMH

SEQ ID NO: 6545 - DNA, 15 bp, Artificial Sequence
  Description of Artificial Sequence: Synthetic oligonucleotide
agctatggcatgcac

SEQ ID NO: 6546 - protein, 5 aa, Artificial Sequence
  Description of Artificial Sequence: Synthetic peptide
SYGMH

SEQ ID NO: 6547 - DNA, 15 bp, Artificial Sequence
  Description of Artificial Sequence: Synthetic oligonucleotide
agctacaatatgcac

SEQ ID NO: 6548 - protein, 5 aa, Artificial Sequence
  Description of Artificial Sequence: Synthetic peptide
SYNMH

SEQ ID NO: 6549 - DNA, 15 bp, Artificial Sequence
  Description of Artificial Sequence: Synthetic oligonucleotide
agctatgccatgagt

SEQ ID NO: 6550 - protein, 5 aa, Artificial Sequence
  Description of Artificial Sequence: Synthetic peptide
SYAMS

SEQ ID NO: 6551 - DNA, 15 bp, Artificial Sequence
  Description of Artificial Sequence: Synthetic oligonucleotide
aattatgatatcaac

SEQ ID NO: 6552 - protein, 5 aa, Artificial Sequence
  Description of Artificial Sequence: Synthetic peptide
NYDIN

SEQ ID NO: 6553 - DNA, 15 bp, Artificial Sequence
  Description of Artificial Sequence: Synthetic oligonucleotide
gactatggcatgcac

SEQ ID NO: 6554 - protein, 5 aa, Artificial Sequence
  Description of Artificial Sequence: Synthetic peptide
DYGMH

SEQ ID NO: 6555 - DNA, 15 bp, Artificial Sequence
  Description of Artificial Sequence: Synthetic oligonucleotide
agctatggcatgcac

SEQ ID NO: 6556 - protein, 5 aa, Artificial Sequence
  Description of Artificial Sequence: Synthetic peptide
SYGMH

SEQ ID NO: 6557 - DNA, 15 bp, Artificial Sequence
  Description of Artificial Sequence: Synthetic oligonucleotide
agctatgccatgagt

SEQ ID NO: 6558 - protein, 5 aa, Artificial Sequence
  Description of Artificial Sequence: Synthetic peptide
SYAMS

SEQ ID NO: 6559 - DNA, 15 bp, Artificial Sequence
  Description of Artificial Sequence: Synthetic oligonucleotide
agctatggcatgcac

SEQ ID NO: 6560 - protein, 5 aa, Artificial Sequence
  Description of Artificial Sequence: Synthetic peptide
SYGMH

SEQ ID NO: 6561 - DNA, 15 bp, Artificial Sequence
  Description of Artificial Sequence: Synthetic oligonucleotide
agctatggcatgcac

SEQ ID NO: 6562 - protein, 5 aa, Artificial Sequence
  Description of Artificial Sequence: Synthetic peptide
SYGMH

SEQ ID NO: 6563 - DNA, 15 bp, Artificial Sequence
  Description of Artificial Sequence: Synthetic oligonucleotide
gactatagcatgaac

SEQ ID NO: 6564 - protein, 5 aa, Artificial Sequence
  Description of Artificial Sequence: Synthetic peptide
DYSMN

SEQ ID NO: 6565 - DNA, 15 bp, Artificial Sequence
  Description of Artificial Sequence: Synthetic oligonucleotide
aattactactggagc

SEQ ID NO: 6566 - protein, 5 aa, Artificial Sequence
  Description of Artificial Sequence: Synthetic peptide
NYYWS

SEQ ID NO: 6567 - DNA, 15 bp, Artificial Sequence
  Description of Artificial Sequence: Synthetic oligonucleotide
agctatggcatgcac

SEQ ID NO: 6568 - protein, 5 aa, Artificial Sequence
  Description of Artificial Sequence: Synthetic peptide
SYGMH

SEQ ID NO: 6569 - DNA, 15 bp, Artificial Sequence
  Description of Artificial Sequence: Synthetic oligonucleotide
aactatggcatgcac

SEQ ID NO: 6570 - protein, 5 aa, Artificial Sequence
  Description of Artificial Sequence: Synthetic peptide
NYGMH

SEQ ID NO: 6571 - DNA, 15 bp, Artificial Sequence
  Description of Artificial Sequence: Synthetic oligonucleotide
agctatgccatgaac

SEQ ID NO: 6572 - protein, 5 aa, Artificial Sequence
  Description of Artificial Sequence: Synthetic peptide
SYAMN

SEQ ID NO: 6573 - DNA, 15 bp, Artificial Sequence
  Description of Artificial Sequence: Synthetic oligonucleotide
atttatggcatgcac

SEQ ID NO: 6574 - protein, 5 aa, Artificial Sequence
  Description of Artificial Sequence: Synthetic peptide
IYGMH

SEQ ID NO: 6575 - DNA, 15 bp, Artificial Sequence
  Description of Artificial Sequence: Synthetic oligonucleotide
agctaccactggagc

SEQ ID NO: 6576 - protein, 5 aa, Artificial Sequence
  Description of Artificial Sequence: Synthetic peptide
SYHWS

SEQ ID NO: 6577 - DNA, 21 bp, Artificial Sequence
  Description of Artificial Sequence: Synthetic oligonucleotide
agtggtggttactactggaac

SEQ ID NO: 6578 - protein, 7 aa, Artificial Sequence
  Description of Artificial Sequence: Synthetic peptide
SGGYYWN

SEQ ID NO: 6579 - DNA, 15 bp, Artificial Sequence
  Description of Artificial Sequence: Synthetic oligonucleotide
agctatggcatgcac

SEQ ID NO: 6580 - protein, 5 aa, Artificial Sequence
  Description of Artificial Sequence: Synthetic peptide
SYGMH

SEQ ID NO: 6581 - DNA, 15 bp, Artificial Sequence
  Description of Artificial Sequence: Synthetic oligonucleotide
agctatgccatgagc

SEQ ID NO: 6582 - protein, 5 aa, Artificial Sequence
  Description of Artificial Sequence: Synthetic peptide
SYAMS

SEQ ID NO: 6583 - DNA, 15 bp, Artificial Sequence
  Description of Artificial Sequence: Synthetic oligonucleotide
aactatggcatgcac

SEQ ID NO: 6584 - protein, 5 aa, Artificial Sequence
  Description of Artificial Sequence: Synthetic peptide
NYGMH

SEQ ID NO: 6585 - DNA, 15 bp, Artificial Sequence
  Description of Artificial Sequence: Synthetic oligonucleotide
acctatggcatgcac

SEQ ID NO: 6586 - protein, 5 aa, Artificial Sequence
  Description of Artificial Sequence: Synthetic peptide
TYGMH

SEQ ID NO: 6587 - DNA, 15 bp, Artificial Sequence
  Description of Artificial Sequence: Synthetic oligonucleotide
agttatcactggagc

SEQ ID NO: 6588 - protein, 5 aa, Artificial Sequence
  Description of Artificial Sequence: Synthetic peptide
SYHWS

SEQ ID NO: 6589 - DNA, 15 bp, Artificial Sequence
  Description of Artificial Sequence: Synthetic oligonucleotide
aattatgatatcaac

SEQ ID NO: 6590 - protein, 5 aa, Artificial Sequence
  Description of Artificial Sequence: Synthetic peptide
NYDIN

SEQ ID NO: 6591 - DNA, 21 bp, Artificial Sequence
  Description of Artificial Sequence: Synthetic oligonucleotide
agtggtggttactactggaac

SEQ ID NO: 6592 - protein, 7 aa, Artificial Sequence
  Description of Artificial Sequence: Synthetic peptide
SGGYYWN

SEQ ID NO: 6593 - DNA, 15 bp, Artificial Sequence
  Description of Artificial Sequence: Synthetic oligonucleotide
agctatggcatgcac

SEQ ID NO: 6594 - protein, 5 aa, Artificial Sequence
  Description of Artificial Sequence: Synthetic peptide
SYGMH

SEQ ID NO: 6595 - DNA, 21 bp, Artificial Sequence
  Description of Artificial Sequence: Synthetic oligonucleotide
agtggtgattactactggaac

SEQ ID NO: 6596 - protein, 7 aa, Artificial Sequence
  Description of Artificial Sequence: Synthetic peptide
SGDYYWN

SEQ ID NO: 6597 - DNA, 21 bp, Artificial Sequence
  Description of Artificial Sequence: Synthetic oligonucleotide
agtggtgattactactggaac

SEQ ID NO: 6598 - protein, 7 aa, Artificial Sequence
  Description of Artificial Sequence: Synthetic peptide
SGDYYWN

SEQ ID NO: 6599 - DNA, 21 bp, Artificial Sequence
  Description of Artificial Sequence: Synthetic oligonucleotide
agtggtgattactactggaac

SEQ ID NO: 6600 - protein, 7 aa, Artificial Sequence
  Description of Artificial Sequence: Synthetic peptide
SGDYYWN

SEQ ID NO: 6601 - DNA, 15 bp, Artificial Sequence
  Description of Artificial Sequence: Synthetic oligonucleotide
agctaccactggagc

SEQ ID NO: 6602 - protein, 5 aa, Artificial Sequence
  Description of Artificial Sequence: Synthetic peptide
SYHWS

SEQ ID NO: 6603 - DNA, 15 bp, Artificial Sequence
  Description of Artificial Sequence: Synthetic oligonucleotide
aattatgatatcaac

SEQ ID NO: 6604 - protein, 5 aa, Artificial Sequence
  Description of Artificial Sequence: Synthetic peptide
NYDIN

SEQ ID NO: 6605 - DNA, 15 bp, Artificial Sequence
  Description of Artificial Sequence: Synthetic oligonucleotide
agctatggcatgcac

SEQ ID NO: 6606 - protein, 5 aa, Artificial Sequence
  Description of Artificial Sequence: Synthetic peptide
SYGMH

SEQ ID NO: 6607 - DNA, 15 bp, Artificial Sequence
  Description of Artificial Sequence: Synthetic oligonucleotide
agctatggcatgcac

SEQ ID NO: 6608 - protein, 5 aa, Artificial Sequence
  Description of Artificial Sequence: Synthetic peptide
SYGMH

SEQ ID NO: 6609 - DNA, 15 bp, Artificial Sequence
  Description of Artificial Sequence: Synthetic oligonucleotide
agttatggcatgcac

SEQ ID NO: 6610 - protein, 5 aa, Artificial Sequence
  Description of Artificial Sequence: Synthetic peptide
SYGMH

SEQ ID NO: 6611 - DNA, 21 bp, Artificial Sequence
  Description of Artificial Sequence: Synthetic oligonucleotide
agtggtggttactactggaac

SEQ ID NO: 6612 - protein, 7 aa, Artificial Sequence
  Description of Artificial Sequence: Synthetic peptide
SGGYYWN

SEQ ID NO: 6613 - DNA, 15 bp, Artificial Sequence
  Description of Artificial Sequence: Synthetic oligonucleotide
gactatagcatgaac

SEQ ID NO: 6614 - protein, 5 aa, Artificial Sequence
  Description of Artificial Sequence: Synthetic peptide
DYSMN

SEQ ID NO: 6615 - DNA, 15 bp, Artificial Sequence
  Description of Artificial Sequence: Synthetic oligonucleotide
agctatgccatgaac

SEQ ID NO: 6616 - protein, 5 aa, Artificial Sequence
  Description of Artificial Sequence: Synthetic peptide
SYAMN

SEQ ID NO: 6617 - DNA, 15 bp, Artificial Sequence
  Description of Artificial Sequence: Synthetic oligonucleotide
agctatggcatgcac

SEQ ID NO: 6618 - protein, 5 aa, Artificial Sequence
  Description of Artificial Sequence: Synthetic peptide
SYGMH

SEQ ID NO: 6619 - DNA, 15 bp, Artificial Sequence
  Description of Artificial Sequence: Synthetic oligonucleotide
agctaccactggagc

SEQ ID NO: 6620 - protein, 5 aa, Artificial Sequence
  Description of Artificial Sequence: Synthetic peptide
SYHWS

SEQ ID NO: 6621 - DNA, 15 bp, Artificial Sequence
  Description of Artificial Sequence: Synthetic oligonucleotide
agctatggcatgcac

SEQ ID NO: 6622 - protein, 5 aa, Artificial Sequence
  Description of Artificial Sequence: Synthetic peptide
SYGMH

SEQ ID NO: 6623 - DNA, 15 bp, Artificial Sequence
  Description of Artificial Sequence: Synthetic oligonucleotide
acctatgccatgagt

SEQ ID NO: 6624 - protein, 5 aa, Artificial Sequence
  Description of Artificial Sequence: Synthetic peptide
TYAMS

SEQ ID NO: 6625 - DNA, 15 bp, Artificial Sequence
  Description of Artificial Sequence: Synthetic oligonucleotide
agctacaatatgcac

SEQ ID NO: 6626 - protein, 5 aa, Artificial Sequence
  Description of Artificial Sequence: Synthetic peptide
SYNMH

SEQ ID NO: 6627 - DNA, 15 bp, Artificial Sequence
  Description of Artificial Sequence: Synthetic oligonucleotide
gactatggcatgcac

SEQ ID NO: 6628 - protein, 5 aa, Artificial Sequence
  Description of Artificial Sequence: Synthetic peptide
DYGMH

SEQ ID NO: 6629 - DNA, 15 bp, Artificial Sequence
  Description of Artificial Sequence: Synthetic oligonucleotide
gactatggcatgcac

SEQ ID NO: 6630 - protein, 5 aa, Artificial Sequence
  Description of Artificial Sequence: Synthetic peptide
DYGMH

SEQ ID NO: 6631 - DNA, 15 bp, Artificial Sequence
  Description of Artificial Sequence: Synthetic oligonucleotide
agctatagcatgaac

SEQ ID NO: 6632 - protein, 5 aa, Artificial Sequence
  Description of Artificial Sequence: Synthetic peptide
SYSMN

SEQ ID NO: 6633 - DNA, 15 bp, Artificial Sequence
  Description of Artificial Sequence: Synthetic oligonucleotide
agctacaatatgcac

SEQ ID NO: 6634 - protein, 5 aa, Artificial Sequence
  Description of Artificial Sequence: Synthetic peptide
SYNMH

SEQ ID NO: 6635 - DNA, 15 bp, Artificial Sequence
  Description of Artificial Sequence: Synthetic oligonucleotide
acctatggcatgcac

SEQ ID NO: 6636 - protein, 5 aa, Artificial Sequence
  Description of Artificial Sequence: Synthetic peptide
TYGMH

SEQ ID NO: 6637 - DNA, 15 bp, Artificial Sequence
  Description of Artificial Sequence: Synthetic oligonucleotide
agctatgccatgagt

SEQ ID NO: 6638 - protein, 5 aa, Artificial Sequence
  Description of Artificial Sequence: Synthetic peptide
SYAMS

SEQ ID NO: 6639 - DNA, 15 bp, Artificial Sequence
  Description of Artificial Sequence: Synthetic oligonucleotide
agctacaatatgcac

SEQ ID NO: 6640 - protein, 5 aa, Artificial Sequence
  Description of Artificial Sequence: Synthetic peptide
SYNMH

SEQ ID NO: 6641 - DNA, 15 bp, Artificial Sequence
  Description of Artificial Sequence: Synthetic oligonucleotide
agctctgccatgaac

SEQ ID NO: 6642 - protein, 5 aa, Artificial Sequence
  Description of Artificial Sequence: Synthetic peptide
SSAMN

SEQ ID NO: 6643 - DNA, 15 bp, Artificial Sequence
  Description of Artificial Sequence: Synthetic oligonucleotide
agctacaatatgcac

SEQ ID NO: 6644 - protein, 5 aa, Artificial Sequence
  Description of Artificial Sequence: Synthetic peptide
SYNMH

SEQ ID NO: 6645 - DNA, 15 bp, Artificial Sequence
  Description of Artificial Sequence: Synthetic oligonucleotide
agttatggcatgcac

SEQ ID NO: 6646 - protein, 5 aa, Artificial Sequence
  Description of Artificial Sequence: Synthetic peptide
SYGMH

SEQ ID NO: 6647 - DNA, 15 bp, Artificial Sequence
  Description of Artificial Sequence: Synthetic oligonucleotide
aactatggcatgcac

SEQ ID NO: 6648 - protein, 5 aa, Artificial Sequence
  Description of Artificial Sequence: Synthetic peptide
NYGMH

SEQ ID NO: 6649 - DNA, 15 bp, Artificial Sequence
  Description of Artificial Sequence: Synthetic oligonucleotide
gactactacatgagc

SEQ ID NO: 6650 - protein, 5 aa, Artificial Sequence
  Description of Artificial Sequence: Synthetic peptide
DYYMS

SEQ ID NO: 6651 - DNA, 21 bp, Artificial Sequence
  Description of Artificial Sequence: Synthetic oligonucleotide
agtggtggttactactggaac

SEQ ID NO: 6652 - protein, 7 aa, Artificial Sequence
  Description of Artificial Sequence: Synthetic peptide
SGGYYWN

SEQ ID NO: 6653 - DNA, 15 bp, Artificial Sequence
  Description of Artificial Sequence: Synthetic oligonucleotide
agctatggcatgcac

SEQ ID NO: 6654 - protein, 5 aa, Artificial Sequence
  Description of Artificial Sequence: Synthetic peptide
SYGMH

SEQ ID NO: 6655 - DNA, 15 bp, Artificial Sequence
  Description of Artificial Sequence: Synthetic oligonucleotide
agctatgccatgagc

SEQ ID NO: 6656 - protein, 5 aa, Artificial Sequence
  Description of Artificial Sequence: Synthetic peptide
SYAMS

SEQ ID NO: 6657 - DNA, 21 bp, Artificial Sequence
  Description of Artificial Sequence: Synthetic oligonucleotide
agtggtgattactactggaac

SEQ ID NO: 6658 - protein, 7 aa, Artificial Sequence
  Description of Artificial Sequence: Synthetic peptide
SGDYYWN

SEQ ID NO: 6659 - DNA, 21 bp, Artificial Sequence
  Description of Artificial Sequence: Synthetic oligonucleotide
agtggtgtttactactggagc

SEQ ID NO: 6660 - protein, 7 aa, Artificial Sequence
  Description of Artificial Sequence: Synthetic peptide
SGVYYWS

SEQ ID NO: 6661 - DNA, 15 bp, Artificial Sequence
  Description of Artificial Sequence: Synthetic oligonucleotide
aattatgatatcaac

SEQ ID NO: 6662 - protein, 5 aa, Artificial Sequence
  Description of Artificial Sequence: Synthetic peptide
NYDIN

SEQ ID NO: 6663 - DNA, 15 bp, Artificial Sequence
  Description of Artificial Sequence: Synthetic oligonucleotide
aattactactggagc

SEQ ID NO: 6664 - protein, 5 aa, Artificial Sequence
  Description of Artificial Sequence: Synthetic peptide
NYYWS

SEQ ID NO: 6665 - DNA, 15 bp, Artificial Sequence
  Description of Artificial Sequence: Synthetic oligonucleotide
agctatggcatgcac

SEQ ID NO: 6666 - protein, 5 aa, Artificial Sequence
  Description of Artificial Sequence: Synthetic peptide
SYGMH

SEQ ID NO: 6667 - DNA, 15 bp, Artificial Sequence
  Description of Artificial Sequence: Synthetic oligonucleotide
agctttatcatgcac

SEQ ID NO: 6668 - protein, 5 aa, Artificial Sequence
  Description of Artificial Sequence: Synthetic peptide
SFIMH

SEQ ID NO: 6669 - DNA, 15 bp, Artificial Sequence
  Description of Artificial Sequence: Synthetic oligonucleotide
gactactacatgagc

SEQ ID NO: 6670 - protein, 5 aa, Artificial Sequence
  Description of Artificial Sequence: Synthetic peptide
DYYMS

SEQ ID NO: 6671 - DNA, 15 bp, Artificial Sequence
  Description of Artificial Sequence: Synthetic oligonucleotide
aattatgatatcaac

SEQ ID NO: 6672 - protein, 5 aa, Artificial Sequence
  Description of Artificial Sequence: Synthetic peptide
NYDIN

SEQ ID NO: 6673 - DNA, 15 bp, Artificial Sequence
  Description of Artificial Sequence: Synthetic oligonucleotide
agttaccactggagt

SEQ ID NO: 6674 - protein, 5 aa, Artificial Sequence
  Description of Artificial Sequence: Synthetic peptide
SYHWS

SEQ ID NO: 6675 - DNA, 15 bp, Artificial Sequence
  Description of Artificial Sequence: Synthetic oligonucleotide
agctatgccatgagt

SEQ ID NO: 6676 - protein, 5 aa, Artificial Sequence
  Description of Artificial Sequence: Synthetic peptide
SYAMS

SEQ ID NO: 6677 - DNA, 15 bp, Artificial Sequence
  Description of Artificial Sequence: Synthetic oligonucleotide
acttatggcatgcac

SEQ ID NO: 6678 - protein, 5 aa, Artificial Sequence
  Description of Artificial Sequence: Synthetic peptide
TYGMH

SEQ ID NO: 6679 - DNA, 15 bp, Artificial Sequence
  Description of Artificial Sequence: Synthetic oligonucleotide
agctatgccatgagc

SEQ ID NO: 6680 - protein, 5 aa, Artificial Sequence
  Description of Artificial Sequence: Synthetic peptide
SYAMS

SEQ ID NO: 6681 - DNA, 15 bp, Artificial Sequence
  Description of Artificial Sequence: Synthetic oligonucleotide
aactatggcatgcac

SEQ ID NO: 6682 - protein, 5 aa, Artificial Sequence
  Description of Artificial Sequence: Synthetic peptide
NYGMH

SEQ ID NO: 6683 - DNA, 21 bp, Artificial Sequence
  Description of Artificial Sequence: Synthetic oligonucleotide
agtggtgattactactggaac

SEQ ID NO: 6684 - protein, 7 aa, Artificial Sequence
  Description of Artificial Sequence: Synthetic peptide
SGDYYWN

SEQ ID NO: 6685 - DNA, 15 bp, Artificial Sequence
  Description of Artificial Sequence: Synthetic oligonucleotide
aactatggcatgcac

SEQ ID NO: 6686 - protein, 5 aa, Artificial Sequence
  Description of Artificial Sequence: Synthetic peptide
NYGMH

SEQ ID NO: 6687 - DNA, 21 bp, Artificial Sequence
  Description of Artificial Sequence: Synthetic oligonucleotide
agtggtggttactactggaac

SEQ ID NO: 6688 - protein, 7 aa, Artificial Sequence
  Description of Artificial Sequence: Synthetic peptide
SGGYYWN

SEQ ID NO: 6689 - DNA, 15 bp, Artificial Sequence
  Description of Artificial Sequence: Synthetic oligonucleotide
agctatggcatgcac

SEQ ID NO: 6690 - protein, 5 aa, Artificial Sequence
  Description of Artificial Sequence: Synthetic peptide
SYGMH

SEQ ID NO: 6691 - DNA, 15 bp, Artificial Sequence
  Description of Artificial Sequence: Synthetic oligonucleotide
agctatggcatgcac

SEQ ID NO: 6692 - protein, 5 aa, Artificial Sequence
  Description of Artificial Sequence: Synthetic peptide
SYGMH

SEQ ID NO: 6693 - DNA, 15 bp, Artificial Sequence
  Description of Artificial Sequence: Synthetic oligonucleotide
gactactacatgagc

SEQ ID NO: 6694 - protein, 5 aa, Artificial Sequence
  Description of Artificial Sequence: Synthetic peptide
DYYMS

SEQ ID NO: 6695 - DNA, 15 bp, Artificial Sequence
  Description of Artificial Sequence: Synthetic oligonucleotide
agctatggcatgcac

SEQ ID NO: 6696 - protein, 5 aa, Artificial Sequence
  Description of Artificial Sequence: Synthetic peptide
SYGMH

SEQ ID NO: 6697 - DNA, 15 bp, Artificial Sequence
  Description of Artificial Sequence: Synthetic oligonucleotide
agctatggcatgcac

SEQ ID NO: 6698 - protein, 5 aa, Artificial Sequence
  Description of Artificial Sequence: Synthetic peptide
SYGMH

SEQ ID NO: 6699 - DNA, 15 bp, Artificial Sequence
  Description of Artificial Sequence: Synthetic oligonucleotide
agctatggcatgcac

SEQ ID NO: 6700 - protein, 5 aa, Artificial Sequence
  Description of Artificial Sequence: Synthetic peptide
SYGMH

SEQ ID NO: 6701 - DNA, 15 bp, Artificial Sequence
  Description of Artificial Sequence: Synthetic oligonucleotide
agctctgccatgagc

SEQ ID NO: 6702 - protein, 5 aa, Artificial Sequence
  Description of Artificial Sequence: Synthetic peptide
SSAMS

SEQ ID NO: 6703 - DNA, 21 bp, Artificial Sequence
  Description of Artificial Sequence: Synthetic oligonucleotide
agtggtgattactactggaac

SEQ ID NO: 6704 - protein, 7 aa, Artificial Sequence
  Description of Artificial Sequence: Synthetic peptide
SGDYYWN

SEQ ID NO: 6705 - DNA, 15 bp, Artificial Sequence
  Description of Artificial Sequence: Synthetic oligonucleotide
agctatggcatgcac

SEQ ID NO: 6706 - protein, 5 aa, Artificial Sequence
  Description of Artificial Sequence: Synthetic peptide
SYGMH

SEQ ID NO: 6707 - DNA, 21 bp, Artificial Sequence
  Description of Artificial Sequence: Synthetic oligonucleotide
agtgttagttactactggagc

SEQ ID NO: 6708 - protein, 7 aa, Artificial Sequence
  Description of Artificial Sequence: Synthetic peptide
SVSYYWS

SEQ ID NO: 6709 - DNA, 15 bp, Artificial Sequence
  Description of Artificial Sequence: Synthetic oligonucleotide
agttatggcatgcac

SEQ ID NO: 6710 - protein, 5 aa, Artificial Sequence
  Description of Artificial Sequence: Synthetic peptide
SYGMH

SEQ ID NO: 6711 - DNA, 15 bp, Artificial Sequence
  Description of Artificial Sequence: Synthetic oligonucleotide
agctatggcatgcac

SEQ ID NO: 6712 - protein, 5 aa, Artificial Sequence
  Description of Artificial Sequence: Synthetic peptide
SYGMH

SEQ ID NO: 6713 - DNA, 21 bp, Artificial Sequence
  Description of Artificial Sequence: Synthetic oligonucleotide
aatggtggatactactggagc

SEQ ID NO: 6714 - protein, 7 aa, Artificial Sequence
  Description of Artificial Sequence: Synthetic peptide
NGGYYWS

SEQ ID NO: 6715 - DNA, 15 bp, Artificial Sequence
  Description of Artificial Sequence: Synthetic oligonucleotide
agctttatcatgcac

SEQ ID NO: 6716 - protein, 5 aa, Artificial Sequence
  Description of Artificial Sequence: Synthetic peptide
SFIMH

SEQ ID NO: 6717 - DNA, 15 bp, Artificial Sequence
  Description of Artificial Sequence: Synthetic oligonucleotide
agctatggcatgcac

SEQ ID NO: 6718 - protein, 5 aa, Artificial Sequence
  Description of Artificial Sequence: Synthetic peptide
SYGMH

SEQ ID NO: 6719 - DNA, 15 bp, Artificial Sequence
  Description of Artificial Sequence: Synthetic oligonucleotide
agctatggcatgcac

SEQ ID NO: 6720 - protein, 5 aa, Artificial Sequence
  Description of Artificial Sequence: Synthetic peptide
SYGMH

SEQ ID NO: 6721 - DNA, 15 bp, Artificial Sequence
  Description of Artificial Sequence: Synthetic oligonucleotide
agctatggcatgcac

SEQ ID NO: 6722 - protein, 5 aa, Artificial Sequence
  Description of Artificial Sequence: Synthetic peptide
SYGMH

SEQ ID NO: 6723 - DNA, 15 bp, Artificial Sequence
  Description of Artificial Sequence: Synthetic oligonucleotide
ggttgctactggagc

SEQ ID NO: 6724 - protein, 5 aa, Artificial Sequence
  Description of Artificial Sequence: Synthetic peptide
GCYWS

SEQ ID NO: 6725 - DNA, 15 bp, Artificial Sequence
  Description of Artificial Sequence: Synthetic oligonucleotide
agctatggcatgcac

SEQ ID NO: 6726 - protein, 5 aa, Artificial Sequence
  Description of Artificial Sequence: Synthetic peptide
SYGMH

SEQ ID NO: 6727 - DNA, 15 bp, Artificial Sequence
  Description of Artificial Sequence: Synthetic oligonucleotide
agctaccactggagc

SEQ ID NO: 6728 - protein, 5 aa, Artificial Sequence
  Description of Artificial Sequence: Synthetic peptide
SYHWS

SEQ ID NO: 6729 - DNA, 15 bp, Artificial Sequence
  Description of Artificial Sequence: Synthetic oligonucleotide
aactatggcatgcac

SEQ ID NO: 6730 - protein, 5 aa, Artificial Sequence
  Description of Artificial Sequence: Synthetic peptide
NYGMH

SEQ ID NO: 6731 - DNA, 15 bp, Artificial Sequence
  Description of Artificial Sequence: Synthetic oligonucleotide
agctatgccatgagc

SEQ ID NO: 6732 - protein, 5 aa, Artificial Sequence
  Description of Artificial Sequence: Synthetic peptide
SYAMS

SEQ ID NO: 6733 - DNA, 15 bp, Artificial Sequence
  Description of Artificial Sequence: Synthetic oligonucleotide
agctatggcatgcac

SEQ ID NO: 6734 - protein, 5 aa, Artificial Sequence
  Description of Artificial Sequence: Synthetic peptide
SYGMH

SEQ ID NO: 6735 - DNA, 21 bp, Artificial Sequence
  Description of Artificial Sequence: Synthetic oligonucleotide
agtggtgtttaccactggagc

SEQ ID NO: 6736 - protein, 7 aa, Artificial Sequence
  Description of Artificial Sequence: Synthetic peptide
SGVYHWS

SEQ ID NO: 6737 - DNA, 21 bp, Artificial Sequence
  Description of Artificial Sequence: Synthetic oligonucleotide
agtggtgtttactactggagc

SEQ ID NO: 6738 - protein, 7 aa, Artificial Sequence
  Description of Artificial Sequence: Synthetic peptide
SGVYYWS

SEQ ID NO: 6739 - DNA, 21 bp, Artificial Sequence
  Description of Artificial Sequence: Synthetic oligonucleotide
agtggtgtttactactggagc

SEQ ID NO: 6740 - protein, 7 aa, Artificial Sequence
  Description of Artificial Sequence: Synthetic peptide
SGVYYWS

SEQ ID NO: 6741 - DNA, 15 bp, Artificial Sequence
  Description of Artificial Sequence: Synthetic oligonucleotide
acctttgccatgagt

SEQ ID NO: 6742 - protein, 5 aa, Artificial Sequence
  Description of Artificial Sequence: Synthetic peptide
TFAMS

SEQ ID NO: 6743 - DNA, 21 bp, Artificial Sequence
  Description of Artificial Sequence: Synthetic oligonucleotide
agtggtgattactactggaac

SEQ ID NO: 6744 - protein, 7 aa, Artificial Sequence
  Description of Artificial Sequence: Synthetic peptide
SGDYYWN

SEQ ID NO: 6745 - DNA, 21 bp, Artificial Sequence
  Description of Artificial Sequence: Synthetic oligonucleotide
agtggtgattactactggaac

SEQ ID NO: 6746 - protein, 7 aa, Artificial Sequence
  Description of Artificial Sequence: Synthetic peptide
SGDYYWN

SEQ ID NO: 6747 - DNA, 15 bp, Artificial Sequence
  Description of Artificial Sequence: Synthetic oligonucleotide
agctatgccatgaac

SEQ ID NO: 6748 - protein, 5 aa, Artificial Sequence
  Description of Artificial Sequence: Synthetic peptide
SYAMN

SEQ ID NO: 6749 - DNA, 15 bp, Artificial Sequence
  Description of Artificial Sequence: Synthetic oligonucleotide
aattatgatatcaac

SEQ ID NO: 6750 - protein, 5 aa, Artificial Sequence
  Description of Artificial Sequence: Synthetic peptide
NYDIN

SEQ ID NO: 6751 - DNA, 15 bp, Artificial Sequence
  Description of Artificial Sequence: Synthetic oligonucleotide
agttatgatatcaac

SEQ ID NO: 6752 - protein, 5 aa, Artificial Sequence
  Description of Artificial Sequence: Synthetic peptide
SYDIN

SEQ ID NO: 6753 - DNA, 21 bp, Artificial Sequence
  Description of Artificial Sequence: Synthetic oligonucleotide
agtggtggttactactggagc

SEQ ID NO: 6754 - protein, 7 aa, Artificial Sequence
  Description of Artificial Sequence: Synthetic peptide
SGGYYWS

SEQ ID NO: 6755 - DNA, 15 bp, Artificial Sequence
  Description of Artificial Sequence: Synthetic oligonucleotide
ggtccctactggagt

SEQ ID NO: 6756 - protein, 5 aa, Artificial Sequence
  Description of Artificial Sequence: Synthetic peptide
GPYWS

SEQ ID NO: 6757 - DNA, 21 bp, Artificial Sequence
  Description of Artificial Sequence: Synthetic oligonucleotide
agtggtgattactactggaac

SEQ ID NO: 6758 - protein, 7 aa, Artificial Sequence
  Description of Artificial Sequence: Synthetic peptide
SGDYYWN

SEQ ID NO: 6759 - DNA, 15 bp, Artificial Sequence
  Description of Artificial Sequence: Synthetic oligonucleotide
agctatggcatgcac

SEQ ID NO: 6760 - protein, 5 aa, Artificial Sequence
  Description of Artificial Sequence: Synthetic peptide
SYGMH

SEQ ID NO: 6761 - DNA, 15 bp, Artificial Sequence
  Description of Artificial Sequence: Synthetic oligonucleotide
ggttacttctggacc

SEQ ID NO: 6762 - protein, 5 aa, Artificial Sequence
  Description of Artificial Sequence: Synthetic peptide
GYFWT

SEQ ID NO: 6763 - DNA, 21 bp, Artificial Sequence
  Description of Artificial Sequence: Synthetic oligonucleotide
agtggtgattactactggaac

SEQ ID NO: 6764 - protein, 7 aa, Artificial Sequence
  Description of Artificial Sequence: Synthetic peptide
SGDYYWN

SEQ ID NO: 6765 - DNA, 21 bp, Artificial Sequence
  Description of Artificial Sequence: Synthetic oligonucleotide
agtggtggttactactggaac

SEQ ID NO: 6766 - protein, 7 aa, Artificial Sequence
  Description of Artificial Sequence: Synthetic peptide
SGGYYWN

SEQ ID NO: 6767 - DNA, 15 bp, Artificial Sequence
  Description of Artificial Sequence: Synthetic oligonucleotide
atctatggcatggac

SEQ ID NO: 6768 - protein, 5 aa, Artificial Sequence
  Description of Artificial Sequence: Synthetic peptide
IYGMD

SEQ ID NO: 6769 - DNA, 21 bp, Artificial Sequence
  Description of Artificial Sequence: Synthetic oligonucleotide
agtggtgtttactactggagc

SEQ ID NO: 6770 - protein, 7 aa, Artificial Sequence
  Description of Artificial Sequence: Synthetic peptide
SGVYYWS

SEQ ID NO: 6771 - DNA, 21 bp, Artificial Sequence
  Description of Artificial Sequence: Synthetic oligonucleotide
aatggtggatactactggagc

SEQ ID NO: 6772 - protein, 7 aa, Artificial Sequence
  Description of Artificial Sequence: Synthetic peptide
NGGYYWS

SEQ ID NO: 6773 - DNA, 15 bp, Artificial Sequence
  Description of Artificial Sequence: Synthetic oligonucleotide
agctatggcatgcac

SEQ ID NO: 6774 - protein, 5 aa, Artificial Sequence
  Description of Artificial Sequence: Synthetic peptide
SYGMH

SEQ ID NO: 6775 - DNA, 15 bp, Artificial Sequence
  Description of Artificial Sequence: Synthetic oligonucleotide
gactatagcatgaac

SEQ ID NO: 6776 - protein, 5 aa, Artificial Sequence
  Description of Artificial Sequence: Synthetic peptide
DYSMN

SEQ ID NO: 6777 - DNA, 21 bp, Artificial Sequence
  Description of Artificial Sequence: Synthetic oligonucleotide
agtgctgattactactggaac

SEQ ID NO: 6778 - protein, 7 aa, Artificial Sequence
  Description of Artificial Sequence: Synthetic peptide
SADYYWN

SEQ ID NO: 6779 - DNA, 15 bp, Artificial Sequence
  Description of Artificial Sequence: Synthetic oligonucleotide
agctatgccatgcac

SEQ ID NO: 6780 - protein, 5 aa, Artificial Sequence
  Description of Artificial Sequence: Synthetic peptide
SYAMH

SEQ ID NO: 6781 - DNA, 15 bp, Artificial Sequence
  Description of Artificial Sequence: Synthetic oligonucleotide
agctatggcatgcac

SEQ ID NO: 6782 - protein, 5 aa, Artificial Sequence
  Description of Artificial Sequence: Synthetic peptide
SYGMH

SEQ ID NO: 6783 - DNA, 15 bp, Artificial Sequence
  Description of Artificial Sequence: Synthetic oligonucleotide
aattactactggagc

SEQ ID NO: 6784 - protein, 5 aa, Artificial Sequence
  Description of Artificial Sequence: Synthetic peptide
NYYWS

SEQ ID NO: 6785 - DNA, 15 bp, Artificial Sequence
  Description of Artificial Sequence: Synthetic oligonucleotide
gtctactatttgaac

SEQ ID NO: 6786 - protein, 5 aa, Artificial Sequence
  Description of Artificial Sequence: Synthetic peptide
VYYLN

SEQ ID NO: 6787 - DNA, 15 bp, Artificial Sequence
  Description of Artificial Sequence: Synthetic oligonucleotide
agttaccactggagc

SEQ ID NO: 6788 - protein, 5 aa, Artificial Sequence
  Description of Artificial Sequence: Synthetic peptide
SYHWS

SEQ ID NO: 6789 - DNA, 21 bp, Artificial Sequence
  Description of Artificial Sequence: Synthetic oligonucleotide
agtggtgattactactggaac

SEQ ID NO: 6790 - protein, 7 aa, Artificial Sequence
  Description of Artificial Sequence: Synthetic peptide
SGDYYWN

SEQ ID NO: 6791 - DNA, 21 bp, Artificial Sequence
  Description of Artificial Sequence: Synthetic oligonucleotide
agtggtgattactactggaac

SEQ ID NO: 6792 - protein, 7 aa, Artificial Sequence
  Description of Artificial Sequence: Synthetic peptide
SGDYYWN

SEQ ID NO: 6793 - DNA, 15 bp, Artificial Sequence
  Description of Artificial Sequence: Synthetic oligonucleotide
agctatggcatgcac

SEQ ID NO: 6794 - protein, 5 aa, Artificial Sequence
  Description of Artificial Sequence: Synthetic peptide
SYGMH

SEQ ID NO: 6795 - DNA, 15 bp, Artificial Sequence
  Description of Artificial Sequence: Synthetic oligonucleotide
gactactacatacac

SEQ ID NO: 6796 - protein, 5 aa, Artificial Sequence
  Description of Artificial Sequence: Synthetic peptide
DYYIH

SEQ ID NO: 6797 - DNA, 15 bp, Artificial Sequence
  Description of Artificial Sequence: Synthetic oligonucleotide
tattactactggagc

SEQ ID NO: 6798 - protein, 5 aa, Artificial Sequence
  Description of Artificial Sequence: Synthetic peptide
YYYWS

SEQ ID NO: 6799 - DNA, 15 bp, Artificial Sequence
  Description of Artificial Sequence: Synthetic oligonucleotide
agctttatcatgcac

SEQ ID NO: 6800 - protein, 5 aa, Artificial Sequence
  Description of Artificial Sequence: Synthetic peptide
SFIMH

SEQ ID NO: 6801 - DNA, 15 bp, Artificial Sequence
  Description of Artificial Sequence: Synthetic oligonucleotide
agctatggcatgcac

SEQ ID NO: 6802 - protein, 5 aa, Artificial Sequence
  Description of Artificial Sequence: Synthetic peptide
SYGMH

SEQ ID NO: 6803 - DNA, 15 bp, Artificial Sequence
  Description of Artificial Sequence: Synthetic oligonucleotide
aactatggcatgcac

SEQ ID NO: 6804 - protein, 5 aa, Artificial Sequence
  Description of Artificial Sequence: Synthetic peptide
NYGMH

SEQ ID NO: 6805 - DNA, 15 bp, Artificial Sequence
  Description of Artificial Sequence: Synthetic oligonucleotide
tattacttctggagc

SEQ ID NO: 6806 - protein, 5 aa, Artificial Sequence
  Description of Artificial Sequence: Synthetic peptide
YYFWS

SEQ ID NO: 6807 - DNA, 15 bp, Artificial Sequence
  Description of Artificial Sequence: Synthetic oligonucleotide
cactatgtcatgcac

SEQ ID NO: 6808 - protein, 5 aa, Artificial Sequence
  Description of Artificial Sequence: Synthetic peptide
HYVMH

SEQ ID NO: 6809 - DNA, 21 bp, Artificial Sequence
  Description of Artificial Sequence: Synthetic oligonucleotide
agcggtggttactactggagc

SEQ ID NO: 6810 - protein, 7 aa, Artificial Sequence
  Description of Artificial Sequence: Synthetic peptide
SGGYYWS

SEQ ID NO: 6811 - DNA, 15 bp, Artificial Sequence
  Description of Artificial Sequence: Synthetic oligonucleotide
agctatggcatgcac

SEQ ID NO: 6812 - protein, 5 aa, Artificial Sequence
  Description of Artificial Sequence: Synthetic peptide
SYGMH

SEQ ID NO: 6813 - DNA, 21 bp, Artificial Sequence
  Description of Artificial Sequence: Synthetic oligonucleotide
agtggtgattactactggaac

SEQ ID NO: 6814 - protein, 7 aa, Artificial Sequence
  Description of Artificial Sequence: Synthetic peptide
SGDYYWN

SEQ ID NO: 6815 - DNA, 15 bp, Artificial Sequence
  Description of Artificial Sequence: Synthetic oligonucleotide
agctatggcatgcac

SEQ ID NO: 6816 - protein, 5 aa, Artificial Sequence
  Description of Artificial Sequence: Synthetic peptide
SYGMH

SEQ ID NO: 6817 - DNA, 15 bp, Artificial Sequence
  Description of Artificial Sequence: Synthetic oligonucleotide
agctatggcatgcac

SEQ ID NO: 6818 - protein, 5 aa, Artificial Sequence
  Description of Artificial Sequence: Synthetic peptide
SYGMH

SEQ ID NO: 6819 - DNA, 21 bp, Artificial Sequence
  Description of Artificial Sequence: Synthetic oligonucleotide
aatagtggttactactggagc

SEQ ID NO: 6820 - protein, 7 aa, Artificial Sequence
  Description of Artificial Sequence: Synthetic peptide
NSGYYWS

SEQ ID NO: 6821 - DNA, 21 bp, Artificial Sequence
  Description of Artificial Sequence: Synthetic oligonucleotide
agtggtggttactactggagc

SEQ ID NO: 6822 - protein, 7 aa, Artificial Sequence
  Description of Artificial Sequence: Synthetic peptide
SGGYYWS

SEQ ID NO: 6823 - DNA, 15 bp, Artificial Sequence
  Description of Artificial Sequence: Synthetic oligonucleotide
gactactacatgagc

SEQ ID NO: 6824 - protein, 5 aa, Artificial Sequence
  Description of Artificial Sequence: Synthetic peptide
DYYMS

SEQ ID NO: 6825 - DNA, 15 bp, Artificial Sequence
  Description of Artificial Sequence: Synthetic oligonucleotide
acctatgccatgagt

SEQ ID NO: 6826 - protein, 5 aa, Artificial Sequence
  Description of Artificial Sequence: Synthetic peptide
TYAMS

SEQ ID NO: 6827 - DNA, 15 bp, Artificial Sequence
  Description of Artificial Sequence: Synthetic oligonucleotide
gactactacatgagc

SEQ ID NO: 6828 - protein, 5 aa, Artificial Sequence
  Description of Artificial Sequence: Synthetic peptide
DYYMS

SEQ ID NO: 6829 - DNA, 15 bp, Artificial Sequence
  Description of Artificial Sequence: Synthetic oligonucleotide
gactactacatgagc

SEQ ID NO: 6830 - protein, 5 aa, Artificial Sequence
  Description of Artificial Sequence: Synthetic peptide
DYYMS

SEQ ID NO: 6831 - DNA, 15 bp, Artificial Sequence
  Description of Artificial Sequence: Synthetic oligonucleotide
agctttggcatgcac

SEQ ID NO: 6832 - protein, 5 aa, Artificial Sequence
  Description of Artificial Sequence: Synthetic peptide
SFGMH

SEQ ID NO: 6833 - DNA, 15 bp, Artificial Sequence
  Description of Artificial Sequence: Synthetic oligonucleotide
agctgtgccatgacc

SEQ ID NO: 6834 - protein, 5 aa, Artificial Sequence
  Description of Artificial Sequence: Synthetic peptide
SCAMT

SEQ ID NO: 6835 - DNA, 15 bp, Artificial Sequence
  Description of Artificial Sequence: Synthetic oligonucleotide
agctatggcatgcac

SEQ ID NO: 6836 - protein, 5 aa, Artificial Sequence
  Description of Artificial Sequence: Synthetic peptide
SYGMH

SEQ ID NO: 6837 - DNA, 15 bp, Artificial Sequence
  Description of Artificial Sequence: Synthetic oligonucleotide
aattatgatatcaac

SEQ ID NO: 6838 - protein, 5 aa, Artificial Sequence
  Description of Artificial Sequence: Synthetic peptide
NYDIN

SEQ ID NO: 6839 - DNA, 15 bp, Artificial Sequence
  Description of Artificial Sequence: Synthetic oligonucleotide
ggctactatatgcac

SEQ ID NO: 6840 - protein, 5 aa, Artificial Sequence
  Description of Artificial Sequence: Synthetic peptide
GYYMH

SEQ ID NO: 6841 - DNA, 15 bp, Artificial Sequence
  Description of Artificial Sequence: Synthetic oligonucleotide
cactatgtcatgcac

SEQ ID NO: 6842 - protein, 5 aa, Artificial Sequence
  Description of Artificial Sequence: Synthetic peptide
HYVMH

SEQ ID NO: 6843 - DNA, 21 bp, Artificial Sequence
  Description of Artificial Sequence: Synthetic oligonucleotide
agtggtggtgactactggagc

SEQ ID NO: 6844 - protein, 7 aa, Artificial Sequence
  Description of Artificial Sequence: Synthetic peptide
SGGDYWS

SEQ ID NO: 6845 - DNA, 15 bp, Artificial Sequence
  Description of Artificial Sequence: Synthetic oligonucleotide
gactatagcatgaac

SEQ ID NO: 6846 - protein, 5 aa, Artificial Sequence
  Description of Artificial Sequence: Synthetic peptide
DYSMN

SEQ ID NO: 6847 - DNA, 15 bp, Artificial Sequence
  Description of Artificial Sequence: Synthetic oligonucleotide
agttatgatatcaac

SEQ ID NO: 6848 - protein, 5 aa, Artificial Sequence
  Description of Artificial Sequence: Synthetic peptide
SYDIN

SEQ ID NO: 6849 - DNA, 21 bp, Artificial Sequence
  Description of Artificial Sequence: Synthetic oligonucleotide
agtggtgtttactactggagc

SEQ ID NO: 6850 - protein, 7 aa, Artificial Sequence
  Description of Artificial Sequence: Synthetic peptide
SGVYYWS

SEQ ID NO: 6851 - DNA, 15 bp, Artificial Sequence
  Description of Artificial Sequence: Synthetic oligonucleotide
agctatggcatgcac

SEQ ID NO: 6852 - protein, 5 aa, Artificial Sequence
  Description of Artificial Sequence: Synthetic peptide
SYGMH

SEQ ID NO: 6853 - DNA, 15 bp, Artificial Sequence
  Description of Artificial Sequence: Synthetic oligonucleotide
agccatggcatgcac

SEQ ID NO: 6854 - protein, 5 aa, Artificial Sequence
  Description of Artificial Sequence: Synthetic peptide
SHGMH

SEQ ID NO: 6855 - DNA, 21 bp, Artificial Sequence
  Description of Artificial Sequence: Synthetic oligonucleotide
agtggtgattactactggaac

SEQ ID NO: 6856 - protein, 7 aa, Artificial Sequence
  Description of Artificial Sequence: Synthetic peptide
SGDYYWN

SEQ ID NO: 6857 - DNA, 15 bp, Artificial Sequence
  Description of Artificial Sequence: Synthetic oligonucleotide
aattatgatatcaac

SEQ ID NO: 6858 - protein, 5 aa, Artificial Sequence
  Description of Artificial Sequence: Synthetic peptide
NYDIN

SEQ ID NO: 6859 - DNA, 15 bp, Artificial Sequence
  Description of Artificial Sequence: Synthetic oligonucleotide
agctatggcatgcac

SEQ ID NO: 6860 - protein, 5 aa, Artificial Sequence
  Description of Artificial Sequence: Synthetic peptide
SYGMH

SEQ ID NO: 6861 - DNA, 15 bp, Artificial Sequence
  Description of Artificial Sequence: Synthetic oligonucleotide
aattatgatatcaac

SEQ ID NO: 6862 - protein, 5 aa, Artificial Sequence
  Description of Artificial Sequence: Synthetic peptide
NYDIN

SEQ ID NO: 6863 - DNA, 15 bp, Artificial Sequence
  Description of Artificial Sequence: Synthetic oligonucleotide
agctctgccatgacc

SEQ ID NO: 6864 - protein, 5 aa, Artificial Sequence
  Description of Artificial Sequence: Synthetic peptide
SSAMT

SEQ ID NO: 6865 - DNA, 15 bp, Artificial Sequence
  Description of Artificial Sequence: Synthetic oligonucleotide
gcttactcctggagc

SEQ ID NO: 6866 - protein, 5 aa, Artificial Sequence
  Description of Artificial Sequence: Synthetic peptide
AYSWS

SEQ ID NO: 6867 - DNA, 15 bp, Artificial Sequence
  Description of Artificial Sequence: Synthetic oligonucleotide
agctatgccatgagc

SEQ ID NO: 6868 - protein, 5 aa, Artificial Sequence
  Description of Artificial Sequence: Synthetic peptide
SYAMS

SEQ ID NO: 6869 - DNA, 15 bp, Artificial Sequence
  Description of Artificial Sequence: Synthetic oligonucleotide
agctatggcatgcac

SEQ ID NO: 6870 - protein, 5 aa, Artificial Sequence
  Description of Artificial Sequence: Synthetic peptide
SYGMH

SEQ ID NO: 6871 - DNA, 15 bp, Artificial Sequence
  Description of Artificial Sequence: Synthetic oligonucleotide
aactatggcatgcac

SEQ ID NO: 6872 - protein, 5 aa, Artificial Sequence
  Description of Artificial Sequence: Synthetic peptide
NYGMH

SEQ ID NO: 6873 - DNA, 15 bp, Artificial Sequence
  Description of Artificial Sequence: Synthetic oligonucleotide
agctatggcatgcac

SEQ ID NO: 6874 - protein, 5 aa, Artificial Sequence
  Description of Artificial Sequence: Synthetic peptide
SYGMH

SEQ ID NO: 6875 - DNA, 21 bp, Artificial Sequence
  Description of Artificial Sequence: Synthetic oligonucleotide
agtggtgattactactggaac

SEQ ID NO: 6876 - protein, 7 aa, Artificial Sequence
  Description of Artificial Sequence: Synthetic peptide
SGDYYWN

SEQ ID NO: 6877 - DNA, 21 bp, Artificial Sequence
  Description of Artificial Sequence: Synthetic oligonucleotide
agtggtggttactactggaac

SEQ ID NO: 6878 - protein, 7 aa, Artificial Sequence
  Description of Artificial Sequence: Synthetic peptide
SGGYYWN

SEQ ID NO: 6879 - DNA, 21 bp, Artificial Sequence
  Description of Artificial Sequence: Synthetic oligonucleotide
agtggtggttactactggagc

SEQ ID NO: 6880 - protein, 7 aa, Artificial Sequence
  Description of Artificial Sequence: Synthetic peptide
SGGYYWS

SEQ ID NO: 6881 - DNA, 15 bp, Artificial Sequence
  Description of Artificial Sequence: Synthetic oligonucleotide
agctatggcatgcac

SEQ ID NO: 6882 - protein, 5 aa, Artificial Sequence
  Description of Artificial Sequence: Synthetic peptide
SYGMH

SEQ ID NO: 6883 - DNA, 15 bp, Artificial Sequence
  Description of Artificial Sequence: Synthetic oligonucleotide
aactatggcatgcac

SEQ ID NO: 6884 - protein, 5 aa, Artificial Sequence
  Description of Artificial Sequence: Synthetic peptide
NYGMH

SEQ ID NO: 6885 - DNA, 15 bp, Artificial Sequence
  Description of Artificial Sequence: Synthetic oligonucleotide
agttaccactggagt

SEQ ID NO: 6886 - protein, 5 aa, Artificial Sequence
  Description of Artificial Sequence: Synthetic peptide
SYHWS

SEQ ID NO: 6887 - DNA, 21 bp, Artificial Sequence
  Description of Artificial Sequence: Synthetic oligonucleotide
agtggtgattactactggaac

SEQ ID NO: 6888 - protein, 7 aa, Artificial Sequence
  Description of Artificial Sequence: Synthetic peptide
SGDYYWN

SEQ ID NO: 6889 - DNA, 21 bp, Artificial Sequence
  Description of Artificial Sequence: Synthetic oligonucleotide
agtggtgattactactggaac

SEQ ID NO: 6890 - protein, 7 aa, Artificial Sequence
  Description of Artificial Sequence: Synthetic peptide
SGDYYWN

SEQ ID NO: 6891 - DNA, 15 bp, Artificial Sequence
  Description of Artificial Sequence: Synthetic oligonucleotide
ggttacttctggacc

SEQ ID NO: 6892 - protein, 5 aa, Artificial Sequence
  Description of Artificial Sequence: Synthetic peptide
GYFWT

SEQ ID NO: 6893 - DNA, 15 bp, Artificial Sequence
  Description of Artificial Sequence: Synthetic oligonucleotide
agctatggcatgcac

SEQ ID NO: 6894 - protein, 5 aa, Artificial Sequence
  Description of Artificial Sequence: Synthetic peptide
SYGMH

SEQ ID NO: 6895 - DNA, 15 bp, Artificial Sequence
  Description of Artificial Sequence: Synthetic oligonucleotide
aactatggcatgcac

SEQ ID NO: 6896 - protein, 5 aa, Artificial Sequence
  Description of Artificial Sequence: Synthetic peptide
NYGMH

SEQ ID NO: 6897 - DNA, 15 bp, Artificial Sequence
  Description of Artificial Sequence: Synthetic oligonucleotide
aactatggcatgcac

SEQ ID NO: 6898 - protein, 5 aa, Artificial Sequence
  Description of Artificial Sequence: Synthetic peptide
NYGMH

SEQ ID NO: 6899 - DNA, 21 bp, Artificial Sequence
  Description of Artificial Sequence: Synthetic oligonucleotide
agtggtggttactactggaac

SEQ ID NO: 6900 - protein, 7 aa, Artificial Sequence
  Description of Artificial Sequence: Synthetic peptide
SGGYYWN

SEQ ID NO: 6901 - DNA, 21 bp, Artificial Sequence
  Description of Artificial Sequence: Synthetic oligonucleotide
agtggtggttactactggagc

SEQ ID NO: 6902 - protein, 7 aa, Artificial Sequence
  Description of Artificial Sequence: Synthetic peptide
SGGYYWS

SEQ ID NO: 6903 - DNA, 15 bp, Artificial Sequence
  Description of Artificial Sequence: Synthetic oligonucleotide
agctatgccatgagc

SEQ ID NO: 6904 - protein, 5 aa, Artificial Sequence
  Description of Artificial Sequence: Synthetic peptide
SYAMS

SEQ ID NO: 6905 - DNA, 15 bp, Artificial Sequence
  Description of Artificial Sequence: Synthetic oligonucleotide
agttatggcatgcac

SEQ ID NO: 6906 - protein, 5 aa, Artificial Sequence
  Description of Artificial Sequence: Synthetic peptide
SYGMH

SEQ ID NO: 6907 - DNA, 21 bp, Artificial Sequence
  Description of Artificial Sequence: Synthetic oligonucleotide
agtggtggttactactggagc

SEQ ID NO: 6908 - protein, 7 aa, Artificial Sequence
  Description of Artificial Sequence: Synthetic peptide
SGGYYWS

SEQ ID NO: 6909 - DNA, 15 bp, Artificial Sequence
  Description of Artificial Sequence: Synthetic oligonucleotide
aattatgatatcaac

SEQ ID NO: 6910 - protein, 5 aa, Artificial Sequence
  Description of Artificial Sequence: Synthetic peptide
NYDIN

SEQ ID NO: 6911 - DNA, 15 bp, Artificial Sequence
  Description of Artificial Sequence: Synthetic oligonucleotide
aattactactggagc

SEQ ID NO: 6912 - protein, 5 aa, Artificial Sequence
  Description of Artificial Sequence: Synthetic peptide
NYYWS

SEQ ID NO: 6913 - DNA, 15 bp, Artificial Sequence
  Description of Artificial Sequence: Synthetic oligonucleotide
agctatggcatgcac

SEQ ID NO: 6914 - protein, 5 aa, Artificial Sequence
  Description of Artificial Sequence: Synthetic peptide
SYGMH

SEQ ID NO: 6915 - DNA, 21 bp, Artificial Sequence
  Description of Artificial Sequence: Synthetic oligonucleotide
agtggtgattactactggaac

SEQ ID NO: 6916 - protein, 7 aa, Artificial Sequence
  Description of Artificial Sequence: Synthetic peptide
SGDYYWN

SEQ ID NO: 6917 - DNA, 15 bp, Artificial Sequence
  Description of Artificial Sequence: Synthetic oligonucleotide
ggttacttctggacc

SEQ ID NO: 6918 - protein, 5 aa, Artificial Sequence
  Description of Artificial Sequence: Synthetic peptide
GYFWT

SEQ ID NO: 6919 - DNA, 15 bp, Artificial Sequence
  Description of Artificial Sequence: Synthetic oligonucleotide
ggttacttctggacc

SEQ ID NO: 6920 - protein, 5 aa, Artificial Sequence
  Description of Artificial Sequence: Synthetic peptide
GYFWT

SEQ ID NO: 6921 - DNA, 15 bp, Artificial Sequence
  Description of Artificial Sequence: Synthetic oligonucleotide
ccttactactggagc

SEQ ID NO: 6922 - protein, 5 aa, Artificial Sequence
  Description of Artificial Sequence: Synthetic peptide
PYYWS

SEQ ID NO: 6923 - DNA, 15 bp, Artificial Sequence
  Description of Artificial Sequence: Synthetic oligonucleotide
agctatggtatcagc

SEQ ID NO: 6924 - protein, 5 aa, Artificial Sequence
  Description of Artificial Sequence: Synthetic peptide
SYGIS

SEQ ID NO: 6925 - DNA, 21 bp, Artificial Sequence
  Description of Artificial Sequence: Synthetic oligonucleotide
agcaacagtgctgcttggaac

SEQ ID NO: 6926 - protein, 7 aa, Artificial Sequence
  Description of Artificial Sequence: Synthetic peptide
SNSAAWN

SEQ ID NO: 6927 - DNA, 15 bp, Artificial Sequence
  Description of Artificial Sequence: Synthetic oligonucleotide
gtttactactggacc

SEQ ID NO: 6928 - protein, 5 aa, Artificial Sequence
  Description of Artificial Sequence: Synthetic peptide
VYYWT

SEQ ID NO: 6929 - DNA, 15 bp, Artificial Sequence
  Description of Artificial Sequence: Synthetic oligonucleotide
ggctactatatgcac

SEQ ID NO: 6930 - protein, 5 aa, Artificial Sequence
  Description of Artificial Sequence: Synthetic peptide
GYYMH

SEQ ID NO: 6931 - DNA, 15 bp, Artificial Sequence
  Description of Artificial Sequence: Synthetic oligonucleotide
ggttacttctggacc

SEQ ID NO: 6932 - protein, 5 aa, Artificial Sequence
  Description of Artificial Sequence: Synthetic peptide
GYFWT

SEQ ID NO: 6933 - DNA, 15 bp, Artificial Sequence
  Description of Artificial Sequence: Synthetic oligonucleotide
ggctactatatccac

SEQ ID NO: 6934 - protein, 5 aa, Artificial Sequence
  Description of Artificial Sequence: Synthetic peptide
GYYIH

SEQ ID NO: 6935 - DNA, 15 bp, Artificial Sequence
  Description of Artificial Sequence: Synthetic oligonucleotide
agctatgccatgagc

SEQ ID NO: 6936 - protein, 5 aa, Artificial Sequence
  Description of Artificial Sequence: Synthetic peptide
SYAMS

SEQ ID NO: 6937 - DNA, 15 bp, Artificial Sequence
  Description of Artificial Sequence: Synthetic oligonucleotide
agttatgatatcaac

SEQ ID NO: 6938 - protein, 5 aa, Artificial Sequence
  Description of Artificial Sequence: Synthetic peptide
SYDIN

SEQ ID NO: 6939 - DNA, 21 bp, Artificial Sequence
  Description of Artificial Sequence: Synthetic oligonucleotide
agcaacagtgctgcttggaac

SEQ ID NO: 6940 - protein, 7 aa, Artificial Sequence
  Description of Artificial Sequence: Synthetic peptide
SNSAAWN

SEQ ID NO: 6941 - DNA, 21 bp, Artificial Sequence
  Description of Artificial Sequence: Synthetic oligonucleotide
agcaacagtgctgcttggaac

SEQ ID NO: 6942 - protein, 7 aa, Artificial Sequence
  Description of Artificial Sequence: Synthetic peptide
SNSAAWN

SEQ ID NO: 6943 - DNA, 15 bp, Artificial Sequence
  Description of Artificial Sequence: Synthetic oligonucleotide
agctatgccatgagc

SEQ ID NO: 6944 - protein, 5 aa, Artificial Sequence
  Description of Artificial Sequence: Synthetic peptide
SYAMS

SEQ ID NO: 6945 - DNA, 15 bp, Artificial Sequence
  Description of Artificial Sequence: Synthetic oligonucleotide
ccttactactggagc

SEQ ID NO: 6946 - protein, 5 aa, Artificial Sequence
  Description of Artificial Sequence: Synthetic peptide
PYYWS

SEQ ID NO: 6947 - DNA, 15 bp, Artificial Sequence
  Description of Artificial Sequence: Synthetic oligonucleotide
tactatggcatgcac

SEQ ID NO: 6948 - protein, 5 aa, Artificial Sequence
  Description of Artificial Sequence: Synthetic peptide
YYGMH

SEQ ID NO: 6949 - DNA, 15 bp, Artificial Sequence
  Description of Artificial Sequence: Synthetic oligonucleotide
agctatggcatgcac

SEQ ID NO: 6950 - protein, 5 aa, Artificial Sequence
  Description of Artificial Sequence: Synthetic peptide
SYGMH

SEQ ID NO: 6951 - DNA, 15 bp, Artificial Sequence
  Description of Artificial Sequence: Synthetic oligonucleotide
ggctactatatccac

SEQ ID NO: 6952 - protein, 5 aa, Artificial Sequence
  Description of Artificial Sequence: Synthetic peptide
GYYIH

SEQ ID NO: 6953 - DNA, 15 bp, Artificial Sequence
  Description of Artificial Sequence: Synthetic oligonucleotide
gactatgtcatgcac

SEQ ID NO: 6954 - protein, 5 aa, Artificial Sequence
  Description of Artificial Sequence: Synthetic peptide
DYVMH

SEQ ID NO: 6955 - DNA, 15 bp, Artificial Sequence
  Description of Artificial Sequence: Synthetic oligonucleotide
agttttggcatgcac

SEQ ID NO: 6956 - protein, 5 aa, Artificial Sequence
  Description of Artificial Sequence: Synthetic peptide
SFGMH

SEQ ID NO: 6957 - DNA, 15 bp, Artificial Sequence
  Description of Artificial Sequence: Synthetic oligonucleotide
gactactacatgagc

SEQ ID NO: 6958 - protein, 5 aa, Artificial Sequence
  Description of Artificial Sequence: Synthetic peptide
DYYMS

SEQ ID NO: 6959 - DNA, 15 bp, Artificial Sequence
  Description of Artificial Sequence: Synthetic oligonucleotide
aattatgatatcaac

SEQ ID NO: 6960 - protein, 5 aa, Artificial Sequence
  Description of Artificial Sequence: Synthetic peptide
NYDIN

SEQ ID NO: 6961 - DNA, 15 bp, Artificial Sequence
  Description of Artificial Sequence: Synthetic oligonucleotide
agctatgtcatgcac

SEQ ID NO: 6962 - protein, 5 aa, Artificial Sequence
  Description of Artificial Sequence: Synthetic peptide
SYVMH

SEQ ID NO: 6963 - DNA, 15 bp, Artificial Sequence
  Description of Artificial Sequence: Synthetic oligonucleotide
ggctactatatccac

SEQ ID NO: 6964 - protein, 5 aa, Artificial Sequence
  Description of Artificial Sequence: Synthetic peptide
GYYIH

SEQ ID NO: 6965 - DNA, 21 bp, Artificial Sequence
  Description of Artificial Sequence: Synthetic oligonucleotide
agcaacagtgctgcttggaac

SEQ ID NO: 6966 - protein, 7 aa, Artificial Sequence
  Description of Artificial Sequence: Synthetic peptide
SNSAAWN

SEQ ID NO: 6967 - DNA, 15 bp, Artificial Sequence
  Description of Artificial Sequence: Synthetic oligonucleotide
acctatgccatgagc

SEQ ID NO: 6968 - protein, 5 aa, Artificial Sequence
  Description of Artificial Sequence: Synthetic peptide
TYAMS

SEQ ID NO: 6969 - DNA, 15 bp, Artificial Sequence
  Description of Artificial Sequence: Synthetic oligonucleotide
agctatggcatgcac

SEQ ID NO: 6970 - protein, 5 aa, Artificial Sequence
  Description of Artificial Sequence: Synthetic peptide
SYGMH

SEQ ID NO: 6971 - DNA, 15 bp, Artificial Sequence
  Description of Artificial Sequence: Synthetic oligonucleotide
agctatggcatgcac

SEQ ID NO: 6972 - protein, 5 aa, Artificial Sequence
  Description of Artificial Sequence: Synthetic peptide
SYGMH

SEQ ID NO: 6973 - DNA, 15 bp, Artificial Sequence
  Description of Artificial Sequence: Synthetic oligonucleotide
ggttacttctggacc

SEQ ID NO: 6974 - protein, 5 aa, Artificial Sequence
  Description of Artificial Sequence: Synthetic peptide
GYFWT

SEQ ID NO: 6975 - DNA, 15 bp, Artificial Sequence
  Description of Artificial Sequence: Synthetic oligonucleotide
ggtcactactggagc

SEQ ID NO: 6976 - protein, 5 aa, Artificial Sequence
  Description of Artificial Sequence: Synthetic peptide
GHYWS

SEQ ID NO: 6977 - DNA, 15 bp, Artificial Sequence
  Description of Artificial Sequence: Synthetic oligonucleotide
agctatggcatgcac

SEQ ID NO: 6978 - protein, 5 aa, Artificial Sequence
  Description of Artificial Sequence: Synthetic peptide
SYGMH

SEQ ID NO: 6979 - DNA, 21 bp, Artificial Sequence
  Description of Artificial Sequence: Synthetic oligonucleotide
agcaacagtgctgcttggaac

SEQ ID NO: 6980 - protein, 7 aa, Artificial Sequence
  Description of Artificial Sequence: Synthetic peptide
SNSAAWN

SEQ ID NO: 6981 - DNA, 15 bp, Artificial Sequence
  Description of Artificial Sequence: Synthetic oligonucleotide
agatatggcatgcac

SEQ ID NO: 6982 - protein, 5 aa, Artificial Sequence
  Description of Artificial Sequence: Synthetic peptide
RYGMH

SEQ ID NO: 6983 - DNA, 15 bp, Artificial Sequence
  Description of Artificial Sequence: Synthetic oligonucleotide
gtttattactggagc

SEQ ID NO: 6984 - protein, 5 aa, Artificial Sequence
  Description of Artificial Sequence: Synthetic peptide
VYYWS

SEQ ID NO: 6985 - DNA, 15 bp, Artificial Sequence
  Description of Artificial Sequence: Synthetic oligonucleotide
agctatgccatgagc

SEQ ID NO: 6986 - protein, 5 aa, Artificial Sequence
  Description of Artificial Sequence: Synthetic peptide
SYAMS

SEQ ID NO: 6987 - DNA, 15 bp, Artificial Sequence
  Description of Artificial Sequence: Synthetic oligonucleotide
agctatgccatgcac

SEQ ID NO: 6988 - protein, 5 aa, Artificial Sequence
  Description of Artificial Sequence: Synthetic peptide
SYAMH

SEQ ID NO: 6989 - DNA, 15 bp, Artificial Sequence
  Description of Artificial Sequence: Synthetic oligonucleotide
ggttacttctggagc

SEQ ID NO: 6990 - protein, 5 aa, Artificial Sequence
  Description of Artificial Sequence: Synthetic peptide
GYFWS

SEQ ID NO: 6991 - DNA, 15 bp, Artificial Sequence
  Description of Artificial Sequence: Synthetic oligonucleotide
ggtccctactggagc

SEQ ID NO: 6992 - protein, 5 aa, Artificial Sequence
  Description of Artificial Sequence: Synthetic peptide
GPYWS

SEQ ID NO: 6993 - DNA, 15 bp, Artificial Sequence
  Description of Artificial Sequence: Synthetic oligonucleotide
ggctactatatccac

SEQ ID NO: 6994 - protein, 5 aa, Artificial Sequence
  Description of Artificial Sequence: Synthetic peptide
GYYIH

SEQ ID NO: 6995 - DNA, 15 bp, Artificial Sequence
  Description of Artificial Sequence: Synthetic oligonucleotide
ggctactatatacac

SEQ ID NO: 6996 - protein, 5 aa, Artificial Sequence
  Description of Artificial Sequence: Synthetic peptide
GYYIH

SEQ ID NO: 6997 - DNA, 15 bp, Artificial Sequence
  Description of Artificial Sequence: Synthetic oligonucleotide
ggctactatatccac

SEQ ID NO: 6998 - protein, 5 aa, Artificial Sequence
  Description of Artificial Sequence: Synthetic peptide
GYYIH

SEQ ID NO: 6999 - DNA, 15 bp, Artificial Sequence
  Description of Artificial Sequence: Synthetic oligonucleotide
agctatggcatgcac

SEQ ID NO: 7000 - protein, 5 aa, Artificial Sequence
  Description of Artificial Sequence: Synthetic peptide
SYGMH

SEQ ID NO: 7001 - DNA, 15 bp, Artificial Sequence
  Description of Artificial Sequence: Synthetic oligonucleotide
aactatggcatgcac

SEQ ID NO: 7002 - protein, 5 aa, Artificial Sequence
  Description of Artificial Sequence: Synthetic peptide
NYGMH

SEQ ID NO: 7003 - DNA, 15 bp, Artificial Sequence
  Description of Artificial Sequence: Synthetic oligonucleotide
gactgtgtcatgcac

SEQ ID NO: 7004 - protein, 5 aa, Artificial Sequence
  Description of Artificial Sequence: Synthetic peptide
DCVMH

SEQ ID NO: 7005 - DNA, 15 bp, Artificial Sequence
  Description of Artificial Sequence: Synthetic oligonucleotide
agctatgccatgagc

SEQ ID NO: 7006 - protein, 5 aa, Artificial Sequence
  Description of Artificial Sequence: Synthetic peptide
SYAMS

SEQ ID NO: 7007 - DNA, 15 bp, Artificial Sequence
  Description of Artificial Sequence: Synthetic oligonucleotide
gtttactactggacc

SEQ ID NO: 7008 - protein, 5 aa, Artificial Sequence
  Description of Artificial Sequence: Synthetic peptide
VYYWT

SEQ ID NO: 7009 - DNA, 15 bp, Artificial Sequence
  Description of Artificial Sequence: Synthetic oligonucleotide
ggctactatatccac

SEQ ID NO: 7010 - protein, 5 aa, Artificial Sequence
  Description of Artificial Sequence: Synthetic peptide
GYYIH

SEQ ID NO: 7011 - DNA, 15 bp, Artificial Sequence
  Description of Artificial Sequence: Synthetic oligonucleotide
gtttcctactggagc

SEQ ID NO: 7012 - protein, 5 aa, Artificial Sequence
  Description of Artificial Sequence: Synthetic peptide
VSYWS

SEQ ID NO: 7013 - DNA, 15 bp, Artificial Sequence
  Description of Artificial Sequence: Synthetic oligonucleotide
ggctactatatccac

SEQ ID NO: 7014 - protein, 5 aa, Artificial Sequence
  Description of Artificial Sequence: Synthetic peptide
GYYIH

SEQ ID NO: 7015 - DNA, 15 bp, Artificial Sequence
  Description of Artificial Sequence: Synthetic oligonucleotide
aactatggcatgcac

SEQ ID NO: 7016 - protein, 5 aa, Artificial Sequence
  Description of Artificial Sequence: Synthetic peptide
NYGMH

SEQ ID NO: 7017 - DNA, 15 bp, Artificial Sequence
  Description of Artificial Sequence: Synthetic oligonucleotide
gactgtgtcatgcac

SEQ ID NO: 7018 - protein, 5 aa, Artificial Sequence
  Description of Artificial Sequence: Synthetic peptide
DCVMH

SEQ ID NO: 7019 - DNA, 15 bp, Artificial Sequence
  Description of Artificial Sequence: Synthetic oligonucleotide
agttactactggagc

SEQ ID NO: 7020 - protein, 5 aa, Artificial Sequence
  Description of Artificial Sequence: Synthetic peptide
SYYWS

SEQ ID NO: 7021 - DNA, 21 bp, Artificial Sequence
  Description of Artificial Sequence: Synthetic oligonucleotide
agcaacagtgctgcttggaac

SEQ ID NO: 7022 - protein, 7 aa, Artificial Sequence
  Description of Artificial Sequence: Synthetic peptide
SNSAAWN

SEQ ID NO: 7023 - DNA, 15 bp, Artificial Sequence
  Description of Artificial Sequence: Synthetic oligonucleotide
ggctactatatccac

SEQ ID NO: 7024 - protein, 5 aa, Artificial Sequence
  Description of Artificial Sequence: Synthetic peptide
GYYIH

SEQ ID NO: 7025 - DNA, 15 bp, Artificial Sequence
  Description of Artificial Sequence: Synthetic oligonucleotide
agccatggcatgcac

SEQ ID NO: 7026 - protein, 5 aa, Artificial Sequence
  Description of Artificial Sequence: Synthetic peptide
SHGMH

SEQ ID NO: 7027 - DNA, 15 bp, Artificial Sequence
  Description of Artificial Sequence: Synthetic oligonucleotide
aacaatggtatcagc

SEQ ID NO: 7028 - protein, 5 aa, Artificial Sequence
  Description of Artificial Sequence: Synthetic peptide
NNGIS

SEQ ID NO: 7029 - DNA, 15 bp, Artificial Sequence
  Description of Artificial Sequence: Synthetic oligonucleotide
agctatggcatgcac

SEQ ID NO: 7030 - protein, 5 aa, Artificial Sequence
  Description of Artificial Sequence: Synthetic peptide
SYGMH

SEQ ID NO: 7031 - DNA, 15 bp, Artificial Sequence
  Description of Artificial Sequence: Synthetic oligonucleotide
agttatggcatgcac

SEQ ID NO: 7032 - protein, 5 aa, Artificial Sequence
  Description of Artificial Sequence: Synthetic peptide
SYGMH

SEQ ID NO: 7033 - DNA, 15 bp, Artificial Sequence
  Description of Artificial Sequence: Synthetic oligonucleotide
aactatggcatgcac

SEQ ID NO: 7034 - protein, 5 aa, Artificial Sequence
  Description of Artificial Sequence: Synthetic peptide
NYGMH

SEQ ID NO: 7035 - DNA, 15 bp, Artificial Sequence
  Description of Artificial Sequence: Synthetic oligonucleotide
agctatggcatgcac

SEQ ID NO: 7036 - protein, 5 aa, Artificial Sequence
  Description of Artificial Sequence: Synthetic peptide
SYGMH

SEQ ID NO: 7037 - DNA, 15 bp, Artificial Sequence
  Description of Artificial Sequence: Synthetic oligonucleotide
agctatggcatgcac

SEQ ID NO: 7038 - protein, 5 aa, Artificial Sequence
  Description of Artificial Sequence: Synthetic peptide
SYGMH

SEQ ID NO: 7039 - DNA, 15 bp, Artificial Sequence
  Description of Artificial Sequence: Synthetic oligonucleotide
aggcatggtatcagc

SEQ ID NO: 7040 - protein, 5 aa, Artificial Sequence
  Description of Artificial Sequence: Synthetic peptide
RHGIS

SEQ ID NO: 7041 - DNA, 15 bp, Artificial Sequence
  Description of Artificial Sequence: Synthetic oligonucleotide
agctatggcatgcac

SEQ ID NO: 7042 - protein, 5 aa, Artificial Sequence
  Description of Artificial Sequence: Synthetic peptide
SYGMH

SEQ ID NO: 7043 - DNA, 15 bp, Artificial Sequence
  Description of Artificial Sequence: Synthetic oligonucleotide
agctatggcatgcac

SEQ ID NO: 7044 - protein, 5 aa, Artificial Sequence
  Description of Artificial Sequence: Synthetic peptide
SYGMH

SEQ ID NO: 7045 - DNA, 15 bp, Artificial Sequence
  Description of Artificial Sequence: Synthetic oligonucleotide
agctatggcatgcac

SEQ ID NO: 7046 - protein, 5 aa, Artificial Sequence
  Description of Artificial Sequence: Synthetic peptide
SYGMH

SEQ ID NO: 7047 - DNA, 15 bp, Artificial Sequence
  Description of Artificial Sequence: Synthetic oligonucleotide
agctatggcatgcac

SEQ ID NO: 7048 - protein, 5 aa, Artificial Sequence
  Description of Artificial Sequence: Synthetic peptide
SYGMH

SEQ ID NO: 7049 - DNA, 15 bp, Artificial Sequence
  Description of Artificial Sequence: Synthetic oligonucleotide
agatatggcatgcac

SEQ ID NO: 7050 - protein, 5 aa, Artificial Sequence
  Description of Artificial Sequence: Synthetic peptide
RYGMH

SEQ ID NO: 7051 - DNA, 15 bp, Artificial Sequence
  Description of Artificial Sequence: Synthetic oligonucleotide
gactatgtcatgcac

SEQ ID NO: 7052 - protein, 5 aa, Artificial Sequence
  Description of Artificial Sequence: Synthetic peptide
DYVMH

SEQ ID NO: 7053 - DNA, 15 bp, Artificial Sequence
  Description of Artificial Sequence: Synthetic oligonucleotide
agttatggcatgcac

SEQ ID NO: 7054 - protein, 5 aa, Artificial Sequence
  Description of Artificial Sequence: Synthetic peptide
SYGMH

SEQ ID NO: 7055 - DNA, 15 bp, Artificial Sequence
  Description of Artificial Sequence: Synthetic oligonucleotide
agctatggcatgcac

SEQ ID NO: 7056 - protein, 5 aa, Artificial Sequence
  Description of Artificial Sequence: Synthetic peptide
SYGMH

SEQ ID NO: 7057 - DNA, 15 bp, Artificial Sequence
  Description of Artificial Sequence: Synthetic oligonucleotide
agctatggcatgcac

SEQ ID NO: 7058 - protein, 5 aa, Artificial Sequence
  Description of Artificial Sequence: Synthetic peptide
SYGMH

SEQ ID NO: 7059 - DNA, 15 bp, Artificial Sequence
  Description of Artificial Sequence: Synthetic oligonucleotide
agctatggcatgcac

SEQ ID NO: 7060 - protein, 5 aa, Artificial Sequence
  Description of Artificial Sequence: Synthetic peptide
SYGMH

SEQ ID NO: 7061 - DNA, 15 bp, Artificial Sequence
  Description of Artificial Sequence: Synthetic oligonucleotide
agttatggcatgcac

SEQ ID NO: 7062 - protein, 5 aa, Artificial Sequence
  Description of Artificial Sequence: Synthetic peptide
SYGMH

SEQ ID NO: 7063 - DNA, 15 bp, Artificial Sequence
  Description of Artificial Sequence: Synthetic oligonucleotide
agctatggcatgcac

SEQ ID NO: 7064 - protein, 5 aa, Artificial Sequence
  Description of Artificial Sequence: Synthetic peptide
SYGMH

SEQ ID NO: 7065 - DNA, 15 bp, Artificial Sequence
  Description of Artificial Sequence: Synthetic oligonucleotide
ggctaccatatgcac

SEQ ID NO: 7066 - protein, 5 aa, Artificial Sequence
  Description of Artificial Sequence: Synthetic peptide
GYHMH

SEQ ID NO: 7067 - DNA, 15 bp, Artificial Sequence
  Description of Artificial Sequence: Synthetic oligonucleotide
agctatggtatcaac

SEQ ID NO: 7068 - protein, 5 aa, Artificial Sequence
  Description of Artificial Sequence: Synthetic peptide
SYGIN

SEQ ID NO: 7069 - DNA, 15 bp, Artificial Sequence
  Description of Artificial Sequence: Synthetic oligonucleotide
agctatggcatgcac

SEQ ID NO: 7070 - protein, 5 aa, Artificial Sequence
  Description of Artificial Sequence: Synthetic peptide
SYGMH

SEQ ID NO: 7071 - DNA, 15 bp, Artificial Sequence
  Description of Artificial Sequence: Synthetic oligonucleotide
agctatggcatgcac

SEQ ID NO: 7072 - protein, 5 aa, Artificial Sequence
  Description of Artificial Sequence: Synthetic peptide
SYGMH

SEQ ID NO: 7073 - DNA, 15 bp, Artificial Sequence
  Description of Artificial Sequence: Synthetic oligonucleotide
ggccactatatacac

SEQ ID NO: 7074 - protein, 5 aa, Artificial Sequence
  Description of Artificial Sequence: Synthetic peptide
GHYIH

SEQ ID NO: 7075 - DNA, 15 bp, Artificial Sequence
  Description of Artificial Sequence: Synthetic oligonucleotide
agctatggcatgcac

SEQ ID NO: 7076 - protein, 5 aa, Artificial Sequence
  Description of Artificial Sequence: Synthetic peptide
SYGMH

SEQ ID NO: 7077 - DNA, 15 bp, Artificial Sequence
  Description of Artificial Sequence: Synthetic oligonucleotide
agctatgtcatgcac

SEQ ID NO: 7078 - protein, 5 aa, Artificial Sequence
  Description of Artificial Sequence: Synthetic peptide
SYVMH

SEQ ID NO: 7079 - DNA, 15 bp, Artificial Sequence
  Description of Artificial Sequence: Synthetic oligonucleotide
gactatgtcatgcac

SEQ ID NO: 7080 - protein, 5 aa, Artificial Sequence
  Description of Artificial Sequence: Synthetic peptide
DYVMH

SEQ ID NO: 7081 - DNA, 15 bp, Artificial Sequence
  Description of Artificial Sequence: Synthetic oligonucleotide
gactatgtcatgcac

SEQ ID NO: 7082 - protein, 5 aa, Artificial Sequence
  Description of Artificial Sequence: Synthetic peptide
DYVMH

SEQ ID NO: 7083 - DNA, 15 bp, Artificial Sequence
  Description of Artificial Sequence: Synthetic oligonucleotide
gactatgtcatacac

SEQ ID NO: 7084 - protein, 5 aa, Artificial Sequence
  Description of Artificial Sequence: Synthetic peptide
DYVIH

SEQ ID NO: 7085 - DNA, 15 bp, Artificial Sequence
  Description of Artificial Sequence: Synthetic oligonucleotide
agctatggcatgcac

SEQ ID NO: 7086 - protein, 5 aa, Artificial Sequence
  Description of Artificial Sequence: Synthetic peptide
SYGMH

SEQ ID NO: 7087 - DNA, 15 bp, Artificial Sequence
  Description of Artificial Sequence: Synthetic oligonucleotide
agctatggcatgcac

SEQ ID NO: 7088 - protein, 5 aa, Artificial Sequence
  Description of Artificial Sequence: Synthetic peptide
SYGMH

SEQ ID NO: 7089 - DNA, 15 bp, Artificial Sequence
  Description of Artificial Sequence: Synthetic oligonucleotide
ggccactatatacac

SEQ ID NO: 7090 - protein, 5 aa, Artificial Sequence
  Description of Artificial Sequence: Synthetic peptide
GHYIH

SEQ ID NO: 7091 - DNA, 15 bp, Artificial Sequence
  Description of Artificial Sequence: Synthetic oligonucleotide
tactatggcatgcac

SEQ ID NO: 7092 - protein, 5 aa, Artificial Sequence
  Description of Artificial Sequence: Synthetic peptide
YYGMH

SEQ ID NO: 7093 - DNA, 15 bp, Artificial Sequence
  Description of Artificial Sequence: Synthetic oligonucleotide
gactatgtcatgcac

SEQ ID NO: 7094 - protein, 5 aa, Artificial Sequence
  Description of Artificial Sequence: Synthetic peptide
DYVMH

SEQ ID NO: 7095 - DNA, 15 bp, Artificial Sequence
  Description of Artificial Sequence: Synthetic oligonucleotide
agctatggcatgcac

SEQ ID NO: 7096 - protein, 5 aa, Artificial Sequence
  Description of Artificial Sequence: Synthetic peptide
SYGMH

SEQ ID NO: 7097 - DNA, 15 bp, Artificial Sequence
  Description of Artificial Sequence: Synthetic oligonucleotide
aactatggcatgcac

SEQ ID NO: 7098 - protein, 5 aa, Artificial Sequence
  Description of Artificial Sequence: Synthetic peptide
NYGMH

SEQ ID NO: 7099 - DNA, 15 bp, Artificial Sequence
  Description of Artificial Sequence: Synthetic oligonucleotide
agctatggcatgcac

SEQ ID NO: 7100 - protein, 5 aa, Artificial Sequence
  Description of Artificial Sequence: Synthetic peptide
SYGMH

SEQ ID NO: 7101 - DNA, 15 bp, Artificial Sequence
  Description of Artificial Sequence: Synthetic oligonucleotide
agctatagcatgaac

SEQ ID NO: 7102 - protein, 5 aa, Artificial Sequence
  Description of Artificial Sequence: Synthetic peptide
SYSMN

SEQ ID NO: 7103 - DNA, 15 bp, Artificial Sequence
  Description of Artificial Sequence: Synthetic oligonucleotide
gactatgtcatgcac

SEQ ID NO: 7104 - protein, 5 aa, Artificial Sequence
  Description of Artificial Sequence: Synthetic peptide
DYVMH

SEQ ID NO: 7105 - DNA, 15 bp, Artificial Sequence
  Description of Artificial Sequence: Synthetic oligonucleotide
gactatgtcatgcac

SEQ ID NO: 7106 - protein, 5 aa, Artificial Sequence
  Description of Artificial Sequence: Synthetic peptide
DYVMH

SEQ ID NO: 7107 - DNA, 15 bp, Artificial Sequence
  Description of Artificial Sequence: Synthetic oligonucleotide
agctataatatgaac

SEQ ID NO: 7108 - protein, 5 aa, Artificial Sequence
  Description of Artificial Sequence: Synthetic peptide
SYNMN

SEQ ID NO: 7109 - DNA, 15 bp, Artificial Sequence
  Description of Artificial Sequence: Synthetic oligonucleotide
gactatgtcatgcac

SEQ ID NO: 7110 - protein, 5 aa, Artificial Sequence
  Description of Artificial Sequence: Synthetic peptide
DYVMH

SEQ ID NO: 7111 - DNA, 15 bp, Artificial Sequence
  Description of Artificial Sequence: Synthetic oligonucleotide
agcaatggcatgcac

SEQ ID NO: 7112 - protein, 5 aa, Artificial Sequence
  Description of Artificial Sequence: Synthetic peptide
SNGMH

SEQ ID NO: 7113 - DNA, 15 bp, Artificial Sequence
  Description of Artificial Sequence: Synthetic oligonucleotide
agttatggcatgcac

SEQ ID NO: 7114 - protein, 5 aa, Artificial Sequence
  Description of Artificial Sequence: Synthetic peptide
SYGMH

SEQ ID NO: 7115 - DNA, 15 bp, Artificial Sequence
  Description of Artificial Sequence: Synthetic oligonucleotide
gactatgtcatgcac

SEQ ID NO: 7116 - protein, 5 aa, Artificial Sequence
  Description of Artificial Sequence: Synthetic peptide
DYVMH

SEQ ID NO: 7117 - DNA, 15 bp, Artificial Sequence
  Description of Artificial Sequence: Synthetic oligonucleotide
gactatgtcatgcac

SEQ ID NO: 7118 - protein, 5 aa, Artificial Sequence
  Description of Artificial Sequence: Synthetic peptide
DYVMH

SEQ ID NO: 7119 - DNA, 15 bp, Artificial Sequence
  Description of Artificial Sequence: Synthetic oligonucleotide
gactatgtcatgcac

SEQ ID NO: 7120 - protein, 5 aa, Artificial Sequence
  Description of Artificial Sequence: Synthetic peptide
DYVMH

SEQ ID NO: 7121 - DNA, 15 bp, Artificial Sequence
  Description of Artificial Sequence: Synthetic oligonucleotide
agatatggcatgcac

SEQ ID NO: 7122 - protein, 5 aa, Artificial Sequence
  Description of Artificial Sequence: Synthetic peptide
RYGMH

SEQ ID NO: 7123 - DNA, 15 bp, Artificial Sequence
  Description of Artificial Sequence: Synthetic oligonucleotide
acttactactggagc

SEQ ID NO: 7124 - protein, 5 aa, Artificial Sequence
  Description of Artificial Sequence: Synthetic peptide
TYYWS

SEQ ID NO: 7125 - DNA, 15 bp, Artificial Sequence
  Description of Artificial Sequence: Synthetic oligonucleotide
gactatgtcatgcac

SEQ ID NO: 7126 - protein, 5 aa, Artificial Sequence
  Description of Artificial Sequence: Synthetic peptide
DYVMH

SEQ ID NO: 7127 - DNA, 15 bp, Artificial Sequence
  Description of Artificial Sequence: Synthetic oligonucleotide
ggctactatatgcac

SEQ ID NO: 7128 - protein, 5 aa, Artificial Sequence
  Description of Artificial Sequence: Synthetic peptide
GYYMH

SEQ ID NO: 7129 - DNA, 15 bp, Artificial Sequence
  Description of Artificial Sequence: Synthetic oligonucleotide
agcaatggcatgcac

SEQ ID NO: 7130 - protein, 5 aa, Artificial Sequence
  Description of Artificial Sequence: Synthetic peptide
SNGMH

SEQ ID NO: 7131 - DNA, 15 bp, Artificial Sequence
  Description of Artificial Sequence: Synthetic oligonucleotide
ggctactatatgcac

SEQ ID NO: 7132 - protein, 5 aa, Artificial Sequence
  Description of Artificial Sequence: Synthetic peptide
GYYMH

SEQ ID NO: 7133 - DNA, 15 bp, Artificial Sequence
  Description of Artificial Sequence: Synthetic oligonucleotide
agctatggtatcaac

SEQ ID NO: 7134 - protein, 5 aa, Artificial Sequence
  Description of Artificial Sequence: Synthetic peptide
SYGIN

SEQ ID NO: 7135 - DNA, 15 bp, Artificial Sequence
  Description of Artificial Sequence: Synthetic oligonucleotide
agctatggcatgcac

SEQ ID NO: 7136 - protein, 5 aa, Artificial Sequence
  Description of Artificial Sequence: Synthetic peptide
SYGMH

SEQ ID NO: 7137 - DNA, 15 bp, Artificial Sequence
  Description of Artificial Sequence: Synthetic oligonucleotide
aactttgccatgagt

SEQ ID NO: 7138 - protein, 5 aa, Artificial Sequence
  Description of Artificial Sequence: Synthetic peptide
NFAMS

SEQ ID NO: 7139 - DNA, 15 bp, Artificial Sequence
  Description of Artificial Sequence: Synthetic oligonucleotide
ggtcgctactggagc

SEQ ID NO: 7140 - protein, 5 aa, Artificial Sequence
  Description of Artificial Sequence: Synthetic peptide
GRYWS

SEQ ID NO: 7141 - DNA, 15 bp, Artificial Sequence
  Description of Artificial Sequence: Synthetic oligonucleotide
ggctactatatgcac

SEQ ID NO: 7142 - protein, 5 aa, Artificial Sequence
  Description of Artificial Sequence: Synthetic peptide
GYYMH

SEQ ID NO: 7143 - DNA, 15 bp, Artificial Sequence
  Description of Artificial Sequence: Synthetic oligonucleotide
aactttgccatgagt

SEQ ID NO: 7144 - protein, 5 aa, Artificial Sequence
  Description of Artificial Sequence: Synthetic peptide
NFAMS

SEQ ID NO: 7145 - DNA, 15 bp, Artificial Sequence
  Description of Artificial Sequence: Synthetic oligonucleotide
agctatggcatgcac

SEQ ID NO: 7146 - protein, 5 aa, Artificial Sequence
  Description of Artificial Sequence: Synthetic peptide
SYGMH

SEQ ID NO: 7147 - DNA, 15 bp, Artificial Sequence
  Description of Artificial Sequence: Synthetic oligonucleotide
ggctactatatgcac

SEQ ID NO: 7148 - protein, 5 aa, Artificial Sequence
  Description of Artificial Sequence: Synthetic peptide
GYYMH

SEQ ID NO: 7149 - DNA, 15 bp, Artificial Sequence
  Description of Artificial Sequence: Synthetic oligonucleotide
agctatggtatcaac

SEQ ID NO: 7150 - protein, 5 aa, Artificial Sequence
  Description of Artificial Sequence: Synthetic peptide
SYGIN

SEQ ID NO: 7151 - DNA, 15 bp, Artificial Sequence
  Description of Artificial Sequence: Synthetic oligonucleotide
agctatggcatgcac

SEQ ID NO: 7152 - protein, 5 aa, Artificial Sequence
  Description of Artificial Sequence: Synthetic peptide
SYGMH

SEQ ID NO: 7153 - DNA, 15 bp, Artificial Sequence
  Description of Artificial Sequence: Synthetic oligonucleotide
agctatgccatgagc

SEQ ID NO: 7154 - protein, 5 aa, Artificial Sequence
  Description of Artificial Sequence: Synthetic peptide
SYAMS

SEQ ID NO: 7155 - DNA, 15 bp, Artificial Sequence
  Description of Artificial Sequence: Synthetic oligonucleotide
agctatgccatgagc

SEQ ID NO: 7156 - protein, 5 aa, Artificial Sequence
  Description of Artificial Sequence: Synthetic peptide
SYAMS

SEQ ID NO: 7157 - DNA, 15 bp, Artificial Sequence
  Description of Artificial Sequence: Synthetic oligonucleotide
agctatatcatgcac

SEQ ID NO: 7158 - protein, 5 aa, Artificial Sequence
  Description of Artificial Sequence: Synthetic peptide
SYIMH

SEQ ID NO: 7159 - DNA, 15 bp, Artificial Sequence
  Description of Artificial Sequence: Synthetic oligonucleotide
ggctactatatacac

SEQ ID NO: 7160 - protein, 5 aa, Artificial Sequence
  Description of Artificial Sequence: Synthetic peptide
GYYIH

SEQ ID NO: 7161 - DNA, 21 bp, Artificial Sequence
  Description of Artificial Sequence: Synthetic oligonucleotide
agaagtagttactactggggc

SEQ ID NO: 7162 - protein, 7 aa, Artificial Sequence
  Description of Artificial Sequence: Synthetic peptide
RSSYYWG

SEQ ID NO: 7163 - DNA, 15 bp, Artificial Sequence
  Description of Artificial Sequence: Synthetic oligonucleotide
agctatggcatgcac

SEQ ID NO: 7164 - protein, 5 aa, Artificial Sequence
  Description of Artificial Sequence: Synthetic peptide
SYGMH

SEQ ID NO: 7165 - DNA, 15 bp, Artificial Sequence
  Description of Artificial Sequence: Synthetic oligonucleotide
aattatgatatcaac

SEQ ID NO: 7166 - protein, 5 aa, Artificial Sequence
  Description of Artificial Sequence: Synthetic peptide
NYDIN

SEQ ID NO: 7167 - DNA, 15 bp, Artificial Sequence
  Description of Artificial Sequence: Synthetic oligonucleotide
agcgatgccatgagc

SEQ ID NO: 7168 - protein, 5 aa, Artificial Sequence
  Description of Artificial Sequence: Synthetic peptide
SDAMS

SEQ ID NO: 7169 - DNA, 15 bp, Artificial Sequence
  Description of Artificial Sequence: Synthetic oligonucleotide
ggctactatatacac

SEQ ID NO: 7170 - protein, 5 aa, Artificial Sequence
  Description of Artificial Sequence: Synthetic peptide
GYYIH

SEQ ID NO: 7171 - DNA, 15 bp, Artificial Sequence
  Description of Artificial Sequence: Synthetic oligonucleotide
aattatgatatcaac

SEQ ID NO: 7172 - protein, 5 aa, Artificial Sequence
  Description of Artificial Sequence: Synthetic peptide
NYDIN

SEQ ID NO: 7173 - DNA, 15 bp, Artificial Sequence
  Description of Artificial Sequence: Synthetic oligonucleotide
aattatgatatcaac

SEQ ID NO: 7174 - protein, 5 aa, Artificial Sequence
  Description of Artificial Sequence: Synthetic peptide
NYDIN

SEQ ID NO: 7175 - DNA, 15 bp, Artificial Sequence
  Description of Artificial Sequence: Synthetic oligonucleotide
agctatggcatgcac

SEQ ID NO: 7176 - protein, 5 aa, Artificial Sequence
  Description of Artificial Sequence: Synthetic peptide
SYGMH

SEQ ID NO: 7177 - DNA, 15 bp, Artificial Sequence
  Description of Artificial Sequence: Synthetic oligonucleotide
ggctactatatacac

SEQ ID NO: 7178 - protein, 5 aa, Artificial Sequence
  Description of Artificial Sequence: Synthetic peptide
GYYIH

SEQ ID NO: 7179 - DNA, 15 bp, Artificial Sequence
  Description of Artificial Sequence: Synthetic oligonucleotide
aattatgatatcaac

SEQ ID NO: 7180 - protein, 5 aa, Artificial Sequence
  Description of Artificial Sequence: Synthetic peptide
NYDIN

SEQ ID NO: 7181 - DNA, 15 bp, Artificial Sequence
  Description of Artificial Sequence: Synthetic oligonucleotide
ggctactatatacac

SEQ ID NO: 7182 - protein, 5 aa, Artificial Sequence
  Description of Artificial Sequence: Synthetic peptide
GYYIH

SEQ ID NO: 7183 - DNA, 15 bp, Artificial Sequence
  Description of Artificial Sequence: Synthetic oligonucleotide
gactatgtcatccac

SEQ ID NO: 7184 - protein, 5 aa, Artificial Sequence
  Description of Artificial Sequence: Synthetic peptide
DYVIH

SEQ ID NO: 7185 - DNA, 15 bp, Artificial Sequence
  Description of Artificial Sequence: Synthetic oligonucleotide
agctactatatgcac

SEQ ID NO: 7186 - protein, 5 aa, Artificial Sequence
  Description of Artificial Sequence: Synthetic peptide
SYYMH

SEQ ID NO: 7187 - DNA, 15 bp, Artificial Sequence
  Description of Artificial Sequence: Synthetic oligonucleotide
aattatgatatcaac

SEQ ID NO: 7188 - protein, 5 aa, Artificial Sequence
  Description of Artificial Sequence: Synthetic peptide
NYDIN

SEQ ID NO: 7189 - DNA, 15 bp, Artificial Sequence
  Description of Artificial Sequence: Synthetic oligonucleotide
ggctactatatacac

SEQ ID NO: 7190 - protein, 5 aa, Artificial Sequence
  Description of Artificial Sequence: Synthetic peptide
GYYIH

SEQ ID NO: 7191 - DNA, 15 bp, Artificial Sequence
  Description of Artificial Sequence: Synthetic oligonucleotide
aattatgatatcaac

SEQ ID NO: 7192 - protein, 5 aa, Artificial Sequence
  Description of Artificial Sequence: Synthetic peptide
NYDIN

SEQ ID NO: 7193 - DNA, 15 bp, Artificial Sequence
  Description of Artificial Sequence: Synthetic oligonucleotide
gactatggcatgcac

SEQ ID NO: 7194 - protein, 5 aa, Artificial Sequence
  Description of Artificial Sequence: Synthetic peptide
DYGMH

SEQ ID NO: 7195 - DNA, 15 bp, Artificial Sequence
  Description of Artificial Sequence: Synthetic oligonucleotide
aactatggcatgcac

SEQ ID NO: 7196 - protein, 5 aa, Artificial Sequence
  Description of Artificial Sequence: Synthetic peptide
NYGMH

SEQ ID NO: 7197 - DNA, 21 bp, Artificial Sequence
  Description of Artificial Sequence: Synthetic oligonucleotide
agtggtcattactactggagc

SEQ ID NO: 7198 - protein, 7 aa, Artificial Sequence
  Description of Artificial Sequence: Synthetic peptide
SGHYYWS

SEQ ID NO: 7199 - DNA, 15 bp, Artificial Sequence
  Description of Artificial Sequence: Synthetic oligonucleotide
agctatggcatgcac

SEQ ID NO: 7200 - protein, 5 aa, Artificial Sequence
  Description of Artificial Sequence: Synthetic peptide
SYGMH

SEQ ID NO: 7201 - DNA, 15 bp, Artificial Sequence
  Description of Artificial Sequence: Synthetic oligonucleotide
aattatgatatcaac

SEQ ID NO: 7202 - protein, 5 aa, Artificial Sequence
  Description of Artificial Sequence: Synthetic peptide
NYDIN

SEQ ID NO: 7203 - DNA, 15 bp, Artificial Sequence
  Description of Artificial Sequence: Synthetic oligonucleotide
aattatgatatcaac

SEQ ID NO: 7204 - protein, 5 aa, Artificial Sequence
  Description of Artificial Sequence: Synthetic peptide
NYDIN

SEQ ID NO: 7205 - DNA, 15 bp, Artificial Sequence
  Description of Artificial Sequence: Synthetic oligonucleotide
cattatgatatcaac

SEQ ID NO: 7206 - protein, 5 aa, Artificial Sequence
  Description of Artificial Sequence: Synthetic peptide
HYDIN

SEQ ID NO: 7207 - DNA, 15 bp, Artificial Sequence
  Description of Artificial Sequence: Synthetic oligonucleotide
aattatgatatcaac

SEQ ID NO: 7208 - protein, 5 aa, Artificial Sequence
  Description of Artificial Sequence: Synthetic peptide
NYDIN

SEQ ID NO: 7209 - DNA, 15 bp, Artificial Sequence
  Description of Artificial Sequence: Synthetic oligonucleotide
acctatggcatgcac

SEQ ID NO: 7210 - protein, 5 aa, Artificial Sequence
  Description of Artificial Sequence: Synthetic peptide
TYGMH

SEQ ID NO: 7211 - DNA, 15 bp, Artificial Sequence
  Description of Artificial Sequence: Synthetic oligonucleotide
aactatggcatgcac

SEQ ID NO: 7212 - protein, 5 aa, Artificial Sequence
  Description of Artificial Sequence: Synthetic peptide
NYGMH

SEQ ID NO: 7213 - DNA, 15 bp, Artificial Sequence
  Description of Artificial Sequence: Synthetic oligonucleotide
gactatggcatgcac

SEQ ID NO: 7214 - protein, 5 aa, Artificial Sequence
  Description of Artificial Sequence: Synthetic peptide
DYGMH

SEQ ID NO: 7215 - DNA, 15 bp, Artificial Sequence
  Description of Artificial Sequence: Synthetic oligonucleotide
aattatgatatcaac

SEQ ID NO: 7216 - protein, 5 aa, Artificial Sequence
  Description of Artificial Sequence: Synthetic peptide
NYDIN

SEQ ID NO: 7217 - DNA, 15 bp, Artificial Sequence
  Description of Artificial Sequence: Synthetic oligonucleotide
aattatgatatcaac

SEQ ID NO: 7218 - protein, 5 aa, Artificial Sequence
  Description of Artificial Sequence: Synthetic peptide
NYDIN

SEQ ID NO: 7219 - DNA, 15 bp, Artificial Sequence
  Description of Artificial Sequence: Synthetic oligonucleotide
acctatggcatgcac

SEQ ID NO: 7220 - protein, 5 aa, Artificial Sequence
  Description of Artificial Sequence: Synthetic peptide
TYGMH

SEQ ID NO: 7221 - DNA, 15 bp, Artificial Sequence
  Description of Artificial Sequence: Synthetic oligonucleotide
agctatggcatgcac

SEQ ID NO: 7222 - protein, 5 aa, Artificial Sequence
  Description of Artificial Sequence: Synthetic peptide
SYGMH

SEQ ID NO: 7223 - DNA, 15 bp, Artificial Sequence
  Description of Artificial Sequence: Synthetic oligonucleotide
ggctactatatacac

SEQ ID NO: 7224 - protein, 5 aa, Artificial Sequence
  Description of Artificial Sequence: Synthetic peptide
GYYIH

SEQ ID NO: 7225 - DNA, 15 bp, Artificial Sequence
  Description of Artificial Sequence: Synthetic oligonucleotide
aactatggcatgcac

SEQ ID NO: 7226 - protein, 5 aa, Artificial Sequence
  Description of Artificial Sequence: Synthetic peptide
NYGMH

SEQ ID NO: 7227 - DNA, 15 bp, Artificial Sequence
  Description of Artificial Sequence: Synthetic oligonucleotide
ggctactatatacac

SEQ ID NO: 7228 - protein, 5 aa, Artificial Sequence
  Description of Artificial Sequence: Synthetic peptide
GYYIH

SEQ ID NO: 7229 - DNA, 15 bp, Artificial Sequence
  Description of Artificial Sequence: Synthetic oligonucleotide
ggctactatatacac

SEQ ID NO: 7230 - protein, 5 aa, Artificial Sequence
  Description of Artificial Sequence: Synthetic peptide
GYYIH

SEQ ID NO: 7231 - DNA, 15 bp, Artificial Sequence
  Description of Artificial Sequence: Synthetic oligonucleotide
ggctattatatacac

SEQ ID NO: 7232 - protein, 5 aa, Artificial Sequence
  Description of Artificial Sequence: Synthetic peptide
GYYIH

SEQ ID NO: 7233 - DNA, 15 bp, Artificial Sequence
  Description of Artificial Sequence: Synthetic oligonucleotide
aattatgatatcaac

SEQ ID NO: 7234 - protein, 5 aa, Artificial Sequence
  Description of Artificial Sequence: Synthetic peptide
NYDIN

SEQ ID NO: 7235 - DNA, 15 bp, Artificial Sequence
  Description of Artificial Sequence: Synthetic oligonucleotide
ggctactatatacac

SEQ ID NO: 7236 - protein, 5 aa, Artificial Sequence
  Description of Artificial Sequence: Synthetic peptide
GYYIH

SEQ ID NO: 7237 - DNA, 15 bp, Artificial Sequence
  Description of Artificial Sequence: Synthetic oligonucleotide
aactgtggcatgcac

SEQ ID NO: 7238 - protein, 5 aa, Artificial Sequence
  Description of Artificial Sequence: Synthetic peptide
NCGMH

SEQ ID NO: 7239 - DNA, 15 bp, Artificial Sequence
  Description of Artificial Sequence: Synthetic oligonucleotide
aattatgatatcaac

SEQ ID NO: 7240 - protein, 5 aa, Artificial Sequence
  Description of Artificial Sequence: Synthetic peptide
NYDIN

SEQ ID NO: 7241 - DNA, 15 bp, Artificial Sequence
  Description of Artificial Sequence: Synthetic oligonucleotide
ggctactatatacac

SEQ ID NO: 7242 - protein, 5 aa, Artificial Sequence
  Description of Artificial Sequence: Synthetic peptide
GYYIH

SEQ ID NO: 7243 - DNA, 15 bp, Artificial Sequence
  Description of Artificial Sequence: Synthetic oligonucleotide
ggctactatacacac

SEQ ID NO: 7244 - protein, 5 aa, Artificial Sequence
  Description of Artificial Sequence: Synthetic peptide
GYYTH

SEQ ID NO: 7245 - DNA, 15 bp, Artificial Sequence
  Description of Artificial Sequence: Synthetic oligonucleotide
ggctactatatacac

SEQ ID NO: 7246 - protein, 5 aa, Artificial Sequence
  Description of Artificial Sequence: Synthetic peptide
GYYIH

SEQ ID NO: 7247 - DNA, 15 bp, Artificial Sequence
  Description of Artificial Sequence: Synthetic oligonucleotide
agctatggcatgcac

SEQ ID NO: 7248 - protein, 5 aa, Artificial Sequence
  Description of Artificial Sequence: Synthetic peptide
SYGMH

SEQ ID NO: 7249 - DNA, 15 bp, Artificial Sequence
  Description of Artificial Sequence: Synthetic oligonucleotide
acttttgccatgacc

SEQ ID NO: 7250 - protein, 5 aa, Artificial Sequence
  Description of Artificial Sequence: Synthetic peptide
TFAMT

SEQ ID NO: 7251 - DNA, 15 bp, Artificial Sequence
  Description of Artificial Sequence: Synthetic oligonucleotide
aactatggcatgcac

SEQ ID NO: 7252 - protein, 5 aa, Artificial Sequence
  Description of Artificial Sequence: Synthetic peptide
NYGMH

SEQ ID NO: 7253 - DNA, 15 bp, Artificial Sequence
  Description of Artificial Sequence: Synthetic oligonucleotide
aattatgatatcaac

SEQ ID NO: 7254 - protein, 5 aa, Artificial Sequence
  Description of Artificial Sequence: Synthetic peptide
NYDIN

SEQ ID NO: 7255 - DNA, 15 bp, Artificial Sequence
  Description of Artificial Sequence: Synthetic oligonucleotide
aattatgatatcaac

SEQ ID NO: 7256 - protein, 5 aa, Artificial Sequence
  Description of Artificial Sequence: Synthetic peptide
NYDIN

SEQ ID NO: 7257 - DNA, 15 bp, Artificial Sequence
  Description of Artificial Sequence: Synthetic oligonucleotide
ggctactatatacac

SEQ ID NO: 7258 - protein, 5 aa, Artificial Sequence
  Description of Artificial Sequence: Synthetic peptide
GYYIH

SEQ ID NO: 7259 - DNA, 15 bp, Artificial Sequence
  Description of Artificial Sequence: Synthetic oligonucleotide
aattatgatatcaac

SEQ ID NO: 7260 - protein, 5 aa, Artificial Sequence
  Description of Artificial Sequence: Synthetic peptide
NYDIN

SEQ ID NO: 7261 - DNA, 15 bp, Artificial Sequence
  Description of Artificial Sequence: Synthetic oligonucleotide
aattatgatatcaac

SEQ ID NO: 7262 - protein, 5 aa, Artificial Sequence
  Description of Artificial Sequence: Synthetic peptide
NYDIN

SEQ ID NO: 7263 - DNA, 15 bp, Artificial Sequence
  Description of Artificial Sequence: Synthetic oligonucleotide
acctatagcatgaac

SEQ ID NO: 7264 - protein, 5 aa, Artificial Sequence
  Description of Artificial Sequence: Synthetic peptide
TYSMN

SEQ ID NO: 7265 - DNA, 15 bp, Artificial Sequence
  Description of Artificial Sequence: Synthetic oligonucleotide
aactatggcatgcac

SEQ ID NO: 7266 - protein, 5 aa, Artificial Sequence
  Description of Artificial Sequence: Synthetic peptide
NYGMH

SEQ ID NO: 7267 - DNA, 15 bp, Artificial Sequence
  Description of Artificial Sequence: Synthetic oligonucleotide
agctatgccatgagc

SEQ ID NO: 7268 - protein, 5 aa, Artificial Sequence
  Description of Artificial Sequence: Synthetic peptide
SYAMS

SEQ ID NO: 7269 - DNA, 15 bp, Artificial Sequence
  Description of Artificial Sequence: Synthetic oligonucleotide
agctatgccatgagc

SEQ ID NO: 7270 - protein, 5 aa, Artificial Sequence
  Description of Artificial Sequence: Synthetic peptide
SYAMS

SEQ ID NO: 7271 - DNA, 15 bp, Artificial Sequence
  Description of Artificial Sequence: Synthetic oligonucleotide
agctatgccatgagc

SEQ ID NO: 7272 - protein, 5 aa, Artificial Sequence
  Description of Artificial Sequence: Synthetic peptide
SYAMS

SEQ ID NO: 7273 - DNA, 15 bp, Artificial Sequence
  Description of Artificial Sequence: Synthetic oligonucleotide
aactataacatgaac

SEQ ID NO: 7274 - protein, 5 aa, Artificial Sequence
  Description of Artificial Sequence: Synthetic peptide
NYNMN

SEQ ID NO: 7275 - DNA, 15 bp, Artificial Sequence
  Description of Artificial Sequence: Synthetic oligonucleotide
agttatgatatcaac

SEQ ID NO: 7276 - protein, 5 aa, Artificial Sequence
  Description of Artificial Sequence: Synthetic peptide
SYDIN

SEQ ID NO: 7277 - DNA, 15 bp, Artificial Sequence
  Description of Artificial Sequence: Synthetic oligonucleotide
agctatgccatgagc

SEQ ID NO: 7278 - protein, 5 aa, Artificial Sequence
  Description of Artificial Sequence: Synthetic peptide
SYAMS

SEQ ID NO: 7279 - DNA, 15 bp, Artificial Sequence
  Description of Artificial Sequence: Synthetic oligonucleotide
gactactatttgcac

SEQ ID NO: 7280 - protein, 5 aa, Artificial Sequence
  Description of Artificial Sequence: Synthetic peptide
DYYLH

SEQ ID NO: 7281 - DNA, 15 bp, Artificial Sequence
  Description of Artificial Sequence: Synthetic oligonucleotide
agctatggcatgcac

SEQ ID NO: 7282 - protein, 5 aa, Artificial Sequence
  Description of Artificial Sequence: Synthetic peptide
SYGMH

SEQ ID NO: 7283 - DNA, 15 bp, Artificial Sequence
  Description of Artificial Sequence: Synthetic oligonucleotide
agctatggcatgcac

SEQ ID NO: 7284 - protein, 5 aa, Artificial Sequence
  Description of Artificial Sequence: Synthetic peptide
SYGMH

SEQ ID NO: 7285 - DNA, 15 bp, Artificial Sequence
  Description of Artificial Sequence: Synthetic oligonucleotide
acctatggcatgcac

SEQ ID NO: 7286 - protein, 5 aa, Artificial Sequence
  Description of Artificial Sequence: Synthetic peptide
TYGMH

SEQ ID NO: 7287 - DNA, 15 bp, Artificial Sequence
  Description of Artificial Sequence: Synthetic oligonucleotide
acctatggcatgcac

SEQ ID NO: 7288 - protein, 5 aa, Artificial Sequence
  Description of Artificial Sequence: Synthetic peptide
TYGMH

SEQ ID NO: 7289 - DNA, 15 bp, Artificial Sequence
  Description of Artificial Sequence: Synthetic oligonucleotide
aactatgtcatgagc

SEQ ID NO: 7290 - protein, 5 aa, Artificial Sequence
  Description of Artificial Sequence: Synthetic peptide
NYVMS

SEQ ID NO: 7291 - DNA, 15 bp, Artificial Sequence
  Description of Artificial Sequence: Synthetic oligonucleotide
agctatgccatgagc

SEQ ID NO: 7292 - protein, 5 aa, Artificial Sequence
  Description of Artificial Sequence: Synthetic peptide
SYAMS

SEQ ID NO: 7293 - DNA, 21 bp, Artificial Sequence
  Description of Artificial Sequence: Synthetic oligonucleotide
agtggttattaccactggagc

SEQ ID NO: 7294 - protein, 7 aa, Artificial Sequence
  Description of Artificial Sequence: Synthetic peptide
SGYYHWS

SEQ ID NO: 7295 - DNA, 15 bp, Artificial Sequence
  Description of Artificial Sequence: Synthetic oligonucleotide
aactataacatgaac

SEQ ID NO: 7296 - protein, 5 aa, Artificial Sequence
  Description of Artificial Sequence: Synthetic peptide
NYNMN

SEQ ID NO: 7297 - DNA, 15 bp, Artificial Sequence
  Description of Artificial Sequence: Synthetic oligonucleotide
agctataacatgaac

SEQ ID NO: 7298 - protein, 5 aa, Artificial Sequence
  Description of Artificial Sequence: Synthetic peptide
SYNMN

SEQ ID NO: 7299 - DNA, 15 bp, Artificial Sequence
  Description of Artificial Sequence: Synthetic oligonucleotide
agctatgccatgagc

SEQ ID NO: 7300 - protein, 5 aa, Artificial Sequence
  Description of Artificial Sequence: Synthetic peptide
SYAMS

SEQ ID NO: 7301 - DNA, 15 bp, Artificial Sequence
  Description of Artificial Sequence: Synthetic oligonucleotide
agctatggcatgcac

SEQ ID NO: 7302 - protein, 5 aa, Artificial Sequence
  Description of Artificial Sequence: Synthetic peptide
SYGMH

SEQ ID NO: 7303 - DNA, 15 bp, Artificial Sequence
  Description of Artificial Sequence: Synthetic oligonucleotide
acctatggcatgcac

SEQ ID NO: 7304 - protein, 5 aa, Artificial Sequence
  Description of Artificial Sequence: Synthetic peptide
TYGMH

SEQ ID NO: 7305 - DNA, 15 bp, Artificial Sequence
  Description of Artificial Sequence: Synthetic oligonucleotide
agctatcccatgagc

SEQ ID NO: 7306 - protein, 5 aa, Artificial Sequence
  Description of Artificial Sequence: Synthetic peptide
SYPMS

SEQ ID NO: 7307 - DNA, 15 bp, Artificial Sequence
  Description of Artificial Sequence: Synthetic oligonucleotide
agctataacatgaac

SEQ ID NO: 7308 - protein, 5 aa, Artificial Sequence
  Description of Artificial Sequence: Synthetic peptide
SYNMN

SEQ ID NO: 7309 - DNA, 15 bp, Artificial Sequence
  Description of Artificial Sequence: Synthetic oligonucleotide
ggctattggatgaac

SEQ ID NO: 7310 - protein, 5 aa, Artificial Sequence
  Description of Artificial Sequence: Synthetic peptide
GYWMN

SEQ ID NO: 7311 - DNA, 15 bp, Artificial Sequence
  Description of Artificial Sequence: Synthetic oligonucleotide
agctatgccatgagc

SEQ ID NO: 7312 - protein, 5 aa, Artificial Sequence
  Description of Artificial Sequence: Synthetic peptide
SYAMS

SEQ ID NO: 7313 - DNA, 15 bp, Artificial Sequence
  Description of Artificial Sequence: Synthetic oligonucleotide
agttatagcatgaac

SEQ ID NO: 7314 - protein, 5 aa, Artificial Sequence
  Description of Artificial Sequence: Synthetic peptide
SYSMN

SEQ ID NO: 7315 - DNA, 15 bp, Artificial Sequence
  Description of Artificial Sequence: Synthetic oligonucleotide
agccacgccatgagc

SEQ ID NO: 7316 - protein, 5 aa, Artificial Sequence
  Description of Artificial Sequence: Synthetic peptide
SHAMS

SEQ ID NO: 7317 - DNA, 15 bp, Artificial Sequence
  Description of Artificial Sequence: Synthetic oligonucleotide
agctatggcatgcac

SEQ ID NO: 7318 - protein, 5 aa, Artificial Sequence
  Description of Artificial Sequence: Synthetic peptide
SYGMH

SEQ ID NO: 7319 - DNA, 15 bp, Artificial Sequence
  Description of Artificial Sequence: Synthetic oligonucleotide
acctatggcatgcac

SEQ ID NO: 7320 - protein, 5 aa, Artificial Sequence
  Description of Artificial Sequence: Synthetic peptide
TYGMH

SEQ ID NO: 7321 - DNA, 15 bp, Artificial Sequence
  Description of Artificial Sequence: Synthetic oligonucleotide
agctatgccatgagc

SEQ ID NO: 7322 - protein, 5 aa, Artificial Sequence
  Description of Artificial Sequence: Synthetic peptide
SYAMS

SEQ ID NO: 7323 - DNA, 15 bp, Artificial Sequence
  Description of Artificial Sequence: Synthetic oligonucleotide
agctataacatgaac

SEQ ID NO: 7324 - protein, 5 aa, Artificial Sequence
  Description of Artificial Sequence: Synthetic peptide
SYNMN

SEQ ID NO: 7325 - DNA, 15 bp, Artificial Sequence
  Description of Artificial Sequence: Synthetic oligonucleotide
acctatgccatgagc

SEQ ID NO: 7326 - protein, 5 aa, Artificial Sequence
  Description of Artificial Sequence: Synthetic peptide
TYAMS

SEQ ID NO: 7327 - DNA, 15 bp, Artificial Sequence
  Description of Artificial Sequence: Synthetic oligonucleotide
acctatggcatgcac

SEQ ID NO: 7328 - protein, 5 aa, Artificial Sequence
  Description of Artificial Sequence: Synthetic peptide
TYGMH

SEQ ID NO: 7329 - DNA, 15 bp, Artificial Sequence
  Description of Artificial Sequence: Synthetic oligonucleotide
agctatgccatgagc

SEQ ID NO: 7330 - protein, 5 aa, Artificial Sequence
  Description of Artificial Sequence: Synthetic peptide
SYAMS

SEQ ID NO: 7331 - DNA, 15 bp, Artificial Sequence
  Description of Artificial Sequence: Synthetic oligonucleotide
gactatggcatgcac

SEQ ID NO: 7332 - protein, 5 aa, Artificial Sequence
  Description of Artificial Sequence: Synthetic peptide
DYGMH

SEQ ID NO: 7333 - DNA, 15 bp, Artificial Sequence
  Description of Artificial Sequence: Synthetic oligonucleotide
agctatgccatgagc

SEQ ID NO: 7334 - protein, 5 aa, Artificial Sequence
  Description of Artificial Sequence: Synthetic peptide
SYAMS

SEQ ID NO: 7335 - DNA, 15 bp, Artificial Sequence
  Description of Artificial Sequence: Synthetic oligonucleotide
agctatgccatgagc

SEQ ID NO: 7336 - protein, 5 aa, Artificial Sequence
  Description of Artificial Sequence: Synthetic peptide
SYAMS

SEQ ID NO: 7337 - DNA, 15 bp, Artificial Sequence
  Description of Artificial Sequence: Synthetic oligonucleotide
gactatggcatgcac

SEQ ID NO: 7338 - protein, 5 aa, Artificial Sequence
  Description of Artificial Sequence: Synthetic peptide
DYGMH

SEQ ID NO: 7339 - DNA, 15 bp, Artificial Sequence
  Description of Artificial Sequence: Synthetic oligonucleotide
agctatgccatgagc

SEQ ID NO: 7340 - protein, 5 aa, Artificial Sequence
  Description of Artificial Sequence: Synthetic peptide
SYAMS

SEQ ID NO: 7341 - DNA, 15 bp, Artificial Sequence
  Description of Artificial Sequence: Synthetic oligonucleotide
agctatgccatgagc

SEQ ID NO: 7342 - protein, 5 aa, Artificial Sequence
  Description of Artificial Sequence: Synthetic peptide
SYAMS

SEQ ID NO: 7343 - DNA, 15 bp, Artificial Sequence
  Description of Artificial Sequence: Synthetic oligonucleotide
gactatggcatgcac

SEQ ID NO: 7344 - protein, 5 aa, Artificial Sequence
  Description of Artificial Sequence: Synthetic peptide
DYGMH

SEQ ID NO: 7345 - DNA, 15 bp, Artificial Sequence
  Description of Artificial Sequence: Synthetic oligonucleotide
gactatggcatgcac

SEQ ID NO: 7346 - protein, 5 aa, Artificial Sequence
  Description of Artificial Sequence: Synthetic peptide
DYGMH

SEQ ID NO: 7347 - DNA, 15 bp, Artificial Sequence
  Description of Artificial Sequence: Synthetic oligonucleotide
aactatggcatgcac

SEQ ID NO: 7348 - protein, 5 aa, Artificial Sequence
  Description of Artificial Sequence: Synthetic peptide
NYGMH

SEQ ID NO: 7349 - DNA, 15 bp, Artificial Sequence
  Description of Artificial Sequence: Synthetic oligonucleotide
acctatggcatgcac

SEQ ID NO: 7350 - protein, 5 aa, Artificial Sequence
  Description of Artificial Sequence: Synthetic peptide
TYGMH

SEQ ID NO: 7351 - DNA, 15 bp, Artificial Sequence
  Description of Artificial Sequence: Synthetic oligonucleotide
acctatggcatgcac

SEQ ID NO: 7352 - protein, 5 aa, Artificial Sequence
  Description of Artificial Sequence: Synthetic peptide
TYGMH

SEQ ID NO: 7353 - DNA, 15 bp, Artificial Sequence
  Description of Artificial Sequence: Synthetic oligonucleotide
agctatgccatgagc

SEQ ID NO: 7354 - protein, 5 aa, Artificial Sequence
  Description of Artificial Sequence: Synthetic peptide
SYAMS

SEQ ID NO: 7355 - DNA, 15 bp, Artificial Sequence
  Description of Artificial Sequence: Synthetic oligonucleotide
agctatggcatgcac

SEQ ID NO: 7356 - protein, 5 aa, Artificial Sequence
  Description of Artificial Sequence: Synthetic peptide
SYGMH

SEQ ID NO: 7357 - DNA, 15 bp, Artificial Sequence
  Description of Artificial Sequence: Synthetic oligonucleotide
agctatgccatgagc

SEQ ID NO: 7358 - protein, 5 aa, Artificial Sequence
  Description of Artificial Sequence: Synthetic peptide
SYAMS

SEQ ID NO: 7359 - DNA, 15 bp, Artificial Sequence
  Description of Artificial Sequence: Synthetic oligonucleotide
acctatggcatgcac

SEQ ID NO: 7360 - protein, 5 aa, Artificial Sequence
  Description of Artificial Sequence: Synthetic peptide
TYGMH

SEQ ID NO: 7361 - DNA, 21 bp, Artificial Sequence
  Description of Artificial Sequence: Synthetic oligonucleotide
agtggttattactactggagc

SEQ ID NO: 7362 - protein, 7 aa, Artificial Sequence
  Description of Artificial Sequence: Synthetic peptide
SGYYYWS

SEQ ID NO: 7363 - DNA, 15 bp, Artificial Sequence
  Description of Artificial Sequence: Synthetic oligonucleotide
agctactggatcggc

SEQ ID NO: 7364 - protein, 5 aa, Artificial Sequence
  Description of Artificial Sequence: Synthetic peptide
SYWIG

SEQ ID NO: 7365 - DNA, 15 bp, Artificial Sequence
  Description of Artificial Sequence: Synthetic oligonucleotide
agctatggcatgcac

SEQ ID NO: 7366 - protein, 5 aa, Artificial Sequence
  Description of Artificial Sequence: Synthetic peptide
SYGMH

SEQ ID NO: 7367 - DNA, 15 bp, Artificial Sequence
  Description of Artificial Sequence: Synthetic oligonucleotide
ggctatggcatgcac

SEQ ID NO: 7368 - protein, 5 aa, Artificial Sequence
  Description of Artificial Sequence: Synthetic peptide
GYGMH

SEQ ID NO: 7369 - DNA, 15 bp, Artificial Sequence
  Description of Artificial Sequence: Synthetic oligonucleotide
agctatgccatgagc

SEQ ID NO: 7370 - protein, 5 aa, Artificial Sequence
  Description of Artificial Sequence: Synthetic peptide
SYAMS

SEQ ID NO: 7371 - DNA, 15 bp, Artificial Sequence
  Description of Artificial Sequence: Synthetic oligonucleotide
agctatggcatgcac

SEQ ID NO: 7372 - protein, 5 aa, Artificial Sequence
  Description of Artificial Sequence: Synthetic peptide
SYGMH

SEQ ID NO: 7373 - DNA, 15 bp, Artificial Sequence
  Description of Artificial Sequence: Synthetic oligonucleotide
aactataacatgaac

SEQ ID NO: 7374 - protein, 5 aa, Artificial Sequence
  Description of Artificial Sequence: Synthetic peptide
NYNMN

SEQ ID NO: 7375 - DNA, 15 bp, Artificial Sequence
  Description of Artificial Sequence: Synthetic oligonucleotide
agctatggcatgcac

SEQ ID NO: 7376 - protein, 5 aa, Artificial Sequence
  Description of Artificial Sequence: Synthetic peptide
SYGMH

SEQ ID NO: 7377 - DNA, 15 bp, Artificial Sequence
  Description of Artificial Sequence: Synthetic oligonucleotide
agctatggcatgcac

SEQ ID NO: 7378 - protein, 5 aa, Artificial Sequence
  Description of Artificial Sequence: Synthetic peptide
SYGMH

SEQ ID NO: 7379 - DNA, 15 bp, Artificial Sequence
  Description of Artificial Sequence: Synthetic oligonucleotide
acctatggcatgcac

SEQ ID NO: 7380 - protein, 5 aa, Artificial Sequence
  Description of Artificial Sequence: Synthetic peptide
TYGMH

SEQ ID NO: 7381 - DNA, 15 bp, Artificial Sequence
  Description of Artificial Sequence: Synthetic oligonucleotide
agctatggcatgcac

SEQ ID NO: 7382 - protein, 5 aa, Artificial Sequence
  Description of Artificial Sequence: Synthetic peptide
SYGMH

SEQ ID NO: 7383 - DNA, 15 bp, Artificial Sequence
  Description of Artificial Sequence: Synthetic oligonucleotide
agctatggcatgcac

SEQ ID NO: 7384 - protein, 5 aa, Artificial Sequence
  Description of Artificial Sequence: Synthetic peptide
SYGMH

SEQ ID NO: 7385 - DNA, 15 bp, Artificial Sequence
  Description of Artificial Sequence: Synthetic oligonucleotide
agctatggcatgcac

SEQ ID NO: 7386 - protein, 5 aa, Artificial Sequence
  Description of Artificial Sequence: Synthetic peptide
SYGMH

SEQ ID NO: 7387 - DNA, 21 bp, Artificial Sequence
  Description of Artificial Sequence: Synthetic oligonucleotide
agtggtggttactactggagc

SEQ ID NO: 7388 - protein, 7 aa, Artificial Sequence
  Description of Artificial Sequence: Synthetic peptide
SGGYYWS

SEQ ID NO: 7389 - DNA, 21 bp, Artificial Sequence
  Description of Artificial Sequence: Synthetic oligonucleotide
agtggtggttactactggagc

SEQ ID NO: 7390 - protein, 7 aa, Artificial Sequence
  Description of Artificial Sequence: Synthetic peptide
SGGYYWS

SEQ ID NO: 7391 - DNA, 15 bp, Artificial Sequence
  Description of Artificial Sequence: Synthetic oligonucleotide
ggctatggcatgcac

SEQ ID NO: 7392 - protein, 5 aa, Artificial Sequence
  Description of Artificial Sequence: Synthetic peptide
GYGMH

SEQ ID NO: 7393 - DNA, 15 bp, Artificial Sequence
  Description of Artificial Sequence: Synthetic oligonucleotide
agcaatggcatgcac

SEQ ID NO: 7394 - protein, 5 aa, Artificial Sequence
  Description of Artificial Sequence: Synthetic peptide
SNGMH

SEQ ID NO: 7395 - DNA, 15 bp, Artificial Sequence
  Description of Artificial Sequence: Synthetic oligonucleotide
agcaatggcatgcac

SEQ ID NO: 7396 - protein, 5 aa, Artificial Sequence
  Description of Artificial Sequence: Synthetic peptide
SNGMH

SEQ ID NO: 7397 - DNA, 15 bp, Artificial Sequence
  Description of Artificial Sequence: Synthetic oligonucleotide
agctatagcttgaac

SEQ ID NO: 7398 - protein, 5 aa, Artificial Sequence
  Description of Artificial Sequence: Synthetic peptide
SYSLN

SEQ ID NO: 7399 - DNA, 15 bp, Artificial Sequence
  Description of Artificial Sequence: Synthetic oligonucleotide
agctatggcatgcac

SEQ ID NO: 7400 - protein, 5 aa, Artificial Sequence
  Description of Artificial Sequence: Synthetic peptide
SYGMH

SEQ ID NO: 7401 - DNA, 15 bp, Artificial Sequence
  Description of Artificial Sequence: Synthetic oligonucleotide
agctatggcatgcac

SEQ ID NO: 7402 - protein, 5 aa, Artificial Sequence
  Description of Artificial Sequence: Synthetic peptide
SYGMH

SEQ ID NO: 7403 - DNA, 15 bp, Artificial Sequence
  Description of Artificial Sequence: Synthetic oligonucleotide
ggctatggcatgaac

SEQ ID NO: 7404 - protein, 5 aa, Artificial Sequence
  Description of Artificial Sequence: Synthetic peptide
GYGMN

SEQ ID NO: 7405 - DNA, 15 bp, Artificial Sequence
  Description of Artificial Sequence: Synthetic oligonucleotide
aactgtggcatgcac

SEQ ID NO: 7406 - protein, 5 aa, Artificial Sequence
  Description of Artificial Sequence: Synthetic peptide
NCGMH

SEQ ID NO: 7407 - DNA, 15 bp, Artificial Sequence
  Description of Artificial Sequence: Synthetic oligonucleotide
agctatagcttgaac

SEQ ID NO: 7408 - protein, 5 aa, Artificial Sequence
  Description of Artificial Sequence: Synthetic peptide
SYSLN

SEQ ID NO: 7409 - DNA, 15 bp, Artificial Sequence
  Description of Artificial Sequence: Synthetic oligonucleotide
agttactatatgtat

SEQ ID NO: 7410 - protein, 5 aa, Artificial Sequence
  Description of Artificial Sequence: Synthetic peptide
SYYMY

SEQ ID NO: 7411 - DNA, 15 bp, Artificial Sequence
  Description of Artificial Sequence: Synthetic oligonucleotide
agttatggcatgcac

SEQ ID NO: 7412 - protein, 5 aa, Artificial Sequence
  Description of Artificial Sequence: Synthetic peptide
SYGMH

SEQ ID NO: 7413 - DNA, 15 bp, Artificial Sequence
  Description of Artificial Sequence: Synthetic oligonucleotide
agttactatatgtat

SEQ ID NO: 7414 - protein, 5 aa, Artificial Sequence
  Description of Artificial Sequence: Synthetic peptide
SYYMY

SEQ ID NO: 7415 - DNA, 15 bp, Artificial Sequence
  Description of Artificial Sequence: Synthetic oligonucleotide
agttactatatgtat

SEQ ID NO: 7416 - protein, 5 aa, Artificial Sequence
  Description of Artificial Sequence: Synthetic peptide
SYYMY

SEQ ID NO: 7417 - DNA, 15 bp, Artificial Sequence
  Description of Artificial Sequence: Synthetic oligonucleotide
agctatggcatgcac

SEQ ID NO: 7418 - protein, 5 aa, Artificial Sequence
  Description of Artificial Sequence: Synthetic peptide
SYGMH

SEQ ID NO: 7419 - DNA, 21 bp, Artificial Sequence
  Description of Artificial Sequence: Synthetic oligonucleotide
agcaacagtgctgcttggaac

SEQ ID NO: 7420 - protein, 7 aa, Artificial Sequence
  Description of Artificial Sequence: Synthetic peptide
SNSAAWN

SEQ ID NO: 7421 - DNA, 15 bp, Artificial Sequence
  Description of Artificial Sequence: Synthetic oligonucleotide
aactgtggcatgcac

SEQ ID NO: 7422 - protein, 5 aa, Artificial Sequence
  Description of Artificial Sequence: Synthetic peptide
NCGMH

SEQ ID NO: 7423 - DNA, 21 bp, Artificial Sequence
  Description of Artificial Sequence: Synthetic oligonucleotide
agcaacagtgctgcttggaac

SEQ ID NO: 7424 - protein, 7 aa, Artificial Sequence
  Description of Artificial Sequence: Synthetic peptide
SNSAAWN

SEQ ID NO: 7425 - DNA, 15 bp, Artificial Sequence
  Description of Artificial Sequence: Synthetic oligonucleotide
agctatggcatgcac

SEQ ID NO: 7426 - protein, 5 aa, Artificial Sequence
  Description of Artificial Sequence: Synthetic peptide
SYGMH

SEQ ID NO: 7427 - DNA, 15 bp, Artificial Sequence
  Description of Artificial Sequence: Synthetic oligonucleotide
aactctggcatgcac

SEQ ID NO: 7428 - protein, 5 aa, Artificial Sequence
  Description of Artificial Sequence: Synthetic peptide
NSGMH

SEQ ID NO: 7429 - DNA, 15 bp, Artificial Sequence
  Description of Artificial Sequence: Synthetic oligonucleotide
agctatagcatgaac

SEQ ID NO: 7430 - protein, 5 aa, Artificial Sequence
  Description of Artificial Sequence: Synthetic peptide
SYSMN

SEQ ID NO: 7431 - DNA, 15 bp, Artificial Sequence
  Description of Artificial Sequence: Synthetic oligonucleotide
aactttggcatgcac

SEQ ID NO: 7432 - protein, 5 aa, Artificial Sequence
  Description of Artificial Sequence: Synthetic peptide
NFGMH

SEQ ID NO: 7433 - DNA, 21 bp, Artificial Sequence
  Description of Artificial Sequence: Synthetic oligonucleotide
actagtggagtgggtgtgggc

SEQ ID NO: 7434 - protein, 7 aa, Artificial Sequence
  Description of Artificial Sequence: Synthetic peptide
TSGVGVG

SEQ ID NO: 7435 - DNA, 15 bp, Artificial Sequence
  Description of Artificial Sequence: Synthetic oligonucleotide
agttatgatatcaac

SEQ ID NO: 7436 - protein, 5 aa, Artificial Sequence
  Description of Artificial Sequence: Synthetic peptide
SYDIN

SEQ ID NO: 7437 - DNA, 15 bp, Artificial Sequence
  Description of Artificial Sequence: Synthetic oligonucleotide
aactatggcatgcac

SEQ ID NO: 7438 - protein, 5 aa, Artificial Sequence
  Description of Artificial Sequence: Synthetic peptide
NYGMH

SEQ ID NO: 7439 - DNA, 15 bp, Artificial Sequence
  Description of Artificial Sequence: Synthetic oligonucleotide
agctatggtatcagc

SEQ ID NO: 7440 - protein, 5 aa, Artificial Sequence
  Description of Artificial Sequence: Synthetic peptide
SYGIS

SEQ ID NO: 7441 - DNA, 21 bp, Artificial Sequence
  Description of Artificial Sequence: Synthetic oligonucleotide
agtaacagtgctgcttggaac

SEQ ID NO: 7442 - protein, 7 aa, Artificial Sequence
  Description of Artificial Sequence: Synthetic peptide
SNSAAWN

SEQ ID NO: 7443 - DNA, 15 bp, Artificial Sequence
  Description of Artificial Sequence: Synthetic oligonucleotide
agctatggtgtcagc

SEQ ID NO: 7444 - protein, 5 aa, Artificial Sequence
  Description of Artificial Sequence: Synthetic peptide
SYGVS

SEQ ID NO: 7445 - DNA, 15 bp, Artificial Sequence
  Description of Artificial Sequence: Synthetic oligonucleotide
ggctatggcatgcac

SEQ ID NO: 7446 - protein, 5 aa, Artificial Sequence
  Description of Artificial Sequence: Synthetic peptide
GYGMH

SEQ ID NO: 7447 - DNA, 15 bp, Artificial Sequence
  Description of Artificial Sequence: Synthetic oligonucleotide
cactttggcatgcac

SEQ ID NO: 7448 - protein, 5 aa, Artificial Sequence
  Description of Artificial Sequence: Synthetic peptide
HFGMH

SEQ ID NO: 7449 - DNA, 15 bp, Artificial Sequence
  Description of Artificial Sequence: Synthetic oligonucleotide
ggctactatatgcac

SEQ ID NO: 7450 - protein, 5 aa, Artificial Sequence
  Description of Artificial Sequence: Synthetic peptide
GYYMH

SEQ ID NO: 7451 - DNA, 15 bp, Artificial Sequence
  Description of Artificial Sequence: Synthetic oligonucleotide
agctatggtatcagc

SEQ ID NO: 7452 - protein, 5 aa, Artificial Sequence
  Description of Artificial Sequence: Synthetic peptide
SYGIS

SEQ ID NO: 7453 - DNA, 15 bp, Artificial Sequence
  Description of Artificial Sequence: Synthetic oligonucleotide
agctatggtatcagc

SEQ ID NO: 7454 - protein, 5 aa, Artificial Sequence
  Description of Artificial Sequence: Synthetic peptide
SYGIS

SEQ ID NO: 7455 - DNA, 15 bp, Artificial Sequence
  Description of Artificial Sequence: Synthetic oligonucleotide
agctatggtttcagc

SEQ ID NO: 7456 - protein, 5 aa, Artificial Sequence
  Description of Artificial Sequence: Synthetic peptide
SYGFS

SEQ ID NO: 7457 - DNA, 21 bp, Artificial Sequence
  Description of Artificial Sequence: Synthetic oligonucleotide
actagtggagtgggtgtgggc

SEQ ID NO: 7458 - protein, 7 aa, Artificial Sequence
  Description of Artificial Sequence: Synthetic peptide
TSGVGVG

SEQ ID NO: 7459 - DNA, 21 bp, Artificial Sequence
  Description of Artificial Sequence: Synthetic oligonucleotide
actagtggagtgggtgtgggc

SEQ ID NO: 7460 - protein, 7 aa, Artificial Sequence
  Description of Artificial Sequence: Synthetic peptide
TSGVGVG

SEQ ID NO: 7461 - DNA, 21 bp, Artificial Sequence
  Description of Artificial Sequence: Synthetic oligonucleotide
actagtggagtgggtgtgggc

SEQ ID NO: 7462 - protein, 7 aa, Artificial Sequence
  Description of Artificial Sequence: Synthetic peptide
TSGVGVG

SEQ ID NO: 7463 - DNA, 21 bp, Artificial Sequence
  Description of Artificial Sequence: Synthetic oligonucleotide
actagtggagtgggtgtgggc

SEQ ID NO: 7464 - protein, 7 aa, Artificial Sequence
  Description of Artificial Sequence: Synthetic peptide
TSGVGVG

SEQ ID NO: 7465 - DNA, 15 bp, Artificial Sequence
  Description of Artificial Sequence: Synthetic oligonucleotide
agctatagcatgaac

SEQ ID NO: 7466 - protein, 5 aa, Artificial Sequence
  Description of Artificial Sequence: Synthetic peptide
SYSMN

SEQ ID NO: 7467 - DNA, 15 bp, Artificial Sequence
  Description of Artificial Sequence: Synthetic oligonucleotide
ttctatggcatgcac

SEQ ID NO: 7468 - protein, 5 aa, Artificial Sequence
  Description of Artificial Sequence: Synthetic peptide
FYGMH

SEQ ID NO: 7469 - DNA, 15 bp, Artificial Sequence
  Description of Artificial Sequence: Synthetic oligonucleotide
agcttttggatgagc

SEQ ID NO: 7470 - protein, 5 aa, Artificial Sequence
  Description of Artificial Sequence: Synthetic peptide
SFWMS

SEQ ID NO: 7471 - DNA, 15 bp, Artificial Sequence
  Description of Artificial Sequence: Synthetic oligonucleotide
agctatggcatgcac

SEQ ID NO: 7472 - protein, 5 aa, Artificial Sequence
  Description of Artificial Sequence: Synthetic peptide
SYGMH

SEQ ID NO: 7473 - DNA, 15 bp, Artificial Sequence
  Description of Artificial Sequence: Synthetic oligonucleotide
agctatagcatgaac

SEQ ID NO: 7474 - protein, 5 aa, Artificial Sequence
  Description of Artificial Sequence: Synthetic peptide
SYSMN

SEQ ID NO: 7475 - DNA, 15 bp, Artificial Sequence
  Description of Artificial Sequence: Synthetic oligonucleotide
agctatagcatgaac

SEQ ID NO: 7476 - protein, 5 aa, Artificial Sequence
  Description of Artificial Sequence: Synthetic peptide
SYSMN

SEQ ID NO: 7477 - DNA, 15 bp, Artificial Sequence
  Description of Artificial Sequence: Synthetic oligonucleotide
agttatggcgtgcac

SEQ ID NO: 7478 - protein, 5 aa, Artificial Sequence
  Description of Artificial Sequence: Synthetic peptide
SYGVH

SEQ ID NO: 7479 - DNA, 21 bp, Artificial Sequence
  Description of Artificial Sequence: Synthetic oligonucleotide
actagtggagtgggtgtgggc

SEQ ID NO: 7480 - protein, 7 aa, Artificial Sequence
  Description of Artificial Sequence: Synthetic peptide
TSGVGVG

SEQ ID NO: 7481 - DNA, 15 bp, Artificial Sequence
  Description of Artificial Sequence: Synthetic oligonucleotide
agctatagcatgaac

SEQ ID NO: 7482 - protein, 5 aa, Artificial Sequence
  Description of Artificial Sequence: Synthetic peptide
SYSMN

SEQ ID NO: 7483 - DNA, 21 bp, Artificial Sequence
  Description of Artificial Sequence: Synthetic oligonucleotide
actagtggagtgggtgtgggc

SEQ ID NO: 7484 - protein, 7 aa, Artificial Sequence
  Description of Artificial Sequence: Synthetic peptide
TSGVGVG

SEQ ID NO: 7485 - DNA, 21 bp, Artificial Sequence
  Description of Artificial Sequence: Synthetic oligonucleotide
actagtgggttgggtgtgggc

SEQ ID NO: 7486 - protein, 7 aa, Artificial Sequence
  Description of Artificial Sequence: Synthetic peptide
TSGLGVG

SEQ ID NO: 7487 - DNA, 21 bp, Artificial Sequence
  Description of Artificial Sequence: Synthetic oligonucleotide
actagtggagtgggtgtgggc

SEQ ID NO: 7488 - protein, 7 aa, Artificial Sequence
  Description of Artificial Sequence: Synthetic peptide
TSGVGVG

SEQ ID NO: 7489 - DNA, 21 bp, Artificial Sequence
  Description of Artificial Sequence: Synthetic oligonucleotide
actagtggagtgggtgtgggc

SEQ ID NO: 7490 - protein, 7 aa, Artificial Sequence
  Description of Artificial Sequence: Synthetic peptide
TSGVGVG

SEQ ID NO: 7491 - DNA, 21 bp, Artificial Sequence
  Description of Artificial Sequence: Synthetic oligonucleotide
actagtggagtgggtgtgggc

SEQ ID NO: 7492 - protein, 7 aa, Artificial Sequence
  Description of Artificial Sequence: Synthetic peptide
TSGVGVG

SEQ ID NO: 7493 - DNA, 21 bp, Artificial Sequence
  Description of Artificial Sequence: Synthetic oligonucleotide
actagtggagtgggtgtgggc

SEQ ID NO: 7494 - protein, 7 aa, Artificial Sequence
  Description of Artificial Sequence: Synthetic peptide
TSGVGVG

SEQ ID NO: 7495 - DNA, 21 bp, Artificial Sequence
  Description of Artificial Sequence: Synthetic oligonucleotide
actagtggagtgggtgtgggc

SEQ ID NO: 7496 - protein, 7 aa, Artificial Sequence
  Description of Artificial Sequence: Synthetic peptide
TSGVGVG

SEQ ID NO: 7497 - DNA, 15 bp, Artificial Sequence
  Description of Artificial Sequence: Synthetic oligonucleotide
agctatagcatgaac

SEQ ID NO: 7498 - protein, 5 aa, Artificial Sequence
  Description of Artificial Sequence: Synthetic peptide
SYSMN

SEQ ID NO: 7499 - DNA, 15 bp, Artificial Sequence
  Description of Artificial Sequence: Synthetic oligonucleotide
agctatagcatgaac

SEQ ID NO: 7500 - protein, 5 aa, Artificial Sequence
  Description of Artificial Sequence: Synthetic peptide
SYSMN

SEQ ID NO: 7501 - DNA, 15 bp, Artificial Sequence
  Description of Artificial Sequence: Synthetic oligonucleotide
ggctactatatgcac

SEQ ID NO: 7502 - protein, 5 aa, Artificial Sequence
  Description of Artificial Sequence: Synthetic peptide
GYYMH

SEQ ID NO: 7503 - DNA, 21 bp, Artificial Sequence
  Description of Artificial Sequence: Synthetic oligonucleotide
actagtggagtgggtgtgggc

SEQ ID NO: 7504 - protein, 7 aa, Artificial Sequence
  Description of Artificial Sequence: Synthetic peptide
TSGVGVG

SEQ ID NO: 7505 - DNA, 15 bp, Artificial Sequence
  Description of Artificial Sequence: Synthetic oligonucleotide
ggctactatatgcac

SEQ ID NO: 7506 - protein, 5 aa, Artificial Sequence
  Description of Artificial Sequence: Synthetic peptide
GYYMH

SEQ ID NO: 7507 - DNA, 21 bp, Artificial Sequence
  Description of Artificial Sequence: Synthetic oligonucleotide
agcaacagtgctgcttggaac

SEQ ID NO: 7508 - protein, 7 aa, Artificial Sequence
  Description of Artificial Sequence: Synthetic peptide
SNSAAWN

SEQ ID NO: 7509 - DNA, 15 bp, Artificial Sequence
  Description of Artificial Sequence: Synthetic oligonucleotide
ggctaccatatgcac

SEQ ID NO: 7510 - protein, 5 aa, Artificial Sequence
  Description of Artificial Sequence: Synthetic peptide
GYHMH

SEQ ID NO: 7511 - DNA, 15 bp, Artificial Sequence
  Description of Artificial Sequence: Synthetic oligonucleotide
ggctactatatgcac

SEQ ID NO: 7512 - protein, 5 aa, Artificial Sequence
  Description of Artificial Sequence: Synthetic peptide
GYYMH

SEQ ID NO: 7513 - DNA, 15 bp, Artificial Sequence
  Description of Artificial Sequence: Synthetic oligonucleotide
ggctactgtatgcac

SEQ ID NO: 7514 - protein, 5 aa, Artificial Sequence
  Description of Artificial Sequence: Synthetic peptide
GYCMH

SEQ ID NO: 7515 - DNA, 15 bp, Artificial Sequence
  Description of Artificial Sequence: Synthetic oligonucleotide
ggctactatatgcac

SEQ ID NO: 7516 - protein, 5 aa, Artificial Sequence
  Description of Artificial Sequence: Synthetic peptide
GYYMH

SEQ ID NO: 7517 - DNA, 21 bp, Artificial Sequence
  Description of Artificial Sequence: Synthetic oligonucleotide
actagtggagtgggtgtgggc

SEQ ID NO: 7518 - protein, 7 aa, Artificial Sequence
  Description of Artificial Sequence: Synthetic peptide
TSGVGVG

SEQ ID NO: 7519 - DNA, 15 bp, Artificial Sequence
  Description of Artificial Sequence: Synthetic oligonucleotide
tactatggcatgcac

SEQ ID NO: 7520 - protein, 5 aa, Artificial Sequence
  Description of Artificial Sequence: Synthetic peptide
YYGMH

SEQ ID NO: 7521 - DNA, 21 bp, Artificial Sequence
  Description of Artificial Sequence: Synthetic oligonucleotide
actagtggagtgggtgtgggc

SEQ ID NO: 7522 - protein, 7 aa, Artificial Sequence
  Description of Artificial Sequence: Synthetic peptide
TSGVGVG

SEQ ID NO: 7523 - DNA, 21 bp, Artificial Sequence
  Description of Artificial Sequence: Synthetic oligonucleotide
actggtggagtgggtgtgggc

SEQ ID NO: 7524 - protein, 7 aa, Artificial Sequence
  Description of Artificial Sequence: Synthetic peptide
TGGVGVG

SEQ ID NO: 7525 - DNA, 15 bp, Artificial Sequence
  Description of Artificial Sequence: Synthetic oligonucleotide
agctatggcatgcac

SEQ ID NO: 7526 - protein, 5 aa, Artificial Sequence
  Description of Artificial Sequence: Synthetic peptide
SYGMH

SEQ ID NO: 7527 - DNA, 21 bp, Artificial Sequence
  Description of Artificial Sequence: Synthetic oligonucleotide
actagtggagtgggtgtgggc

SEQ ID NO: 7528 - protein, 7 aa, Artificial Sequence
  Description of Artificial Sequence: Synthetic peptide
TSGVGVG

SEQ ID NO: 7529 - DNA, 21 bp, Artificial Sequence
  Description of Artificial Sequence: Synthetic oligonucleotide
agtggtggttactactggagc

SEQ ID NO: 7530 - protein, 7 aa, Artificial Sequence
  Description of Artificial Sequence: Synthetic peptide
SGGYYWS

SEQ ID NO: 7531 - DNA, 15 bp, Artificial Sequence
  Description of Artificial Sequence: Synthetic oligonucleotide
agctatggcatgcac

SEQ ID NO: 7532 - protein, 5 aa, Artificial Sequence
  Description of Artificial Sequence: Synthetic peptide
SYGMH

SEQ ID NO: 7533 - DNA, 15 bp, Artificial Sequence
  Description of Artificial Sequence: Synthetic oligonucleotide
cgatatggcatgcac

SEQ ID NO: 7534 - protein, 5 aa, Artificial Sequence
  Description of Artificial Sequence: Synthetic peptide
RYGMH

SEQ ID NO: 7535 - DNA, 21 bp, Artificial Sequence
  Description of Artificial Sequence: Synthetic oligonucleotide
agtggtggttactactggagc

SEQ ID NO: 7536 - protein, 7 aa, Artificial Sequence
  Description of Artificial Sequence: Synthetic peptide
SGGYYWS

SEQ ID NO: 7537 - DNA, 15 bp, Artificial Sequence
  Description of Artificial Sequence: Synthetic oligonucleotide
agctatggcatgcac

SEQ ID NO: 7538 - protein, 5 aa, Artificial Sequence
  Description of Artificial Sequence: Synthetic peptide
SYGMH

SEQ ID NO: 7539 - DNA, 15 bp, Artificial Sequence
  Description of Artificial Sequence: Synthetic oligonucleotide
agctatggcatgcac

SEQ ID NO: 7540 - protein, 5 aa, Artificial Sequence
  Description of Artificial Sequence: Synthetic peptide
SYGMH

SEQ ID NO: 7541 - DNA, 21 bp, Artificial Sequence
  Description of Artificial Sequence: Synthetic oligonucleotide
actggtggagtgggtgtgggc

SEQ ID NO: 7542 - protein, 7 aa, Artificial Sequence
  Description of Artificial Sequence: Synthetic peptide
TGGVGVG

SEQ ID NO: 7543 - DNA, 15 bp, Artificial Sequence
  Description of Artificial Sequence: Synthetic oligonucleotide
agctatggcatgcac

SEQ ID NO: 7544 - protein, 5 aa, Artificial Sequence
  Description of Artificial Sequence: Synthetic peptide
SYGMH

SEQ ID NO: 7545 - DNA, 15 bp, Artificial Sequence
  Description of Artificial Sequence: Synthetic oligonucleotide
agctatgccatgagc

SEQ ID NO: 7546 - protein, 5 aa, Artificial Sequence
  Description of Artificial Sequence: Synthetic peptide
SYAMS

SEQ ID NO: 7547 - DNA, 15 bp, Artificial Sequence
  Description of Artificial Sequence: Synthetic oligonucleotide
acctatggcatgcac

SEQ ID NO: 7548 - protein, 5 aa, Artificial Sequence
  Description of Artificial Sequence: Synthetic peptide
TYGMH

SEQ ID NO: 7549 - DNA, 15 bp, Artificial Sequence
  Description of Artificial Sequence: Synthetic oligonucleotide
agttatgatatcaat

SEQ ID NO: 7550 - protein, 5 aa, Artificial Sequence
  Description of Artificial Sequence: Synthetic peptide
SYDIN

SEQ ID NO: 7551 - DNA, 21 bp, Artificial Sequence
  Description of Artificial Sequence: Synthetic oligonucleotide
actactggagtgggtgtgggc

SEQ ID NO: 7552 - protein, 7 aa, Artificial Sequence
  Description of Artificial Sequence: Synthetic peptide
TTGVGVG

SEQ ID NO: 7553 - DNA, 15 bp, Artificial Sequence
  Description of Artificial Sequence: Synthetic oligonucleotide
agctatggcatgcac

SEQ ID NO: 7554 - protein, 5 aa, Artificial Sequence
  Description of Artificial Sequence: Synthetic peptide
SYGMH

SEQ ID NO: 7555 - DNA, 15 bp, Artificial Sequence
  Description of Artificial Sequence: Synthetic oligonucleotide
agttatggcatgctc

SEQ ID NO: 7556 - protein, 5 aa, Artificial Sequence
  Description of Artificial Sequence: Synthetic peptide
SYGML

SEQ ID NO: 7557 - DNA, 15 bp, Artificial Sequence
  Description of Artificial Sequence: Synthetic oligonucleotide
agctatggcatgcac

SEQ ID NO: 7558 - protein, 5 aa, Artificial Sequence
  Description of Artificial Sequence: Synthetic peptide
SYGMH

SEQ ID NO: 7559 - DNA, 15 bp, Artificial Sequence
  Description of Artificial Sequence: Synthetic oligonucleotide
aactatggcatgcac

SEQ ID NO: 7560 - protein, 5 aa, Artificial Sequence
  Description of Artificial Sequence: Synthetic peptide
NYGMH

SEQ ID NO: 7561 - DNA, 21 bp, Artificial Sequence
  Description of Artificial Sequence: Synthetic oligonucleotide
actggtggagtgggtgtgggc

SEQ ID NO: 7562 - protein, 7 aa, Artificial Sequence
  Description of Artificial Sequence: Synthetic peptide
TGGVGVG

SEQ ID NO: 7563 - DNA, 21 bp, Artificial Sequence
  Description of Artificial Sequence: Synthetic oligonucleotide
actagtggagtgggtgtgggc

SEQ ID NO: 7564 - protein, 7 aa, Artificial Sequence
  Description of Artificial Sequence: Synthetic peptide
TSGVGVG

SEQ ID NO: 7565 - DNA, 21 bp, Artificial Sequence
  Description of Artificial Sequence: Synthetic oligonucleotide
agtggtggttactactggagc

SEQ ID NO: 7566 - protein, 7 aa, Artificial Sequence
  Description of Artificial Sequence: Synthetic peptide
SGGYYWS

SEQ ID NO: 7567 - DNA, 15 bp, Artificial Sequence
  Description of Artificial Sequence: Synthetic oligonucleotide
agctatggcatgcat

SEQ ID NO: 7568 - protein, 5 aa, Artificial Sequence
  Description of Artificial Sequence: Synthetic peptide
SYGMH

SEQ ID NO: 7569 - DNA, 21 bp, Artificial Sequence
  Description of Artificial Sequence: Synthetic oligonucleotide
aggaaaagtgctacttggaac

SEQ ID NO: 7570 - protein, 7 aa, Artificial Sequence
  Description of Artificial Sequence: Synthetic peptide
RKSATWN

SEQ ID NO: 7571 - DNA, 15 bp, Artificial Sequence
  Description of Artificial Sequence: Synthetic oligonucleotide
aactatggcatacac

SEQ ID NO: 7572 - protein, 5 aa, Artificial Sequence
  Description of Artificial Sequence: Synthetic peptide
NYGIH

SEQ ID NO: 7573 - DNA, 15 bp, Artificial Sequence
  Description of Artificial Sequence: Synthetic oligonucleotide
agctatggcatgcac

SEQ ID NO: 7574 - protein, 5 aa, Artificial Sequence
  Description of Artificial Sequence: Synthetic peptide
SYGMH

SEQ ID NO: 7575 - DNA, 15 bp, Artificial Sequence
  Description of Artificial Sequence: Synthetic oligonucleotide
agctatggcatgcac

SEQ ID NO: 7576 - protein, 5 aa, Artificial Sequence
  Description of Artificial Sequence: Synthetic peptide
SYGMH

SEQ ID NO: 7577 - DNA, 15 bp, Artificial Sequence
  Description of Artificial Sequence: Synthetic oligonucleotide
agctatggcatgcac

SEQ ID NO: 7578 - protein, 5 aa, Artificial Sequence
  Description of Artificial Sequence: Synthetic peptide
SYGMH

SEQ ID NO: 7579 - DNA, 15 bp, Artificial Sequence
  Description of Artificial Sequence: Synthetic oligonucleotide
ggctactatatgcac

SEQ ID NO: 7580 - protein, 5 aa, Artificial Sequence
  Description of Artificial Sequence: Synthetic peptide
GYYMH

SEQ ID NO: 7581 - DNA, 15 bp, Artificial Sequence
  Description of Artificial Sequence: Synthetic oligonucleotide
agctatggcatgcat

SEQ ID NO: 7582 - protein, 5 aa, Artificial Sequence
  Description of Artificial Sequence: Synthetic peptide
SYGMH

SEQ ID NO: 7583 - DNA, 15 bp, Artificial Sequence
  Description of Artificial Sequence: Synthetic oligonucleotide
agctatggcctgcac

SEQ ID NO: 7584 - protein, 5 aa, Artificial Sequence
  Description of Artificial Sequence: Synthetic peptide
SYGLH

SEQ ID NO: 7585 - DNA, 21 bp, Artificial Sequence
  Description of Artificial Sequence: Synthetic oligonucleotide
aggaaaagtgctacttggaac

SEQ ID NO: 7586 - protein, 7 aa, Artificial Sequence
  Description of Artificial Sequence: Synthetic peptide
RKSATWN

SEQ ID NO: 7587 - DNA, 15 bp, Artificial Sequence
  Description of Artificial Sequence: Synthetic oligonucleotide
aactatggcatgcac

SEQ ID NO: 7588 - protein, 5 aa, Artificial Sequence
  Description of Artificial Sequence: Synthetic peptide
NYGMH

SEQ ID NO: 7589 - DNA, 15 bp, Artificial Sequence
  Description of Artificial Sequence: Synthetic oligonucleotide
agctatggcatgcat

SEQ ID NO: 7590 - protein, 5 aa, Artificial Sequence
  Description of Artificial Sequence: Synthetic peptide
SYGMH

SEQ ID NO: 7591 - DNA, 21 bp, Artificial Sequence
  Description of Artificial Sequence: Synthetic oligonucleotide
agtggtggtgactactggagc

SEQ ID NO: 7592 - protein, 7 aa, Artificial Sequence
  Description of Artificial Sequence: Synthetic peptide
SGGDYWS

SEQ ID NO: 7593 - DNA, 15 bp, Artificial Sequence
  Description of Artificial Sequence: Synthetic oligonucleotide
agttactactggatc

SEQ ID NO: 7594 - protein, 5 aa, Artificial Sequence
  Description of Artificial Sequence: Synthetic peptide
SYYWI

SEQ ID NO: 7595 - DNA, 21 bp, Artificial Sequence
  Description of Artificial Sequence: Synthetic oligonucleotide
agtggtggtgactactggagc

SEQ ID NO: 7596 - protein, 7 aa, Artificial Sequence
  Description of Artificial Sequence: Synthetic peptide
SGGDYWS

SEQ ID NO: 7597 - DNA, 15 bp, Artificial Sequence
  Description of Artificial Sequence: Synthetic oligonucleotide
agctatggcatgcac

SEQ ID NO: 7598 - protein, 5 aa, Artificial Sequence
  Description of Artificial Sequence: Synthetic peptide
SYGMH

SEQ ID NO: 7599 - DNA, 15 bp, Artificial Sequence
  Description of Artificial Sequence: Synthetic oligonucleotide
aattatggcatgcac

SEQ ID NO: 7600 - protein, 5 aa, Artificial Sequence
  Description of Artificial Sequence: Synthetic peptide
NYGMH

SEQ ID NO: 7601 - DNA, 15 bp, Artificial Sequence
  Description of Artificial Sequence: Synthetic oligonucleotide
ttccatggcatgcac

SEQ ID NO: 7602 - protein, 5 aa, Artificial Sequence
  Description of Artificial Sequence: Synthetic peptide
FHGMH

SEQ ID NO: 7603 - DNA, 15 bp, Artificial Sequence
  Description of Artificial Sequence: Synthetic oligonucleotide
acctatggcatgcac

SEQ ID NO: 7604 - protein, 5 aa, Artificial Sequence
  Description of Artificial Sequence: Synthetic peptide
TYGMH

SEQ ID NO: 7605 - DNA, 15 bp, Artificial Sequence
  Description of Artificial Sequence: Synthetic oligonucleotide
ggctacaatatgcac

SEQ ID NO: 7606 - protein, 5 aa, Artificial Sequence
  Description of Artificial Sequence: Synthetic peptide
GYNMH

SEQ ID NO: 7607 - DNA, 15 bp, Artificial Sequence
  Description of Artificial Sequence: Synthetic oligonucleotide
agctatggcatgcac

SEQ ID NO: 7608 - protein, 5 aa, Artificial Sequence
  Description of Artificial Sequence: Synthetic peptide
SYGMH

SEQ ID NO: 7609 - DNA, 21 bp, Artificial Sequence
  Description of Artificial Sequence: Synthetic oligonucleotide
agtggtggttactactggagc

SEQ ID NO: 7610 - protein, 7 aa, Artificial Sequence
  Description of Artificial Sequence: Synthetic peptide
SGGYYWS

SEQ ID NO: 7611 - DNA, 15 bp, Artificial Sequence
  Description of Artificial Sequence: Synthetic oligonucleotide
aattactactggagc

SEQ ID NO: 7612 - protein, 5 aa, Artificial Sequence
  Description of Artificial Sequence: Synthetic peptide
NYYWS

SEQ ID NO: 7613 - DNA, 21 bp, Artificial Sequence
  Description of Artificial Sequence: Synthetic oligonucleotide
agtggtggttactactggagc

SEQ ID NO: 7614 - protein, 7 aa, Artificial Sequence
  Description of Artificial Sequence: Synthetic peptide
SGGYYWS

SEQ ID NO: 7615 - DNA, 21 bp, Artificial Sequence
  Description of Artificial Sequence: Synthetic oligonucleotide
agtggtggtgactactggagc

SEQ ID NO: 7616 - protein, 7 aa, Artificial Sequence
  Description of Artificial Sequence: Synthetic peptide
SGGDYWS

SEQ ID NO: 7617 - DNA, 15 bp, Artificial Sequence
  Description of Artificial Sequence: Synthetic oligonucleotide
agttactactggagc

SEQ ID NO: 7618 - protein, 5 aa, Artificial Sequence
  Description of Artificial Sequence: Synthetic peptide
SYYWS

SEQ ID NO: 7619 - DNA, 15 bp, Artificial Sequence
  Description of Artificial Sequence: Synthetic oligonucleotide
aacgcctacatgacc

SEQ ID NO: 7620 - protein, 5 aa, Artificial Sequence
  Description of Artificial Sequence: Synthetic peptide
NAYMT

SEQ ID NO: 7621 - DNA, 15 bp, Artificial Sequence
  Description of Artificial Sequence: Synthetic oligonucleotide
ggctactatatgcac

SEQ ID NO: 7622 - protein, 5 aa, Artificial Sequence
  Description of Artificial Sequence: Synthetic peptide
GYYMH

SEQ ID NO: 7623 - DNA, 21 bp, Artificial Sequence
  Description of Artificial Sequence: Synthetic oligonucleotide
agtggtggtgactactggagc

SEQ ID NO: 7624 - protein, 7 aa, Artificial Sequence
  Description of Artificial Sequence: Synthetic peptide
SGGDYWS

SEQ ID NO: 7625 - DNA, 15 bp, Artificial Sequence
  Description of Artificial Sequence: Synthetic oligonucleotide
agctatggcatgcac

SEQ ID NO: 7626 - protein, 5 aa, Artificial Sequence
  Description of Artificial Sequence: Synthetic peptide
SYGMH

SEQ ID NO: 7627 - DNA, 21 bp, Artificial Sequence
  Description of Artificial Sequence: Synthetic oligonucleotide
agtggtggtgactactggagc

SEQ ID NO: 7628 - protein, 7 aa, Artificial Sequence
  Description of Artificial Sequence: Synthetic peptide
SGGDYWS

SEQ ID NO: 7629 - DNA, 15 bp, Artificial Sequence
  Description of Artificial Sequence: Synthetic oligonucleotide
agctatggcatgcac

SEQ ID NO: 7630 - protein, 5 aa, Artificial Sequence
  Description of Artificial Sequence: Synthetic peptide
SYGMH

SEQ ID NO: 7631 - DNA, 15 bp, Artificial Sequence
  Description of Artificial Sequence: Synthetic oligonucleotide
gactactacatgagc

SEQ ID NO: 7632 - protein, 5 aa, Artificial Sequence
  Description of Artificial Sequence: Synthetic peptide
DYYMS

SEQ ID NO: 7633 - DNA, 15 bp, Artificial Sequence
  Description of Artificial Sequence: Synthetic oligonucleotide
aattactactggagc

SEQ ID NO: 7634 - protein, 5 aa, Artificial Sequence
  Description of Artificial Sequence: Synthetic peptide
NYYWS

SEQ ID NO: 7635 - DNA, 15 bp, Artificial Sequence
  Description of Artificial Sequence: Synthetic oligonucleotide
ggctactatatgcac

SEQ ID NO: 7636 - protein, 5 aa, Artificial Sequence
  Description of Artificial Sequence: Synthetic peptide
GYYMH

SEQ ID NO: 7637 - DNA, 15 bp, Artificial Sequence
  Description of Artificial Sequence: Synthetic oligonucleotide
ggctactatatgcac

SEQ ID NO: 7638 - protein, 5 aa, Artificial Sequence
  Description of Artificial Sequence: Synthetic peptide
GYYMH

SEQ ID NO: 7639 - DNA, 15 bp, Artificial Sequence
  Description of Artificial Sequence: Synthetic oligonucleotide
ggctacaatatgcac

SEQ ID NO: 7640 - protein, 5 aa, Artificial Sequence
  Description of Artificial Sequence: Synthetic peptide
GYNMH

SEQ ID NO: 7641 - DNA, 15 bp, Artificial Sequence
  Description of Artificial Sequence: Synthetic oligonucleotide
ggctactatatacac

SEQ ID NO: 7642 - protein, 5 aa, Artificial Sequence
  Description of Artificial Sequence: Synthetic peptide
GYYIH

SEQ ID NO: 7643 - DNA, 15 bp, Artificial Sequence
  Description of Artificial Sequence: Synthetic oligonucleotide
atttactactggagc

SEQ ID NO: 7644 - protein, 5 aa, Artificial Sequence
  Description of Artificial Sequence: Synthetic peptide
IYYWS

SEQ ID NO: 7645 - DNA, 21 bp, Artificial Sequence
  Description of Artificial Sequence: Synthetic oligonucleotide
agtggtggttactactggagc

SEQ ID NO: 7646 - protein, 7 aa, Artificial Sequence
  Description of Artificial Sequence: Synthetic peptide
SGGYYWS

SEQ ID NO: 7647 - DNA, 15 bp, Artificial Sequence
  Description of Artificial Sequence: Synthetic oligonucleotide
ggctacaatatgcac

SEQ ID NO: 7648 - protein, 5 aa, Artificial Sequence
  Description of Artificial Sequence: Synthetic peptide
GYNMH

SEQ ID NO: 7649 - DNA, 15 bp, Artificial Sequence
  Description of Artificial Sequence: Synthetic oligonucleotide
ttccatggcatgcac

SEQ ID NO: 7650 - protein, 5 aa, Artificial Sequence
  Description of Artificial Sequence: Synthetic peptide
FHGMH

SEQ ID NO: 7651 - DNA, 21 bp, Artificial Sequence
  Description of Artificial Sequence: Synthetic oligonucleotide
agtggtggtgactactggagc

SEQ ID NO: 7652 - protein, 7 aa, Artificial Sequence
  Description of Artificial Sequence: Synthetic peptide
SGGDYWS

SEQ ID NO: 7653 - DNA, 15 bp, Artificial Sequence
  Description of Artificial Sequence: Synthetic oligonucleotide
ttctatggcatgcac

SEQ ID NO: 7654 - protein, 5 aa, Artificial Sequence
  Description of Artificial Sequence: Synthetic peptide
FYGMH

SEQ ID NO: 7655 - DNA, 15 bp, Artificial Sequence
  Description of Artificial Sequence: Synthetic oligonucleotide
atttactactggagc

SEQ ID NO: 7656 - protein, 5 aa, Artificial Sequence
  Description of Artificial Sequence: Synthetic peptide
IYYWS

SEQ ID NO: 7657 - DNA, 21 bp, Artificial Sequence
  Description of Artificial Sequence: Synthetic oligonucleotide
agtggtggtgactattggagc

SEQ ID NO: 7658 - protein, 7 aa, Artificial Sequence
  Description of Artificial Sequence: Synthetic peptide
SGGDYWS

SEQ ID NO: 7659 - DNA, 15 bp, Artificial Sequence
  Description of Artificial Sequence: Synthetic oligonucleotide
agttactactggagc

SEQ ID NO: 7660 - protein, 5 aa, Artificial Sequence
  Description of Artificial Sequence: Synthetic peptide
SYYWS

SEQ ID NO: 7661 - DNA, 21 bp, Artificial Sequence
  Description of Artificial Sequence: Synthetic oligonucleotide
agtggtggtgactactggagc

SEQ ID NO: 7662 - protein, 7 aa, Artificial Sequence
  Description of Artificial Sequence: Synthetic peptide
SGGDYWS

SEQ ID NO: 7663 - DNA, 21 bp, Artificial Sequence
  Description of Artificial Sequence: Synthetic oligonucleotide
agtggtggtgactactggagc

SEQ ID NO: 7664 - protein, 7 aa, Artificial Sequence
  Description of Artificial Sequence: Synthetic peptide
SGGDYWS

SEQ ID NO: 7665 - DNA, 21 bp, Artificial Sequence
  Description of Artificial Sequence: Synthetic oligonucleotide
cgcatcaatcctacttggaac

SEQ ID NO: 7666 - protein, 7 aa, Artificial Sequence
  Description of Artificial Sequence: Synthetic peptide
RINPTWN

SEQ ID NO: 7667 - DNA, 15 bp, Artificial Sequence
  Description of Artificial Sequence: Synthetic oligonucleotide
aactatggcatgcac

SEQ ID NO: 7668 - protein, 5 aa, Artificial Sequence
  Description of Artificial Sequence: Synthetic peptide
NYGMH

SEQ ID NO: 7669 - DNA, 21 bp, Artificial Sequence
  Description of Artificial Sequence: Synthetic oligonucleotide
cgcaccaatcctacttggaac

SEQ ID NO: 7670 - protein, 7 aa, Artificial Sequence
  Description of Artificial Sequence: Synthetic peptide
RTNPTWN

SEQ ID NO: 7671 - DNA, 15 bp, Artificial Sequence
  Description of Artificial Sequence: Synthetic oligonucleotide
aactatggcatgcac

SEQ ID NO: 7672 - protein, 5 aa, Artificial Sequence
  Description of Artificial Sequence: Synthetic peptide
NYGMH

SEQ ID NO: 7673 - DNA, 15 bp, Artificial Sequence
  Description of Artificial Sequence: Synthetic oligonucleotide
agctatggcatgcac

SEQ ID NO: 7674 - protein, 5 aa, Artificial Sequence
  Description of Artificial Sequence: Synthetic peptide
SYGMH

SEQ ID NO: 7675 - DNA, 15 bp, Artificial Sequence
  Description of Artificial Sequence: Synthetic oligonucleotide
agttatagcatgaac

SEQ ID NO: 7676 - protein, 5 aa, Artificial Sequence
  Description of Artificial Sequence: Synthetic peptide
SYSMN

SEQ ID NO: 7677 - DNA, 15 bp, Artificial Sequence
  Description of Artificial Sequence: Synthetic oligonucleotide
agctatggcatgcac

SEQ ID NO: 7678 - protein, 5 aa, Artificial Sequence
  Description of Artificial Sequence: Synthetic peptide
SYGMH

SEQ ID NO: 7679 - DNA, 21 bp, Artificial Sequence
  Description of Artificial Sequence: Synthetic oligonucleotide
agtggtggttcctactggagc

SEQ ID NO: 7680 - protein, 7 aa, Artificial Sequence
  Description of Artificial Sequence: Synthetic peptide
SGGSYWS

SEQ ID NO: 7681 - DNA, 15 bp, Artificial Sequence
  Description of Artificial Sequence: Synthetic oligonucleotide
gactactatatgaac

SEQ ID NO: 7682 - protein, 5 aa, Artificial Sequence
  Description of Artificial Sequence: Synthetic peptide
DYYMN

SEQ ID NO: 7683 - DNA, 15 bp, Artificial Sequence
  Description of Artificial Sequence: Synthetic oligonucleotide
cactatggcatgcac

SEQ ID NO: 7684 - protein, 5 aa, Artificial Sequence
  Description of Artificial Sequence: Synthetic peptide
HYGMH

SEQ ID NO: 7685 - DNA, 15 bp, Artificial Sequence
  Description of Artificial Sequence: Synthetic oligonucleotide
aactatggcatgcac

SEQ ID NO: 7686 - protein, 5 aa, Artificial Sequence
  Description of Artificial Sequence: Synthetic peptide
NYGMH

SEQ ID NO: 7687 - DNA, 15 bp, Artificial Sequence
  Description of Artificial Sequence: Synthetic oligonucleotide
cactatggcatgcac

SEQ ID NO: 7688 - protein, 5 aa, Artificial Sequence
  Description of Artificial Sequence: Synthetic peptide
HYGMH

SEQ ID NO: 7689 - DNA, 15 bp, Artificial Sequence
  Description of Artificial Sequence: Synthetic oligonucleotide
agctatgccatgcac

SEQ ID NO: 7690 - protein, 5 aa, Artificial Sequence
  Description of Artificial Sequence: Synthetic peptide
SYAMH

SEQ ID NO: 7691 - DNA, 15 bp, Artificial Sequence
  Description of Artificial Sequence: Synthetic oligonucleotide
aactatggcatgcac

SEQ ID NO: 7692 - protein, 5 aa, Artificial Sequence
  Description of Artificial Sequence: Synthetic peptide
NYGMH

SEQ ID NO: 7693 - DNA, 15 bp, Artificial Sequence
  Description of Artificial Sequence: Synthetic oligonucleotide
cactatggcatgcac

SEQ ID NO: 7694 - protein, 5 aa, Artificial Sequence
  Description of Artificial Sequence: Synthetic peptide
HYGMH

SEQ ID NO: 7695 - DNA, 21 bp, Artificial Sequence
  Description of Artificial Sequence: Synthetic oligonucleotide
agtggtggttactactggagc

SEQ ID NO: 7696 - protein, 7 aa, Artificial Sequence
  Description of Artificial Sequence: Synthetic peptide
SGGYYWS

SEQ ID NO: 7697 - DNA, 21 bp, Artificial Sequence
  Description of Artificial Sequence: Synthetic oligonucleotide
agtggtggtgactactggagc

SEQ ID NO: 7698 - protein, 7 aa, Artificial Sequence
  Description of Artificial Sequence: Synthetic peptide
SGGDYWS

SEQ ID NO: 7699 - DNA, 21 bp, Artificial Sequence
  Description of Artificial Sequence: Synthetic oligonucleotide
agtggtggtgactactggagc

SEQ ID NO: 7700 - protein, 7 aa, Artificial Sequence
  Description of Artificial Sequence: Synthetic peptide
SGGDYWS

SEQ ID NO: 7701 - DNA, 15 bp, Artificial Sequence
  Description of Artificial Sequence: Synthetic oligonucleotide
cactatggcatgcac

SEQ ID NO: 7702 - protein, 5 aa, Artificial Sequence
  Description of Artificial Sequence: Synthetic peptide
HYGMH

SEQ ID NO: 7703 - DNA, 15 bp, Artificial Sequence
  Description of Artificial Sequence: Synthetic oligonucleotide
aactatggcatgcac

SEQ ID NO: 7704 - protein, 5 aa, Artificial Sequence
  Description of Artificial Sequence: Synthetic peptide
NYGMH

SEQ ID NO: 7705 - DNA, 15 bp, Artificial Sequence
  Description of Artificial Sequence: Synthetic oligonucleotide
cactatggcatgcac

SEQ ID NO: 7706 - protein, 5 aa, Artificial Sequence
  Description of Artificial Sequence: Synthetic peptide
HYGMH

SEQ ID NO: 7707 - DNA, 15 bp, Artificial Sequence
  Description of Artificial Sequence: Synthetic oligonucleotide
cactatggcatgcac

SEQ ID NO: 7708 - protein, 5 aa, Artificial Sequence
  Description of Artificial Sequence: Synthetic peptide
HYGMH

SEQ ID NO: 7709 - DNA, 21 bp, Artificial Sequence
  Description of Artificial Sequence: Synthetic oligonucleotide
agtggtggtgactactggagc

SEQ ID NO: 7710 - protein, 7 aa, Artificial Sequence
  Description of Artificial Sequence: Synthetic peptide
SGGDYWS

SEQ ID NO: 7711 - DNA, 21 bp, Artificial Sequence
  Description of Artificial Sequence: Synthetic oligonucleotide
agtggtggtgactactggagt

SEQ ID NO: 7712 - protein, 7 aa, Artificial Sequence
  Description of Artificial Sequence: Synthetic peptide
SGGDYWS

SEQ ID NO: 7713 - DNA, 15 bp, Artificial Sequence
  Description of Artificial Sequence: Synthetic oligonucleotide
cactatggcatgcac

SEQ ID NO: 7714 - protein, 5 aa, Artificial Sequence
  Description of Artificial Sequence: Synthetic peptide
HYGMH

SEQ ID NO: 7715 - DNA, 15 bp, Artificial Sequence
  Description of Artificial Sequence: Synthetic oligonucleotide
cactatggcatgcac

SEQ ID NO: 7716 - protein, 5 aa, Artificial Sequence
  Description of Artificial Sequence: Synthetic peptide
HYGMH

SEQ ID NO: 7717 - DNA, 21 bp, Artificial Sequence
  Description of Artificial Sequence: Synthetic oligonucleotide
agtggtggtgactactggagc

SEQ ID NO: 7718 - protein, 7 aa, Artificial Sequence
  Description of Artificial Sequence: Synthetic peptide
SGGDYWS

SEQ ID NO: 7719 - DNA, 15 bp, Artificial Sequence
  Description of Artificial Sequence: Synthetic oligonucleotide
gactactatatgaac

SEQ ID NO: 7720 - protein, 5 aa, Artificial Sequence
  Description of Artificial Sequence: Synthetic peptide
DYYMN

SEQ ID NO: 7721 - DNA, 21 bp, Artificial Sequence
  Description of Artificial Sequence: Synthetic oligonucleotide
agtggtggtgactactggagt

SEQ ID NO: 7722 - protein, 7 aa, Artificial Sequence
  Description of Artificial Sequence: Synthetic peptide
SGGDYWS

SEQ ID NO: 7723 - DNA, 21 bp, Artificial Sequence
  Description of Artificial Sequence: Synthetic oligonucleotide
actgctttttactactggagc

SEQ ID NO: 7724 - protein, 7 aa, Artificial Sequence
  Description of Artificial Sequence: Synthetic peptide
TAFYYWS

SEQ ID NO: 7725 - DNA, 21 bp, Artificial Sequence
  Description of Artificial Sequence: Synthetic oligonucleotide
agtggtggtgattactggagc

SEQ ID NO: 7726 - protein, 7 aa, Artificial Sequence
  Description of Artificial Sequence: Synthetic peptide
SGGDYWS

SEQ ID NO: 7727 - DNA, 21 bp, Artificial Sequence
  Description of Artificial Sequence: Synthetic oligonucleotide
agtggtggtgactactggagc

SEQ ID NO: 7728 - protein, 7 aa, Artificial Sequence
  Description of Artificial Sequence: Synthetic peptide
SGGDYWS

SEQ ID NO: 7729 - DNA, 15 bp, Artificial Sequence
  Description of Artificial Sequence: Synthetic oligonucleotide
aacgcctggatgcac

SEQ ID NO: 7730 - protein, 5 aa, Artificial Sequence
  Description of Artificial Sequence: Synthetic peptide
NAWMH

SEQ ID NO: 7731 - DNA, 15 bp, Artificial Sequence
  Description of Artificial Sequence: Synthetic oligonucleotide
cactatggcatgcac

SEQ ID NO: 7732 - protein, 5 aa, Artificial Sequence
  Description of Artificial Sequence: Synthetic peptide
HYGMH

SEQ ID NO: 7733 - DNA, 21 bp, Artificial Sequence
  Description of Artificial Sequence: Synthetic oligonucleotide
agtggtggtgactactggagc

SEQ ID NO: 7734 - protein, 7 aa, Artificial Sequence
  Description of Artificial Sequence: Synthetic peptide
SGGDYWS

SEQ ID NO: 7735 - DNA, 15 bp, Artificial Sequence
  Description of Artificial Sequence: Synthetic oligonucleotide
cactatggcatgcac

SEQ ID NO: 7736 - protein, 5 aa, Artificial Sequence
  Description of Artificial Sequence: Synthetic peptide
HYGMH

SEQ ID NO: 7737 - DNA, 21 bp, Artificial Sequence
  Description of Artificial Sequence: Synthetic oligonucleotide
agtggtggtgactactggagc

SEQ ID NO: 7738 - protein, 7 aa, Artificial Sequence
  Description of Artificial Sequence: Synthetic peptide
SGGDYWS

SEQ ID NO: 7739 - DNA, 21 bp, Artificial Sequence
  Description of Artificial Sequence: Synthetic oligonucleotide
agtggtggtgattactggagc

SEQ ID NO: 7740 - protein, 7 aa, Artificial Sequence
  Description of Artificial Sequence: Synthetic peptide
SGGDYWS

SEQ ID NO: 7741 - DNA, 15 bp, Artificial Sequence
  Description of Artificial Sequence: Synthetic oligonucleotide
agctatgccatgcac

SEQ ID NO: 7742 - protein, 5 aa, Artificial Sequence
  Description of Artificial Sequence: Synthetic peptide
SYAMH

SEQ ID NO: 7743 - DNA, 15 bp, Artificial Sequence
  Description of Artificial Sequence: Synthetic oligonucleotide
aactatggcatgcac

SEQ ID NO: 7744 - protein, 5 aa, Artificial Sequence
  Description of Artificial Sequence: Synthetic peptide
NYGMH

SEQ ID NO: 7745 - DNA, 15 bp, Artificial Sequence
  Description of Artificial Sequence: Synthetic oligonucleotide
aactatggcatgcac

SEQ ID NO: 7746 - protein, 5 aa, Artificial Sequence
  Description of Artificial Sequence: Synthetic peptide
NYGMH

SEQ ID NO: 7747 - DNA, 15 bp, Artificial Sequence
  Description of Artificial Sequence: Synthetic oligonucleotide
aactatggcatgcac

SEQ ID NO: 7748 - protein, 5 aa, Artificial Sequence
  Description of Artificial Sequence: Synthetic peptide
NYGMH

SEQ ID NO: 7749 - DNA, 15 bp, Artificial Sequence
  Description of Artificial Sequence: Synthetic oligonucleotide
agctatggcttgcac

SEQ ID NO: 7750 - protein, 5 aa, Artificial Sequence
  Description of Artificial Sequence: Synthetic peptide
SYGLH

SEQ ID NO: 7751 - DNA, 15 bp, Artificial Sequence
  Description of Artificial Sequence: Synthetic oligonucleotide
aactatggcatgcac

SEQ ID NO: 7752 - protein, 5 aa, Artificial Sequence
  Description of Artificial Sequence: Synthetic peptide
NYGMH

SEQ ID NO: 7753 - DNA, 15 bp, Artificial Sequence
  Description of Artificial Sequence: Synthetic oligonucleotide
cactatggcatgcac

SEQ ID NO: 7754 - protein, 5 aa, Artificial Sequence
  Description of Artificial Sequence: Synthetic peptide
HYGMH

SEQ ID NO: 7755 - DNA, 15 bp, Artificial Sequence
  Description of Artificial Sequence: Synthetic oligonucleotide
cactatggcatgcac

SEQ ID NO: 7756 - protein, 5 aa, Artificial Sequence
  Description of Artificial Sequence: Synthetic peptide
HYGMH

SEQ ID NO: 7757 - DNA, 15 bp, Artificial Sequence
  Description of Artificial Sequence: Synthetic oligonucleotide
cactatggcatgcac

SEQ ID NO: 7758 - protein, 5 aa, Artificial Sequence
  Description of Artificial Sequence: Synthetic peptide
HYGMH

SEQ ID NO: 7759 - DNA, 21 bp, Artificial Sequence
  Description of Artificial Sequence: Synthetic oligonucleotide
agcaacagtgctgcttggaac

SEQ ID NO: 7760 - protein, 7 aa, Artificial Sequence
  Description of Artificial Sequence: Synthetic peptide
SNSAAWN

SEQ ID NO: 7761 - DNA, 15 bp, Artificial Sequence
  Description of Artificial Sequence: Synthetic oligonucleotide
ggctactatatacac

SEQ ID NO: 7762 - protein, 5 aa, Artificial Sequence
  Description of Artificial Sequence: Synthetic peptide
GYYIH

SEQ ID NO: 7763 - DNA, 15 bp, Artificial Sequence
  Description of Artificial Sequence: Synthetic oligonucleotide
acctatggcatgcac

SEQ ID NO: 7764 - protein, 5 aa, Artificial Sequence
  Description of Artificial Sequence: Synthetic peptide
TYGMH

SEQ ID NO: 7765 - DNA, 15 bp, Artificial Sequence
  Description of Artificial Sequence: Synthetic oligonucleotide
agctatggcatgcac

SEQ ID NO: 7766 - protein, 5 aa, Artificial Sequence
  Description of Artificial Sequence: Synthetic peptide
SYGMH

SEQ ID NO: 7767 - DNA, 15 bp, Artificial Sequence
  Description of Artificial Sequence: Synthetic oligonucleotide
ggctactttatgcac

SEQ ID NO: 7768 - protein, 5 aa, Artificial Sequence
  Description of Artificial Sequence: Synthetic peptide
GYFMH

SEQ ID NO: 7769 - DNA, 15 bp, Artificial Sequence
  Description of Artificial Sequence: Synthetic oligonucleotide
ggctactatatgcac

SEQ ID NO: 7770 - protein, 5 aa, Artificial Sequence
  Description of Artificial Sequence: Synthetic peptide
GYYMH

SEQ ID NO: 7771 - DNA, 15 bp, Artificial Sequence
  Description of Artificial Sequence: Synthetic oligonucleotide
ggctactatatacac

SEQ ID NO: 7772 - protein, 5 aa, Artificial Sequence
  Description of Artificial Sequence: Synthetic peptide
GYYIH

SEQ ID NO: 7773 - DNA, 15 bp, Artificial Sequence
  Description of Artificial Sequence: Synthetic oligonucleotide
ggctactttatgcac

SEQ ID NO: 7774 - protein, 5 aa, Artificial Sequence
  Description of Artificial Sequence: Synthetic peptide
GYFMH

SEQ ID NO: 7775 - DNA, 15 bp, Artificial Sequence
  Description of Artificial Sequence: Synthetic oligonucleotide
ggctactatatgcac

SEQ ID NO: 7776 - protein, 5 aa, Artificial Sequence
  Description of Artificial Sequence: Synthetic peptide
GYYMH

SEQ ID NO: 7777 - DNA, 15 bp, Artificial Sequence
  Description of Artificial Sequence: Synthetic oligonucleotide
agctatgccatgagc

SEQ ID NO: 7778 - protein, 5 aa, Artificial Sequence
  Description of Artificial Sequence: Synthetic peptide
SYAMS

SEQ ID NO: 7779 - DNA, 15 bp, Artificial Sequence
  Description of Artificial Sequence: Synthetic oligonucleotide
ggctactatatgcac

SEQ ID NO: 7780 - protein, 5 aa, Artificial Sequence
  Description of Artificial Sequence: Synthetic peptide
GYYMH

SEQ ID NO: 7781 - DNA, 21 bp, Artificial Sequence
  Description of Artificial Sequence: Synthetic oligonucleotide
actagtggagtgggtgtgggc

SEQ ID NO: 7782 - protein, 7 aa, Artificial Sequence
  Description of Artificial Sequence: Synthetic peptide
TSGVGVG

SEQ ID NO: 7783 - DNA, 15 bp, Artificial Sequence
  Description of Artificial Sequence: Synthetic oligonucleotide
agctatgccatgaac

SEQ ID NO: 7784 - protein, 5 aa, Artificial Sequence
  Description of Artificial Sequence: Synthetic peptide
SYAMN

SEQ ID NO: 7785 - DNA, 15 bp, Artificial Sequence
  Description of Artificial Sequence: Synthetic oligonucleotide
agctatgtcatgagc

SEQ ID NO: 7786 - protein, 5 aa, Artificial Sequence
  Description of Artificial Sequence: Synthetic peptide
SYVMS

SEQ ID NO: 7787 - DNA, 15 bp, Artificial Sequence
  Description of Artificial Sequence: Synthetic oligonucleotide
agctatagcatgaac

SEQ ID NO: 7788 - protein, 5 aa, Artificial Sequence
  Description of Artificial Sequence: Synthetic peptide
SYSMN

SEQ ID NO: 7789 - DNA, 15 bp, Artificial Sequence
  Description of Artificial Sequence: Synthetic oligonucleotide
aactatagaatgaac

SEQ ID NO: 7790 - protein, 5 aa, Artificial Sequence
  Description of Artificial Sequence: Synthetic peptide
NYRMN

SEQ ID NO: 7791 - DNA, 15 bp, Artificial Sequence
  Description of Artificial Sequence: Synthetic oligonucleotide
agctttggcatgaac

SEQ ID NO: 7792 - protein, 5 aa, Artificial Sequence
  Description of Artificial Sequence: Synthetic peptide
SFGMN

SEQ ID NO: 7793 - DNA, 15 bp, Artificial Sequence
  Description of Artificial Sequence: Synthetic oligonucleotide
agctatgccatgagc

SEQ ID NO: 7794 - protein, 5 aa, Artificial Sequence
  Description of Artificial Sequence: Synthetic peptide
SYAMS

SEQ ID NO: 7795 - DNA, 15 bp, Artificial Sequence
  Description of Artificial Sequence: Synthetic oligonucleotide
agctatagcatgaac

SEQ ID NO: 7796 - protein, 5 aa, Artificial Sequence
  Description of Artificial Sequence: Synthetic peptide
SYSMN

SEQ ID NO: 7797 - DNA, 15 bp, Artificial Sequence
  Description of Artificial Sequence: Synthetic oligonucleotide
acttctgccatgagc

SEQ ID NO: 7798 - protein, 5 aa, Artificial Sequence
  Description of Artificial Sequence: Synthetic peptide
TSAMS

SEQ ID NO: 7799 - DNA, 15 bp, Artificial Sequence
  Description of Artificial Sequence: Synthetic oligonucleotide
ggctactatatgcac

SEQ ID NO: 7800 - protein, 5 aa, Artificial Sequence
  Description of Artificial Sequence: Synthetic peptide
GYYMH

SEQ ID NO: 7801 - DNA, 15 bp, Artificial Sequence
  Description of Artificial Sequence: Synthetic oligonucleotide
gattactactggagc

SEQ ID NO: 7802 - protein, 5 aa, Artificial Sequence
  Description of Artificial Sequence: Synthetic peptide
DYYWS

SEQ ID NO: 7803 - DNA, 15 bp, Artificial Sequence
  Description of Artificial Sequence: Synthetic oligonucleotide
agctatgccatgagc

SEQ ID NO: 7804 - protein, 5 aa, Artificial Sequence
  Description of Artificial Sequence: Synthetic peptide
SYAMS

SEQ ID NO: 7805 - DNA, 15 bp, Artificial Sequence
  Description of Artificial Sequence: Synthetic oligonucleotide
agctatgccatgagc

SEQ ID NO: 7806 - protein, 5 aa, Artificial Sequence
  Description of Artificial Sequence: Synthetic peptide
SYAMS

SEQ ID NO: 7807 - DNA, 15 bp, Artificial Sequence
  Description of Artificial Sequence: Synthetic oligonucleotide
cgctatggcatgcac

SEQ ID NO: 7808 - protein, 5 aa, Artificial Sequence
  Description of Artificial Sequence: Synthetic peptide
RYGMH

SEQ ID NO: 7809 - DNA, 15 bp, Artificial Sequence
  Description of Artificial Sequence: Synthetic oligonucleotide
cgctatggcatgcac

SEQ ID NO: 7810 - protein, 5 aa, Artificial Sequence
  Description of Artificial Sequence: Synthetic peptide
RYGMH

SEQ ID NO: 7811 - DNA, 15 bp, Artificial Sequence
  Description of Artificial Sequence: Synthetic oligonucleotide
acctatggcatgcac

SEQ ID NO: 7812 - protein, 5 aa, Artificial Sequence
  Description of Artificial Sequence: Synthetic peptide
TYGMH

SEQ ID NO: 7813 - DNA, 15 bp, Artificial Sequence
  Description of Artificial Sequence: Synthetic oligonucleotide
ggctactttatgcac

SEQ ID NO: 7814 - protein, 5 aa, Artificial Sequence
  Description of Artificial Sequence: Synthetic peptide
GYFMH

SEQ ID NO: 7815 - DNA, 15 bp, Artificial Sequence
  Description of Artificial Sequence: Synthetic oligonucleotide
agctatagcatgaac

SEQ ID NO: 7816 - protein, 5 aa, Artificial Sequence
  Description of Artificial Sequence: Synthetic peptide
SYSMN

SEQ ID NO: 7817 - DNA, 15 bp, Artificial Sequence
  Description of Artificial Sequence: Synthetic oligonucleotide
ggctactttatgcac

SEQ ID NO: 7818 - protein, 5 aa, Artificial Sequence
  Description of Artificial Sequence: Synthetic peptide
GYFMH

SEQ ID NO: 7819 - DNA, 15 bp, Artificial Sequence
  Description of Artificial Sequence: Synthetic oligonucleotide
ggctactttatgcac

SEQ ID NO: 7820 - protein, 5 aa, Artificial Sequence
  Description of Artificial Sequence: Synthetic peptide
GYFMH

SEQ ID NO: 7821 - DNA, 15 bp, Artificial Sequence
  Description of Artificial Sequence: Synthetic oligonucleotide
agctatggcatggac

SEQ ID NO: 7822 - protein, 5 aa, Artificial Sequence
  Description of Artificial Sequence: Synthetic peptide
SYGMD

SEQ ID NO: 7823 - DNA, 15 bp, Artificial Sequence
  Description of Artificial Sequence: Synthetic oligonucleotide
ggctactttatgcac

SEQ ID NO: 7824 - protein, 5 aa, Artificial Sequence
  Description of Artificial Sequence: Synthetic peptide
GYFMH

SEQ ID NO: 7825 - DNA, 15 bp, Artificial Sequence
  Description of Artificial Sequence: Synthetic oligonucleotide
agctatggcatgcac

SEQ ID NO: 7826 - protein, 5 aa, Artificial Sequence
  Description of Artificial Sequence: Synthetic peptide
SYGMH

SEQ ID NO: 7827 - DNA, 15 bp, Artificial Sequence
  Description of Artificial Sequence: Synthetic oligonucleotide
gactatggcatgcac

SEQ ID NO: 7828 - protein, 5 aa, Artificial Sequence
  Description of Artificial Sequence: Synthetic peptide
DYGMH

SEQ ID NO: 7829 - DNA, 15 bp, Artificial Sequence
  Description of Artificial Sequence: Synthetic oligonucleotide
agctatgccatgagc

SEQ ID NO: 7830 - protein, 5 aa, Artificial Sequence
  Description of Artificial Sequence: Synthetic peptide
SYAMS

SEQ ID NO: 7831 - DNA, 15 bp, Artificial Sequence
  Description of Artificial Sequence: Synthetic oligonucleotide
gactatgtcatgcac

SEQ ID NO: 7832 - protein, 5 aa, Artificial Sequence
  Description of Artificial Sequence: Synthetic peptide
DYVMH

SEQ ID NO: 7833 - DNA, 15 bp, Artificial Sequence
  Description of Artificial Sequence: Synthetic oligonucleotide
gactatgtcatgcac

SEQ ID NO: 7834 - protein, 5 aa, Artificial Sequence
  Description of Artificial Sequence: Synthetic peptide
DYVMH

SEQ ID NO: 7835 - DNA, 21 bp, Artificial Sequence
  Description of Artificial Sequence: Synthetic oligonucleotide
agtggtggttactactggagc

SEQ ID NO: 7836 - protein, 7 aa, Artificial Sequence
  Description of Artificial Sequence: Synthetic peptide
SGGYYWS

SEQ ID NO: 7837 - DNA, 15 bp, Artificial Sequence
  Description of Artificial Sequence: Synthetic oligonucleotide
agctatggcatgcac

SEQ ID NO: 7838 - protein, 5 aa, Artificial Sequence
  Description of Artificial Sequence: Synthetic peptide
SYGMH

SEQ ID NO: 7839 - DNA, 15 bp, Artificial Sequence
  Description of Artificial Sequence: Synthetic oligonucleotide
gattactactggagc

SEQ ID NO: 7840 - protein, 5 aa, Artificial Sequence
  Description of Artificial Sequence: Synthetic peptide
DYYWS

SEQ ID NO: 7841 - DNA, 15 bp, Artificial Sequence
  Description of Artificial Sequence: Synthetic oligonucleotide
aattatgatatcaac

SEQ ID NO: 7842 - protein, 5 aa, Artificial Sequence
  Description of Artificial Sequence: Synthetic peptide
NYDIN

SEQ ID NO: 7843 - DNA, 15 bp, Artificial Sequence
  Description of Artificial Sequence: Synthetic oligonucleotide
ggttgctactggagc

SEQ ID NO: 7844 - protein, 5 aa, Artificial Sequence
  Description of Artificial Sequence: Synthetic peptide
GCYWS

SEQ ID NO: 7845 - DNA, 15 bp, Artificial Sequence
  Description of Artificial Sequence: Synthetic oligonucleotide
agttatggcatgcat

SEQ ID NO: 7846 - protein, 5 aa, Artificial Sequence
  Description of Artificial Sequence: Synthetic peptide
SYGMH

SEQ ID NO: 7847 - DNA, 15 bp, Artificial Sequence
  Description of Artificial Sequence: Synthetic oligonucleotide
ggttgctactggagc

SEQ ID NO: 7848 - protein, 5 aa, Artificial Sequence
  Description of Artificial Sequence: Synthetic peptide
GCYWS

SEQ ID NO: 7849 - DNA, 15 bp, Artificial Sequence
  Description of Artificial Sequence: Synthetic oligonucleotide
ggttgctactggagc

SEQ ID NO: 7850 - protein, 5 aa, Artificial Sequence
  Description of Artificial Sequence: Synthetic peptide
GCYWS

SEQ ID NO: 7851 - DNA, 21 bp, Artificial Sequence
  Description of Artificial Sequence: Synthetic oligonucleotide
actggtggagtgggtgtgggc

SEQ ID NO: 7852 - protein, 7 aa, Artificial Sequence
  Description of Artificial Sequence: Synthetic peptide
TGGVGVG

SEQ ID NO: 7853 - DNA, 15 bp, Artificial Sequence
  Description of Artificial Sequence: Synthetic oligonucleotide
ggttgctactggagc

SEQ ID NO: 7854 - protein, 5 aa, Artificial Sequence
  Description of Artificial Sequence: Synthetic peptide
GCYWS

SEQ ID NO: 7855 - DNA, 15 bp, Artificial Sequence
  Description of Artificial Sequence: Synthetic oligonucleotide
ggttgctactggagc

SEQ ID NO: 7856 - protein, 5 aa, Artificial Sequence
  Description of Artificial Sequence: Synthetic peptide
GCYWS

SEQ ID NO: 7857 - DNA, 21 bp, Artificial Sequence
  Description of Artificial Sequence: Synthetic oligonucleotide
aggagtagttactactggggc

SEQ ID NO: 7858 - protein, 7 aa, Artificial Sequence
  Description of Artificial Sequence: Synthetic peptide
RSSYYWG

SEQ ID NO: 7859 - DNA, 15 bp, Artificial Sequence
  Description of Artificial Sequence: Synthetic oligonucleotide
ggttgctactggagc

SEQ ID NO: 7860 - protein, 5 aa, Artificial Sequence
  Description of Artificial Sequence: Synthetic peptide
GCYWS

SEQ ID NO: 7861 - DNA, 15 bp, Artificial Sequence
  Description of Artificial Sequence: Synthetic oligonucleotide
aattatgatatcaac

SEQ ID NO: 7862 - protein, 5 aa, Artificial Sequence
  Description of Artificial Sequence: Synthetic peptide
NYDIN

SEQ ID NO: 7863 - DNA, 15 bp, Artificial Sequence
  Description of Artificial Sequence: Synthetic oligonucleotide
aattatgatatcaac

SEQ ID NO: 7864 - protein, 5 aa, Artificial Sequence
  Description of Artificial Sequence: Synthetic peptide
NYDIN

SEQ ID NO: 7865 - DNA, 15 bp, Artificial Sequence
  Description of Artificial Sequence: Synthetic oligonucleotide
aattatgatatcaac

SEQ ID NO: 7866 - protein, 5 aa, Artificial Sequence
  Description of Artificial Sequence: Synthetic peptide
NYDIN

SEQ ID NO: 7867 - DNA, 15 bp, Artificial Sequence
  Description of Artificial Sequence: Synthetic oligonucleotide
ggttgctactggagc

SEQ ID NO: 7868 - protein, 5 aa, Artificial Sequence
  Description of Artificial Sequence: Synthetic peptide
GCYWS

SEQ ID NO: 7869 - DNA, 15 bp, Artificial Sequence
  Description of Artificial Sequence: Synthetic oligonucleotide
aactacgacatgcac

SEQ ID NO: 7870 - protein, 5 aa, Artificial Sequence
  Description of Artificial Sequence: Synthetic peptide
NYDMH

SEQ ID NO: 7871 - DNA, 21 bp, Artificial Sequence
  Description of Artificial Sequence: Synthetic oligonucleotide
actggtggagtgggtgtgggc

SEQ ID NO: 7872 - protein, 7 aa, Artificial Sequence
  Description of Artificial Sequence: Synthetic peptide
TGGVGVG

SEQ ID NO: 7873 - DNA, 15 bp, Artificial Sequence
  Description of Artificial Sequence: Synthetic oligonucleotide
aattatgatatcaac

SEQ ID NO: 7874 - protein, 5 aa, Artificial Sequence
  Description of Artificial Sequence: Synthetic peptide
NYDIN

SEQ ID NO: 7875 - DNA, 15 bp, Artificial Sequence
  Description of Artificial Sequence: Synthetic oligonucleotide
aacgcctggatgaac

SEQ ID NO: 7876 - protein, 5 aa, Artificial Sequence
  Description of Artificial Sequence: Synthetic peptide
NAWMN

SEQ ID NO: 7877 - DNA, 15 bp, Artificial Sequence
  Description of Artificial Sequence: Synthetic oligonucleotide
aactatggcatgcac

SEQ ID NO: 7878 - protein, 5 aa, Artificial Sequence
  Description of Artificial Sequence: Synthetic peptide
NYGMH

SEQ ID NO: 7879 - DNA, 15 bp, Artificial Sequence
  Description of Artificial Sequence: Synthetic oligonucleotide
aattatgatattaat

SEQ ID NO: 7880 - protein, 5 aa, Artificial Sequence
  Description of Artificial Sequence: Synthetic peptide
NYDIN

SEQ ID NO: 7881 - DNA, 15 bp, Artificial Sequence
  Description of Artificial Sequence: Synthetic oligonucleotide
aattatgatattaat

SEQ ID NO: 7882 - protein, 5 aa, Artificial Sequence
  Description of Artificial Sequence: Synthetic peptide
NYDIN

SEQ ID NO: 7883 - DNA, 15 bp, Artificial Sequence
  Description of Artificial Sequence: Synthetic oligonucleotide
aattatgatattaat

SEQ ID NO: 7884 - protein, 5 aa, Artificial Sequence
  Description of Artificial Sequence: Synthetic peptide
NYDIN

SEQ ID NO: 7885 - DNA, 15 bp, Artificial Sequence
  Description of Artificial Sequence: Synthetic oligonucleotide
aattatgatattaat

SEQ ID NO: 7886 - protein, 5 aa, Artificial Sequence
  Description of Artificial Sequence: Synthetic peptide
NYDIN

SEQ ID NO: 7887 - DNA, 15 bp, Artificial Sequence
  Description of Artificial Sequence: Synthetic oligonucleotide
aattatgatattaat

SEQ ID NO: 7888 - protein, 5 aa, Artificial Sequence
  Description of Artificial Sequence: Synthetic peptide
NYDIN

SEQ ID NO: 7889 - DNA, 15 bp, Artificial Sequence
  Description of Artificial Sequence: Synthetic oligonucleotide
aattatgatattaat

SEQ ID NO: 7890 - protein, 5 aa, Artificial Sequence
  Description of Artificial Sequence: Synthetic peptide
NYDIN

SEQ ID NO: 7891 - DNA, 15 bp, Artificial Sequence
  Description of Artificial Sequence: Synthetic oligonucleotide
aattatgatattaat

SEQ ID NO: 7892 - protein, 5 aa, Artificial Sequence
  Description of Artificial Sequence: Synthetic peptide
NYDIN

SEQ ID NO: 7893 - DNA, 15 bp, Artificial Sequence
  Description of Artificial Sequence: Synthetic oligonucleotide
aattatgatattaat

SEQ ID NO: 7894 - protein, 5 aa, Artificial Sequence
  Description of Artificial Sequence: Synthetic peptide
NYDIN

SEQ ID NO: 7895 - DNA, 15 bp, Artificial Sequence
  Description of Artificial Sequence: Synthetic oligonucleotide
aattatgatattaat

SEQ ID NO: 7896 - protein, 5 aa, Artificial Sequence
  Description of Artificial Sequence: Synthetic peptide
NYDIN

SEQ ID NO: 7897 - DNA, 15 bp, Artificial Sequence
  Description of Artificial Sequence: Synthetic oligonucleotide
aattatgatattaat

SEQ ID NO: 7898 - protein, 5 aa, Artificial Sequence
  Description of Artificial Sequence: Synthetic peptide
NYDIN

SEQ ID NO: 7899 - DNA, 15 bp, Artificial Sequence
  Description of Artificial Sequence: Synthetic oligonucleotide
aattatgatattaat

SEQ ID NO: 7900 - protein, 5 aa, Artificial Sequence
  Description of Artificial Sequence: Synthetic peptide
NYDIN

SEQ ID NO: 7901 - DNA, 15 bp, Artificial Sequence
  Description of Artificial Sequence: Synthetic oligonucleotide
aattatgatattaat

SEQ ID NO: 7902 - protein, 5 aa, Artificial Sequence
  Description of Artificial Sequence: Synthetic peptide
NYDIN

SEQ ID NO: 7903 - DNA, 15 bp, Artificial Sequence
  Description of Artificial Sequence: Synthetic oligonucleotide
aattatgatatcaac

SEQ ID NO: 7904 - protein, 5 aa, Artificial Sequence
  Description of Artificial Sequence: Synthetic peptide
NYDIN

SEQ ID NO: 7905 - DNA, 15 bp, Artificial Sequence
  Description of Artificial Sequence: Synthetic oligonucleotide
aattatgatatcaac

SEQ ID NO: 7906 - protein, 5 aa, Artificial Sequence
  Description of Artificial Sequence: Synthetic peptide
NYDIN

SEQ ID NO: 7907 - DNA, 15 bp, Artificial Sequence
  Description of Artificial Sequence: Synthetic oligonucleotide
aattatgatatcaac

SEQ ID NO: 7908 - protein, 5 aa, Artificial Sequence
  Description of Artificial Sequence: Synthetic peptide
NYDIN

SEQ ID NO: 7909 - DNA, 15 bp, Artificial Sequence
  Description of Artificial Sequence: Synthetic oligonucleotide
aattatgatatcaac

SEQ ID NO: 7910 - protein, 5 aa, Artificial Sequence
  Description of Artificial Sequence: Synthetic peptide
NYDIN

SEQ ID NO: 7911 - DNA, 15 bp, Artificial Sequence
  Description of Artificial Sequence: Synthetic oligonucleotide
aattatgatatcaac

SEQ ID NO: 7912 - protein, 5 aa, Artificial Sequence
  Description of Artificial Sequence: Synthetic peptide
NYDIN

SEQ ID NO: 7913 - DNA, 15 bp, Artificial Sequence
  Description of Artificial Sequence: Synthetic oligonucleotide
aattatgatatcaac

SEQ ID NO: 7914 - protein, 5 aa, Artificial Sequence
  Description of Artificial Sequence: Synthetic peptide
NYDIN

SEQ ID NO: 7915 - DNA, 15 bp, Artificial Sequence
  Description of Artificial Sequence: Synthetic oligonucleotide
aattatgatatcaac

SEQ ID NO: 7916 - protein, 5 aa, Artificial Sequence
  Description of Artificial Sequence: Synthetic peptide
NYDIN

SEQ ID NO: 7917 - DNA, 15 bp, Artificial Sequence
  Description of Artificial Sequence: Synthetic oligonucleotide
aattatgatatcaac

SEQ ID NO: 7918 - protein, 5 aa, Artificial Sequence
  Description of Artificial Sequence: Synthetic peptide
NYDIN

SEQ ID NO: 7919 - DNA, 15 bp, Artificial Sequence
  Description of Artificial Sequence: Synthetic oligonucleotide
aattatgatatcaac

SEQ ID NO: 7920 - protein, 5 aa, Artificial Sequence
  Description of Artificial Sequence: Synthetic peptide
NYDIN

SEQ ID NO: 7921 - DNA, 15 bp, Artificial Sequence
  Description of Artificial Sequence: Synthetic oligonucleotide
aattatgatatcaac

SEQ ID NO: 7922 - protein, 5 aa, Artificial Sequence
  Description of Artificial Sequence: Synthetic peptide
NYDIN

SEQ ID NO: 7923 - DNA, 15 bp, Artificial Sequence
  Description of Artificial Sequence: Synthetic oligonucleotide
aattatgatatcaac

SEQ ID NO: 7924 - protein, 5 aa, Artificial Sequence
  Description of Artificial Sequence: Synthetic peptide
NYDIN

SEQ ID NO: 7925 - DNA, 15 bp, Artificial Sequence
  Description of Artificial Sequence: Synthetic oligonucleotide
aattatgatatcaac

SEQ ID NO: 7926 - protein, 5 aa, Artificial Sequence
  Description of Artificial Sequence: Synthetic peptide
NYDIN

SEQ ID NO: 7927 - DNA, 15 bp, Artificial Sequence
  Description of Artificial Sequence: Synthetic oligonucleotide
aattatgatatcaac

SEQ ID NO: 7928 - protein, 5 aa, Artificial Sequence
  Description of Artificial Sequence: Synthetic peptide
NYDIN

SEQ ID NO: 7929 - DNA, 15 bp, Artificial Sequence
  Description of Artificial Sequence: Synthetic oligonucleotide
aattatgatatcaac

SEQ ID NO: 7930 - protein, 5 aa, Artificial Sequence
  Description of Artificial Sequence: Synthetic peptide
NYDIN

SEQ ID NO: 7931 - DNA, 15 bp, Artificial Sequence
  Description of Artificial Sequence: Synthetic oligonucleotide
aattatgatatcaac

SEQ ID NO: 7932 - protein, 5 aa, Artificial Sequence
  Description of Artificial Sequence: Synthetic peptide
NYDIN

SEQ ID NO: 7933 - DNA, 15 bp, Artificial Sequence
  Description of Artificial Sequence: Synthetic oligonucleotide
aattatgatatcaac

SEQ ID NO: 7934 - protein, 5 aa, Artificial Sequence
  Description of Artificial Sequence: Synthetic peptide
NYDIN

SEQ ID NO: 7935 - DNA, 15 bp, Artificial Sequence
  Description of Artificial Sequence: Synthetic oligonucleotide
aattatgatatcaac

SEQ ID NO: 7936 - protein, 5 aa, Artificial Sequence
  Description of Artificial Sequence: Synthetic peptide
NYDIN

SEQ ID NO: 7937 - DNA, 15 bp, Artificial Sequence
  Description of Artificial Sequence: Synthetic oligonucleotide
aattatgatatcaac

SEQ ID NO: 7938 - protein, 5 aa, Artificial Sequence
  Description of Artificial Sequence: Synthetic peptide
NYDIN

SEQ ID NO: 7939 - DNA, 15 bp, Artificial Sequence
  Description of Artificial Sequence: Synthetic oligonucleotide
gactactatttgcac

SEQ ID NO: 7940 - protein, 5 aa, Artificial Sequence
  Description of Artificial Sequence: Synthetic peptide
DYYLH

SEQ ID NO: 7941 - DNA, 15 bp, Artificial Sequence
  Description of Artificial Sequence: Synthetic oligonucleotide
gactactatttgcac

SEQ ID NO: 7942 - protein, 5 aa, Artificial Sequence
  Description of Artificial Sequence: Synthetic peptide
DYYLH

SEQ ID NO: 7943 - DNA, 15 bp, Artificial Sequence
  Description of Artificial Sequence: Synthetic oligonucleotide
gactactatttgcac

SEQ ID NO: 7944 - protein, 5 aa, Artificial Sequence
  Description of Artificial Sequence: Synthetic peptide
DYYLH

SEQ ID NO: 7945 - DNA, 15 bp, Artificial Sequence
  Description of Artificial Sequence: Synthetic oligonucleotide
gactactatttgcac

SEQ ID NO: 7946 - protein, 5 aa, Artificial Sequence
  Description of Artificial Sequence: Synthetic peptide
DYYLH

SEQ ID NO: 7947 - DNA, 15 bp, Artificial Sequence
  Description of Artificial Sequence: Synthetic oligonucleotide
gactactatttgcac

SEQ ID NO: 7948 - protein, 5 aa, Artificial Sequence
  Description of Artificial Sequence: Synthetic peptide
DYYLH

SEQ ID NO: 7949 - DNA, 15 bp, Artificial Sequence
  Description of Artificial Sequence: Synthetic oligonucleotide
gactactatttgcac

SEQ ID NO: 7950 - protein, 5 aa, Artificial Sequence
  Description of Artificial Sequence: Synthetic peptide
DYYLH

SEQ ID NO: 7951 - DNA, 15 bp, Artificial Sequence
  Description of Artificial Sequence: Synthetic oligonucleotide
gactactatttgcac

SEQ ID NO: 7952 - protein, 5 aa, Artificial Sequence
  Description of Artificial Sequence: Synthetic peptide
DYYLH

SEQ ID NO: 7953 - DNA, 15 bp, Artificial Sequence
  Description of Artificial Sequence: Synthetic oligonucleotide
gactactatttgcac

SEQ ID NO: 7954 - protein, 5 aa, Artificial Sequence
  Description of Artificial Sequence: Synthetic peptide
DYYLH

SEQ ID NO: 7955 - DNA, 15 bp, Artificial Sequence
  Description of Artificial Sequence: Synthetic oligonucleotide
aactatgtcatgcac

SEQ ID NO: 7956 - protein, 5 aa, Artificial Sequence
  Description of Artificial Sequence: Synthetic peptide
NYVMH

SEQ ID NO: 7957 - DNA, 15 bp, Artificial Sequence
  Description of Artificial Sequence: Synthetic oligonucleotide
aactatgtcatgcac

SEQ ID NO: 7958 - protein, 5 aa, Artificial Sequence
  Description of Artificial Sequence: Synthetic peptide
NYVMH

SEQ ID NO: 7959 - DNA, 15 bp, Artificial Sequence
  Description of Artificial Sequence: Synthetic oligonucleotide
aactatgtcatgcac

SEQ ID NO: 7960 - protein, 5 aa, Artificial Sequence
  Description of Artificial Sequence: Synthetic peptide
NYVMH

SEQ ID NO: 7961 - DNA, 15 bp, Artificial Sequence
  Description of Artificial Sequence: Synthetic oligonucleotide
aactatgtcatgcac

SEQ ID NO: 7962 - protein, 5 aa, Artificial Sequence
  Description of Artificial Sequence: Synthetic peptide
NYVMH

SEQ ID NO: 7963 - DNA, 15 bp, Artificial Sequence
  Description of Artificial Sequence: Synthetic oligonucleotide
aactatgtcatgcac

SEQ ID NO: 7964 - protein, 5 aa, Artificial Sequence
  Description of Artificial Sequence: Synthetic peptide
NYVMH

SEQ ID NO: 7965 - DNA, 15 bp, Artificial Sequence
  Description of Artificial Sequence: Synthetic oligonucleotide
aactatgtcatgcac

SEQ ID NO: 7966 - protein, 5 aa, Artificial Sequence
  Description of Artificial Sequence: Synthetic peptide
NYVMH

SEQ ID NO: 7967 - DNA, 15 bp, Artificial Sequence
  Description of Artificial Sequence: Synthetic oligonucleotide
aactatgtcatgcac

SEQ ID NO: 7968 - protein, 5 aa, Artificial Sequence
  Description of Artificial Sequence: Synthetic peptide
NYVMH

SEQ ID NO: 7969 - DNA, 15 bp, Artificial Sequence
  Description of Artificial Sequence: Synthetic oligonucleotide
aactatgtcatgcac

SEQ ID NO: 7970 - protein, 5 aa, Artificial Sequence
  Description of Artificial Sequence: Synthetic peptide
NYVMH

SEQ ID NO: 7971 - DNA, 15 bp, Artificial Sequence
  Description of Artificial Sequence: Synthetic oligonucleotide
aactatgtcatgcac

SEQ ID NO: 7972 - protein, 5 aa, Artificial Sequence
  Description of Artificial Sequence: Synthetic peptide
NYVMH

SEQ ID NO: 7973 - DNA, 15 bp, Artificial Sequence
  Description of Artificial Sequence: Synthetic oligonucleotide
aactatgtcatgcac

SEQ ID NO: 7974 - protein, 5 aa, Artificial Sequence
  Description of Artificial Sequence: Synthetic peptide
NYVMH

SEQ ID NO: 7975 - DNA, 15 bp, Artificial Sequence
  Description of Artificial Sequence: Synthetic oligonucleotide
aactatgtcatgcac

SEQ ID NO: 7976 - protein, 5 aa, Artificial Sequence
  Description of Artificial Sequence: Synthetic peptide
NYVMH

SEQ ID NO: 7977 - DNA, 15 bp, Artificial Sequence
  Description of Artificial Sequence: Synthetic oligonucleotide
aactatgtcatgcac

SEQ ID NO: 7978 - protein, 5 aa, Artificial Sequence
  Description of Artificial Sequence: Synthetic peptide
NYVMH

SEQ ID NO: 7979 - DNA, 15 bp, Artificial Sequence
  Description of Artificial Sequence: Synthetic oligonucleotide
aactatgtcatgcac

SEQ ID NO: 7980 - protein, 5 aa, Artificial Sequence
  Description of Artificial Sequence: Synthetic peptide
NYVMH

SEQ ID NO: 7981 - DNA, 15 bp, Artificial Sequence
  Description of Artificial Sequence: Synthetic oligonucleotide
aactatgtcatgcac

SEQ ID NO: 7982 - protein, 5 aa, Artificial Sequence
  Description of Artificial Sequence: Synthetic peptide
NYVMH

SEQ ID NO: 7983 - DNA, 15 bp, Artificial Sequence
  Description of Artificial Sequence: Synthetic oligonucleotide
agctttggcatgcac

SEQ ID NO: 7984 - protein, 5 aa, Artificial Sequence
  Description of Artificial Sequence: Synthetic peptide
SFGMH

SEQ ID NO: 7985 - DNA, 15 bp, Artificial Sequence
  Description of Artificial Sequence: Synthetic oligonucleotide
agctttggcatgcac

SEQ ID NO: 7986 - protein, 5 aa, Artificial Sequence
  Description of Artificial Sequence: Synthetic peptide
SFGMH

SEQ ID NO: 7987 - DNA, 15 bp, Artificial Sequence
  Description of Artificial Sequence: Synthetic oligonucleotide
agctttggcatgcac

SEQ ID NO: 7988 - protein, 5 aa, Artificial Sequence
  Description of Artificial Sequence: Synthetic peptide
SFGMH

SEQ ID NO: 7989 - DNA, 15 bp, Artificial Sequence
  Description of Artificial Sequence: Synthetic oligonucleotide
agctttggcatgcac

SEQ ID NO: 7990 - protein, 5 aa, Artificial Sequence
  Description of Artificial Sequence: Synthetic peptide
SFGMH

SEQ ID NO: 7991 - DNA, 15 bp, Artificial Sequence
  Description of Artificial Sequence: Synthetic oligonucleotide
agctttggcatgcac

SEQ ID NO: 7992 - protein, 5 aa, Artificial Sequence
  Description of Artificial Sequence: Synthetic peptide
SFGMH

SEQ ID NO: 7993 - DNA, 15 bp, Artificial Sequence
  Description of Artificial Sequence: Synthetic oligonucleotide
agctttggcatgcac

SEQ ID NO: 7994 - protein, 5 aa, Artificial Sequence
  Description of Artificial Sequence: Synthetic peptide
SFGMH

SEQ ID NO: 7995 - DNA, 15 bp, Artificial Sequence
  Description of Artificial Sequence: Synthetic oligonucleotide
agctttggcatgcac

SEQ ID NO: 7996 - protein, 5 aa, Artificial Sequence
  Description of Artificial Sequence: Synthetic peptide
SFGMH

SEQ ID NO: 7997 - DNA, 15 bp, Artificial Sequence
  Description of Artificial Sequence: Synthetic oligonucleotide
agctttggcatgcac

SEQ ID NO: 7998 - protein, 5 aa, Artificial Sequence
  Description of Artificial Sequence: Synthetic peptide
SFGMH

SEQ ID NO: 7999 - DNA, 15 bp, Artificial Sequence
  Description of Artificial Sequence: Synthetic oligonucleotide
agctttggcatgcac

SEQ ID NO: 8000 - protein, 5 aa, Artificial Sequence
  Description of Artificial Sequence: Synthetic peptide
SFGMH

SEQ ID NO: 8001 - DNA, 15 bp, Artificial Sequence
  Description of Artificial Sequence: Synthetic oligonucleotide
agctttggcatgcac

SEQ ID NO: 8002 - protein, 5 aa, Artificial Sequence
  Description of Artificial Sequence: Synthetic peptide
SFGMH

SEQ ID NO: 8003 - DNA, 15 bp, Artificial Sequence
  Description of Artificial Sequence: Synthetic oligonucleotide
agctttggcatgcac

SEQ ID NO: 8004 - protein, 5 aa, Artificial Sequence
  Description of Artificial Sequence: Synthetic peptide
SFGMH

SEQ ID NO: 8005 - DNA, 15 bp, Artificial Sequence
  Description of Artificial Sequence: Synthetic oligonucleotide
agctttggcatgcac

SEQ ID NO: 8006 - protein, 5 aa, Artificial Sequence
  Description of Artificial Sequence: Synthetic peptide
SFGMH

SEQ ID NO: 8007 - DNA, 15 bp, Artificial Sequence
  Description of Artificial Sequence: Synthetic oligonucleotide
agctttggcatgcac

SEQ ID NO: 8008 - protein, 5 aa, Artificial Sequence
  Description of Artificial Sequence: Synthetic peptide
SFGMH

SEQ ID NO: 8009 - DNA, 15 bp, Artificial Sequence
  Description of Artificial Sequence: Synthetic oligonucleotide
agctttggcatgcac

SEQ ID NO: 8010 - protein, 5 aa, Artificial Sequence
  Description of Artificial Sequence: Synthetic peptide
SFGMH

SEQ ID NO: 8011 - DNA, 15 bp, Artificial Sequence
  Description of Artificial Sequence: Synthetic oligonucleotide
agctttggcatgcac

SEQ ID NO: 8012 - protein, 5 aa, Artificial Sequence
  Description of Artificial Sequence: Synthetic peptide
SFGMH

SEQ ID NO: 8013 - DNA, 15 bp, Artificial Sequence
  Description of Artificial Sequence: Synthetic oligonucleotide
agctttggcatgcac

SEQ ID NO: 8014 - protein, 5 aa, Artificial Sequence
  Description of Artificial Sequence: Synthetic peptide
SFGMH

SEQ ID NO: 8015 - DNA, 15 bp, Artificial Sequence
  Description of Artificial Sequence: Synthetic oligonucleotide
agctttggcatgcac

SEQ ID NO: 8016 - protein, 5 aa, Artificial Sequence
  Description of Artificial Sequence: Synthetic peptide
SFGMH

SEQ ID NO: 8017 - DNA, 15 bp, Artificial Sequence
  Description of Artificial Sequence: Synthetic oligonucleotide
agctttggcatgcac

SEQ ID NO: 8018 - protein, 5 aa, Artificial Sequence
  Description of Artificial Sequence: Synthetic peptide
SFGMH

SEQ ID NO: 8019 - DNA, 15 bp, Artificial Sequence
  Description of Artificial Sequence: Synthetic oligonucleotide
agctttggcatgcac

SEQ ID NO: 8020 - protein, 5 aa, Artificial Sequence
  Description of Artificial Sequence: Synthetic peptide
SFGMH

SEQ ID NO: 8021 - DNA, 15 bp, Artificial Sequence
  Description of Artificial Sequence: Synthetic oligonucleotide
agctttggcatgcac

SEQ ID NO: 8022 - protein, 5 aa, Artificial Sequence
  Description of Artificial Sequence: Synthetic peptide
SFGMH

SEQ ID NO: 8023 - DNA, 15 bp, Artificial Sequence
  Description of Artificial Sequence: Synthetic oligonucleotide
agctttggcatgcac

SEQ ID NO: 8024 - protein, 5 aa, Artificial Sequence
  Description of Artificial Sequence: Synthetic peptide
SFGMH

SEQ ID NO: 8025 - DNA, 21 bp, Artificial Sequence
  Description of Artificial Sequence: Synthetic oligonucleotide
aacagtggttactactggagc

SEQ ID NO: 8026 - protein, 7 aa, Artificial Sequence
  Description of Artificial Sequence: Synthetic peptide
NSGYYWS

SEQ ID NO: 8027 - DNA, 15 bp, Artificial Sequence
  Description of Artificial Sequence: Synthetic oligonucleotide
ggctactatatacac

SEQ ID NO: 8028 - protein, 5 aa, Artificial Sequence
  Description of Artificial Sequence: Synthetic peptide
GYYIH

SEQ ID NO: 8029 - DNA, 15 bp, Artificial Sequence
  Description of Artificial Sequence: Synthetic oligonucleotide
ggctactatatacac

SEQ ID NO: 8030 - protein, 5 aa, Artificial Sequence
  Description of Artificial Sequence: Synthetic peptide
GYYIH

SEQ ID NO: 8031 - DNA, 15 bp, Artificial Sequence
  Description of Artificial Sequence: Synthetic oligonucleotide
aattatgatattaat

SEQ ID NO: 8032 - protein, 5 aa, Artificial Sequence
  Description of Artificial Sequence: Synthetic peptide
NYDIN

SEQ ID NO: 8033 - DNA, 15 bp, Artificial Sequence
  Description of Artificial Sequence: Synthetic oligonucleotide
gactactatttgcac

SEQ ID NO: 8034 - protein, 5 aa, Artificial Sequence
  Description of Artificial Sequence: Synthetic peptide
DYYLH

SEQ ID NO: 8035 - DNA, 15 bp, Artificial Sequence
  Description of Artificial Sequence: Synthetic oligonucleotide
agctttggcatgcac

SEQ ID NO: 8036 - protein, 5 aa, Artificial Sequence
  Description of Artificial Sequence: Synthetic peptide
SFGMH

SEQ ID NO: 8037 - DNA, 15 bp, Artificial Sequence
  Description of Artificial Sequence: Synthetic oligonucleotide
aattatgatatcaac

SEQ ID NO: 8038 - protein, 5 aa, Artificial Sequence
  Description of Artificial Sequence: Synthetic peptide
NYDIN

SEQ ID NO: 8039 - DNA, 15 bp, Artificial Sequence
  Description of Artificial Sequence: Synthetic oligonucleotide
aattatgatatcaac

SEQ ID NO: 8040 - protein, 5 aa, Artificial Sequence
  Description of Artificial Sequence: Synthetic peptide
NYDIN

SEQ ID NO: 8041 - DNA, 15 bp, Artificial Sequence
  Description of Artificial Sequence: Synthetic oligonucleotide
agctttagcttgaac

SEQ ID NO: 8042 - protein, 5 aa, Artificial Sequence
  Description of Artificial Sequence: Synthetic peptide
SFSLN

SEQ ID NO: 8043 - DNA, 15 bp, Artificial Sequence
  Description of Artificial Sequence: Synthetic oligonucleotide
agttatagcatgaac

SEQ ID NO: 8044 - protein, 5 aa, Artificial Sequence
  Description of Artificial Sequence: Synthetic peptide
SYSMN

SEQ ID NO: 8045 - DNA, 15 bp, Artificial Sequence
  Description of Artificial Sequence: Synthetic oligonucleotide
agctatggcatgcac

SEQ ID NO: 8046 - protein, 5 aa, Artificial Sequence
  Description of Artificial Sequence: Synthetic peptide
SYGMH

SEQ ID NO: 8047 - DNA, 15 bp, Artificial Sequence
  Description of Artificial Sequence: Synthetic oligonucleotide
tactatggcttgcac

SEQ ID NO: 8048 - protein, 5 aa, Artificial Sequence
  Description of Artificial Sequence: Synthetic peptide
YYGLH

SEQ ID NO: 8049 - DNA, 15 bp, Artificial Sequence
  Description of Artificial Sequence: Synthetic oligonucleotide
agctatggtatcagc

SEQ ID NO: 8050 - protein, 5 aa, Artificial Sequence
  Description of Artificial Sequence: Synthetic peptide
SYGIS

SEQ ID NO: 8051 - DNA, 15 bp, Artificial Sequence
  Description of Artificial Sequence: Synthetic oligonucleotide
agctatggtatcagc

SEQ ID NO: 8052 - protein, 5 aa, Artificial Sequence
  Description of Artificial Sequence: Synthetic peptide
SYGIS

SEQ ID NO: 8053 - DNA, 15 bp, Artificial Sequence
  Description of Artificial Sequence: Synthetic oligonucleotide
agctatggtatcagc

SEQ ID NO: 8054 - protein, 5 aa, Artificial Sequence
  Description of Artificial Sequence: Synthetic peptide
SYGIS

SEQ ID NO: 8055 - DNA, 15 bp, Artificial Sequence
  Description of Artificial Sequence: Synthetic oligonucleotide
agctatggcatgcac

SEQ ID NO: 8056 - protein, 5 aa, Artificial Sequence
  Description of Artificial Sequence: Synthetic peptide
SYGMH

SEQ ID NO: 8057 - DNA, 15 bp, Artificial Sequence
  Description of Artificial Sequence: Synthetic oligonucleotide
ggctactatatacac

SEQ ID NO: 8058 - protein, 5 aa, Artificial Sequence
  Description of Artificial Sequence: Synthetic peptide
GYYIH

SEQ ID NO: 8059 - DNA, 15 bp, Artificial Sequence
  Description of Artificial Sequence: Synthetic oligonucleotide
gactatgtcatgcag

SEQ ID NO: 8060 - protein, 5 aa, Artificial Sequence
  Description of Artificial Sequence: Synthetic peptide
DYVMQ

SEQ ID NO: 8061 - DNA, 15 bp, Artificial Sequence
  Description of Artificial Sequence: Synthetic oligonucleotide
aattatgatatcaac

SEQ ID NO: 8062 - protein, 5 aa, Artificial Sequence
  Description of Artificial Sequence: Synthetic peptide
NYDIN

SEQ ID NO: 8063 - DNA, 21 bp, Artificial Sequence
  Description of Artificial Sequence: Synthetic oligonucleotide
agtggtggttactactggagc

SEQ ID NO: 8064 - protein, 7 aa, Artificial Sequence
  Description of Artificial Sequence: Synthetic peptide
SGGYYWS

SEQ ID NO: 8065 - DNA, 15 bp, Artificial Sequence
  Description of Artificial Sequence: Synthetic oligonucleotide
agccatggcatgcac

SEQ ID NO: 8066 - protein, 5 aa, Artificial Sequence
  Description of Artificial Sequence: Synthetic peptide
SHGMH

SEQ ID NO: 8067 - DNA, 15 bp, Artificial Sequence
  Description of Artificial Sequence: Synthetic oligonucleotide
gtttactattggagc

SEQ ID NO: 8068 - protein, 5 aa, Artificial Sequence
  Description of Artificial Sequence: Synthetic peptide
VYYWS

SEQ ID NO: 8069 - DNA, 15 bp, Artificial Sequence
  Description of Artificial Sequence: Synthetic oligonucleotide
aattatgatatcaac

SEQ ID NO: 8070 - protein, 5 aa, Artificial Sequence
  Description of Artificial Sequence: Synthetic peptide
NYDIN

SEQ ID NO: 8071 - DNA, 15 bp, Artificial Sequence
  Description of Artificial Sequence: Synthetic oligonucleotide
aattatgatgtcaac

SEQ ID NO: 8072 - protein, 5 aa, Artificial Sequence
  Description of Artificial Sequence: Synthetic peptide
NYDVN

SEQ ID NO: 8073 - DNA, 15 bp, Artificial Sequence
  Description of Artificial Sequence: Synthetic oligonucleotide
aattatgatatcaac

SEQ ID NO: 8074 - protein, 5 aa, Artificial Sequence
  Description of Artificial Sequence: Synthetic peptide
NYDIN

SEQ ID NO: 8075 - DNA, 15 bp, Artificial Sequence
  Description of Artificial Sequence: Synthetic oligonucleotide
aattatgatatcaac

SEQ ID NO: 8076 - protein, 5 aa, Artificial Sequence
  Description of Artificial Sequence: Synthetic peptide
NYDIN

SEQ ID NO: 8077 - DNA, 15 bp, Artificial Sequence
  Description of Artificial Sequence: Synthetic oligonucleotide
aattatgatatcaac

SEQ ID NO: 8078 - protein, 5 aa, Artificial Sequence
  Description of Artificial Sequence: Synthetic peptide
NYDIN

SEQ ID NO: 8079 - DNA, 15 bp, Artificial Sequence
  Description of Artificial Sequence: Synthetic oligonucleotide
agttatgatatcaac

SEQ ID NO: 8080 - protein, 5 aa, Artificial Sequence
  Description of Artificial Sequence: Synthetic peptide
SYDIN

SEQ ID NO: 8081 - DNA, 15 bp, Artificial Sequence
  Description of Artificial Sequence: Synthetic oligonucleotide
agttatgatatcaac

SEQ ID NO: 8082 - protein, 5 aa, Artificial Sequence
  Description of Artificial Sequence: Synthetic peptide
SYDIN

SEQ ID NO: 8083 - DNA, 15 bp, Artificial Sequence
  Description of Artificial Sequence: Synthetic oligonucleotide
agctatgccatgagc

SEQ ID NO: 8084 - protein, 5 aa, Artificial Sequence
  Description of Artificial Sequence: Synthetic peptide
SYAMS

SEQ ID NO: 8085 - DNA, 15 bp, Artificial Sequence
  Description of Artificial Sequence: Synthetic oligonucleotide
agttatgatatcaac

SEQ ID NO: 8086 - protein, 5 aa, Artificial Sequence
  Description of Artificial Sequence: Synthetic peptide
SYDIN

SEQ ID NO: 8087 - DNA, 15 bp, Artificial Sequence
  Description of Artificial Sequence: Synthetic oligonucleotide
agttatgatatcaac

SEQ ID NO: 8088 - protein, 5 aa, Artificial Sequence
  Description of Artificial Sequence: Synthetic peptide
SYDIN

SEQ ID NO: 8089 - DNA, 15 bp, Artificial Sequence
  Description of Artificial Sequence: Synthetic oligonucleotide
agctatgccatgagc

SEQ ID NO: 8090 - protein, 5 aa, Artificial Sequence
  Description of Artificial Sequence: Synthetic peptide
SYAMS

SEQ ID NO: 8091 - DNA, 21 bp, Artificial Sequence
  Description of Artificial Sequence: Synthetic oligonucleotide
gttgcatcccgtttgcaaagt

SEQ ID NO: 8092 - protein, 7 aa, Artificial Sequence
  Description of Artificial Sequence: Synthetic peptide
VASRLQS

SEQ ID NO: 8093 - DNA, 21 bp, Artificial Sequence
  Description of Artificial Sequence: Synthetic oligonucleotide
tgggcatcttcccgggaatcc

SEQ ID NO: 8094 - protein, 7 aa, Artificial Sequence
  Description of Artificial Sequence: Synthetic peptide
WASSRES

SEQ ID NO: 8095 - DNA, 21 bp, Artificial Sequence
  Description of Artificial Sequence: Synthetic oligonucleotide
tgggcatctacccgggaatcc

SEQ ID NO: 8096 - protein, 7 aa, Artificial Sequence
  Description of Artificial Sequence: Synthetic peptide
WASTRES

SEQ ID NO: 8097 - DNA, 21 bp, Artificial Sequence
  Description of Artificial Sequence: Synthetic oligonucleotide
gaagtttccaaccggttctct

SEQ ID NO: 8098 - protein, 7 aa, Artificial Sequence
  Description of Artificial Sequence: Synthetic peptide
EVSNRFS

SEQ ID NO: 8099 - DNA, 21 bp, Artificial Sequence
  Description of Artificial Sequence: Synthetic oligonucleotide
ggtgcattcaatttgcacagt

SEQ ID NO: 8100 - protein, 7 aa, Artificial Sequence
  Description of Artificial Sequence: Synthetic peptide
GAFNLHS

SEQ ID NO: 8101 - DNA, 21 bp, Artificial Sequence
  Description of Artificial Sequence: Synthetic oligonucleotide
caagatagcaagcggccctca

SEQ ID NO: 8102 - protein, 7 aa, Artificial Sequence
  Description of Artificial Sequence: Synthetic peptide
QDSKRPS

SEQ ID NO: 8103 - DNA, 21 bp, Artificial Sequence
  Description of Artificial Sequence: Synthetic oligonucleotide
gctgcatccattttgcaaagt

SEQ ID NO: 8104 - protein, 7 aa, Artificial Sequence
  Description of Artificial Sequence: Synthetic peptide
AASILQS

SEQ ID NO: 8105 - DNA, 21 bp, Artificial Sequence
  Description of Artificial Sequence: Synthetic oligonucleotide
gctgcatccagtttgcttagt

SEQ ID NO: 8106 - protein, 7 aa, Artificial Sequence
  Description of Artificial Sequence: Synthetic peptide
AASSLLS

SEQ ID NO: 8107 - DNA, 21 bp, Artificial Sequence
  Description of Artificial Sequence: Synthetic oligonucleotide
gctgcatccagtttgcaaagt

SEQ ID NO: 8108 - protein, 7 aa, Artificial Sequence
  Description of Artificial Sequence: Synthetic peptide
AASSLQS

SEQ ID NO: 8109 - DNA, 21 bp, Artificial Sequence
  Description of Artificial Sequence: Synthetic oligonucleotide
gctgcatccagtttgcaaagt

SEQ ID NO: 8110 - protein, 7 aa, Artificial Sequence
  Description of Artificial Sequence: Synthetic peptide
AASSLQS

SEQ ID NO: 8111 - DNA, 21 bp, Artificial Sequence
  Description of Artificial Sequence: Synthetic oligonucleotide
ggtgcatccagcagggccact

SEQ ID NO: 8112 - protein, 7 aa, Artificial Sequence
  Description of Artificial Sequence: Synthetic peptide
GASSRAT

SEQ ID NO: 8113 - DNA, 21 bp, Artificial Sequence
  Description of Artificial Sequence: Synthetic oligonucleotide
gctgcatccagtttgcaaagt

SEQ ID NO: 8114 - protein, 7 aa, Artificial Sequence
  Description of Artificial Sequence: Synthetic peptide
AASSLQS

SEQ ID NO: 8115 - DNA, 21 bp, Artificial Sequence
  Description of Artificial Sequence: Synthetic oligonucleotide
gaagtttccaagcggctctct

SEQ ID NO: 8116 - protein, 7 aa, Artificial Sequence
  Description of Artificial Sequence: Synthetic peptide
EVSKRLS

SEQ ID NO: 8117 - DNA, 21 bp, Artificial Sequence
  Description of Artificial Sequence: Synthetic oligonucleotide
gctgcatccactttgcaaagt

SEQ ID NO: 8118 - protein, 7 aa, Artificial Sequence
  Description of Artificial Sequence: Synthetic peptide
AASTLQS

SEQ ID NO: 8119 - DNA, 21 bp, Artificial Sequence
  Description of Artificial Sequence: Synthetic oligonucleotide
gaagtttccaaccggttctct

SEQ ID NO: 8120 - protein, 7 aa, Artificial Sequence
  Description of Artificial Sequence: Synthetic peptide
EVSNRFS

SEQ ID NO: 8121 - DNA, 21 bp, Artificial Sequence
  Description of Artificial Sequence: Synthetic oligonucleotide
gctgcatccagtttgcaaagt

SEQ ID NO: 8122 - protein, 7 aa, Artificial Sequence
  Description of Artificial Sequence: Synthetic peptide
AASSLQS

SEQ ID NO: 8123 - DNA, 21 bp, Artificial Sequence
  Description of Artificial Sequence: Synthetic oligonucleotide
gctgcatccagtttgcaaagt

SEQ ID NO: 8124 - protein, 7 aa, Artificial Sequence
  Description of Artificial Sequence: Synthetic peptide
AASSLQS

SEQ ID NO: 8125 - DNA, 21 bp, Artificial Sequence
  Description of Artificial Sequence: Synthetic oligonucleotide
gctgcatccagtttgcaaagt

SEQ ID NO: 8126 - protein, 7 aa, Artificial Sequence
  Description of Artificial Sequence: Synthetic peptide
AASSLQS

SEQ ID NO: 8127 - DNA, 21 bp, Artificial Sequence
  Description of Artificial Sequence: Synthetic oligonucleotide
ggtgcatccaccagggccact

SEQ ID NO: 8128 - protein, 7 aa, Artificial Sequence
  Description of Artificial Sequence: Synthetic peptide
GASTRAT

SEQ ID NO: 8129 - DNA, 21 bp, Artificial Sequence
  Description of Artificial Sequence: Synthetic oligonucleotide
ggtgcagccaccagggccact

SEQ ID NO: 8130 - protein, 7 aa, Artificial Sequence
  Description of Artificial Sequence: Synthetic peptide
GAATRAT

SEQ ID NO: 8131 - DNA, 21 bp, Artificial Sequence
  Description of Artificial Sequence: Synthetic oligonucleotide
ggtgcatccagtttgcaaagt

SEQ ID NO: 8132 - protein, 7 aa, Artificial Sequence
  Description of Artificial Sequence: Synthetic peptide
GASSLQS

SEQ ID NO: 8133 - DNA, 21 bp, Artificial Sequence
  Description of Artificial Sequence: Synthetic oligonucleotide
ggtgcatccagcagggccact

SEQ ID NO: 8134 - protein, 7 aa, Artificial Sequence
  Description of Artificial Sequence: Synthetic peptide
GASSRAT

SEQ ID NO: 8135 - DNA, 21 bp, Artificial Sequence
  Description of Artificial Sequence: Synthetic oligonucleotide
gctgcatccagtttgcaaagt

SEQ ID NO: 8136 - protein, 7 aa, Artificial Sequence
  Description of Artificial Sequence: Synthetic peptide
AASSLQS

SEQ ID NO: 8137 - DNA, 21 bp, Artificial Sequence
  Description of Artificial Sequence: Synthetic oligonucleotide
ggtgcatccagcagggccact

SEQ ID NO: 8138 - protein, 7 aa, Artificial Sequence
  Description of Artificial Sequence: Synthetic peptide
GASSRAT

SEQ ID NO: 8139 - DNA, 21 bp, Artificial Sequence
  Description of Artificial Sequence: Synthetic oligonucleotide
gctgcatccagtttgcaaagt

SEQ ID NO: 8140 - protein, 7 aa, Artificial Sequence
  Description of Artificial Sequence: Synthetic peptide
AASSLQS

SEQ ID NO: 8141 - DNA, 21 bp, Artificial Sequence
  Description of Artificial Sequence: Synthetic oligonucleotide
ggtgcatccagcagggccact

SEQ ID NO: 8142 - protein, 7 aa, Artificial Sequence
  Description of Artificial Sequence: Synthetic peptide
GASSRAT

SEQ ID NO: 8143 - DNA, 21 bp, Artificial Sequence
  Description of Artificial Sequence: Synthetic oligonucleotide
gctgcatccagtttgcaaagt

SEQ ID NO: 8144 - protein, 7 aa, Artificial Sequence
  Description of Artificial Sequence: Synthetic peptide
AASSLQS

SEQ ID NO: 8145 - DNA, 21 bp, Artificial Sequence
  Description of Artificial Sequence: Synthetic oligonucleotide
actgcatccagtttgcaaagt

SEQ ID NO: 8146 - protein, 7 aa, Artificial Sequence
  Description of Artificial Sequence: Synthetic peptide
TASSLQS

SEQ ID NO: 8147 - DNA, 21 bp, Artificial Sequence
  Description of Artificial Sequence: Synthetic oligonucleotide
ggtgcatccagtttgcaaagt

SEQ ID NO: 8148 - protein, 7 aa, Artificial Sequence
  Description of Artificial Sequence: Synthetic peptide
GASSLQS

SEQ ID NO: 8149 - DNA, 21 bp, Artificial Sequence
  Description of Artificial Sequence: Synthetic oligonucleotide
gctgcatccagtttgcatagt

SEQ ID NO: 8150 - protein, 7 aa, Artificial Sequence
  Description of Artificial Sequence: Synthetic peptide
AASSLHS

SEQ ID NO: 8151 - DNA, 21 bp, Artificial Sequence
  Description of Artificial Sequence: Synthetic oligonucleotide
tgggcatctacccgggaatcc

SEQ ID NO: 8152 - protein, 7 aa, Artificial Sequence
  Description of Artificial Sequence: Synthetic peptide
WASTRES

SEQ ID NO: 8153 - DNA, 21 bp, Artificial Sequence
  Description of Artificial Sequence: Synthetic oligonucleotide
tgggcatctacccgggaatcc

SEQ ID NO: 8154 - protein, 7 aa, Artificial Sequence
  Description of Artificial Sequence: Synthetic peptide
WASTRES

SEQ ID NO: 8155 - DNA, 21 bp, Artificial Sequence
  Description of Artificial Sequence: Synthetic oligonucleotide
gaggtttctaagtgggactct

SEQ ID NO: 8156 - protein, 7 aa, Artificial Sequence
  Description of Artificial Sequence: Synthetic peptide
EVSKWDS

SEQ ID NO: 8157 - DNA, 21 bp, Artificial Sequence
  Description of Artificial Sequence: Synthetic oligonucleotide
aaggtttctaactgggactct

SEQ ID NO: 8158 - protein, 7 aa, Artificial Sequence
  Description of Artificial Sequence: Synthetic peptide
KVSNWDS

SEQ ID NO: 8159 - DNA, 21 bp, Artificial Sequence
  Description of Artificial Sequence: Synthetic oligonucleotide
gctgcatccagtttgcagagt

SEQ ID NO: 8160 - protein, 7 aa, Artificial Sequence
  Description of Artificial Sequence: Synthetic peptide
AASSLQS

SEQ ID NO: 8161 - DNA, 21 bp, Artificial Sequence
  Description of Artificial Sequence: Synthetic oligonucleotide
gctgcatccagtttgcaaagt

SEQ ID NO: 8162 - protein, 7 aa, Artificial Sequence
  Description of Artificial Sequence: Synthetic peptide
AASSLQS

SEQ ID NO: 8163 - DNA, 21 bp, Artificial Sequence
  Description of Artificial Sequence: Synthetic oligonucleotide
gaggtcagtaatcggccctca

SEQ ID NO: 8164 - protein, 7 aa, Artificial Sequence
  Description of Artificial Sequence: Synthetic peptide
EVSNRPS

SEQ ID NO: 8165 - DNA, 21 bp, Artificial Sequence
  Description of Artificial Sequence: Synthetic oligonucleotide
agtaataatcagcggccctca

SEQ ID NO: 8166 - protein, 7 aa, Artificial Sequence
  Description of Artificial Sequence: Synthetic peptide
SNNQRPS

SEQ ID NO: 8167 - DNA, 21 bp, Artificial Sequence
  Description of Artificial Sequence: Synthetic oligonucleotide
gaggacagcaagcgaccctcc

SEQ ID NO: 8168 - protein, 7 aa, Artificial Sequence
  Description of Artificial Sequence: Synthetic peptide
EDSKRPS

SEQ ID NO: 8169 - DNA, 21 bp, Artificial Sequence
  Description of Artificial Sequence: Synthetic oligonucleotide
gctgcatccagtttgcaaagt

SEQ ID NO: 8170 - protein, 7 aa, Artificial Sequence
  Description of Artificial Sequence: Synthetic peptide
AASSLQS

SEQ ID NO: 8171 - DNA, 21 bp, Artificial Sequence
  Description of Artificial Sequence: Synthetic oligonucleotide
tgggcatctacccgggaatcc

SEQ ID NO: 8172 - protein, 7 aa, Artificial Sequence
  Description of Artificial Sequence: Synthetic peptide
WASTRES

SEQ ID NO: 8173 - DNA, 21 bp, Artificial Sequence
  Description of Artificial Sequence: Synthetic oligonucleotide
actgcatacagtttgcaaagt

SEQ ID NO: 8174 - protein, 7 aa, Artificial Sequence
  Description of Artificial Sequence: Synthetic peptide
TAYSLQS

SEQ ID NO: 8175 - DNA, 21 bp, Artificial Sequence
  Description of Artificial Sequence: Synthetic oligonucleotide
caagataggaagcgcccctca

SEQ ID NO: 8176 - protein, 7 aa, Artificial Sequence
  Description of Artificial Sequence: Synthetic peptide
QDRKRPS

SEQ ID NO: 8177 - DNA, 21 bp, Artificial Sequence
  Description of Artificial Sequence: Synthetic oligonucleotide
aaggtttctaactgggactct

SEQ ID NO: 8178 - protein, 7 aa, Artificial Sequence
  Description of Artificial Sequence: Synthetic peptide
KVSNWDS

SEQ ID NO: 8179 - DNA, 21 bp, Artificial Sequence
  Description of Artificial Sequence: Synthetic oligonucleotide
gaggtcagtaatcggccctca

SEQ ID NO: 8180 - protein, 7 aa, Artificial Sequence
  Description of Artificial Sequence: Synthetic peptide
EVSNRPS

SEQ ID NO: 8181 - DNA, 21 bp, Artificial Sequence
  Description of Artificial Sequence: Synthetic oligonucleotide
gctgcatccagtttgcaaagt

SEQ ID NO: 8182 - protein, 7 aa, Artificial Sequence
  Description of Artificial Sequence: Synthetic peptide
AASSLQS

SEQ ID NO: 8183 - DNA, 21 bp, Artificial Sequence
  Description of Artificial Sequence: Synthetic oligonucleotide
gctgcatccaggttgcaaagt

SEQ ID NO: 8184 - protein, 7 aa, Artificial Sequence
  Description of Artificial Sequence: Synthetic peptide
AASRLQS

SEQ ID NO: 8185 - DNA, 21 bp, Artificial Sequence
  Description of Artificial Sequence: Synthetic oligonucleotide
gctgcatccagattgcaaagt

SEQ ID NO: 8186 - protein, 7 aa, Artificial Sequence
  Description of Artificial Sequence: Synthetic peptide
AASRLQS

SEQ ID NO: 8187 - DNA, 21 bp, Artificial Sequence
  Description of Artificial Sequence: Synthetic oligonucleotide
gctgcatccagtttgcaaagt

SEQ ID NO: 8188 - protein, 7 aa, Artificial Sequence
  Description of Artificial Sequence: Synthetic peptide
AASSLQS

SEQ ID NO: 8189 - DNA, 21 bp, Artificial Sequence
  Description of Artificial Sequence: Synthetic oligonucleotide
caagataggaagcggccctca

SEQ ID NO: 8190 - protein, 7 aa, Artificial Sequence
  Description of Artificial Sequence: Synthetic peptide
QDRKRPS

SEQ ID NO: 8191 - DNA, 21 bp, Artificial Sequence
  Description of Artificial Sequence: Synthetic oligonucleotide
aaggtttctaactgggactct

SEQ ID NO: 8192 - protein, 7 aa, Artificial Sequence
  Description of Artificial Sequence: Synthetic peptide
KVSNWDS

SEQ ID NO: 8193 - DNA, 21 bp, Artificial Sequence
  Description of Artificial Sequence: Synthetic oligonucleotide
caagataggaagcggccctca

SEQ ID NO: 8194 - protein, 7 aa, Artificial Sequence
  Description of Artificial Sequence: Synthetic peptide
QDRKRPS

SEQ ID NO: 8195 - DNA, 21 bp, Artificial Sequence
  Description of Artificial Sequence: Synthetic oligonucleotide
gaggtcagtaatcggccctca

SEQ ID NO: 8196 - protein, 7 aa, Artificial Sequence
  Description of Artificial Sequence: Synthetic peptide
EVSNRPS

SEQ ID NO: 8197 - DNA, 21 bp, Artificial Sequence
  Description of Artificial Sequence: Synthetic oligonucleotide
caagataggaagcggccctca

SEQ ID NO: 8198 - protein, 7 aa, Artificial Sequence
  Description of Artificial Sequence: Synthetic peptide
QDRKRPS

SEQ ID NO: 8199 - DNA, 21 bp, Artificial Sequence
  Description of Artificial Sequence: Synthetic oligonucleotide
caagataccaagcggccctca

SEQ ID NO: 8200 - protein, 7 aa, Artificial Sequence
  Description of Artificial Sequence: Synthetic peptide
QDTKRPS

SEQ ID NO: 8201 - DNA, 21 bp, Artificial Sequence
  Description of Artificial Sequence: Synthetic oligonucleotide
caagatagcaagcggccctca

SEQ ID NO: 8202 - protein, 7 aa, Artificial Sequence
  Description of Artificial Sequence: Synthetic peptide
QDSKRPS

SEQ ID NO: 8203 - DNA, 21 bp, Artificial Sequence
  Description of Artificial Sequence: Synthetic oligonucleotide
caagatggcaagcggccctca

SEQ ID NO: 8204 - protein, 7 aa, Artificial Sequence
  Description of Artificial Sequence: Synthetic peptide
QDGKRPS

SEQ ID NO: 8205 - DNA, 21 bp, Artificial Sequence
  Description of Artificial Sequence: Synthetic oligonucleotide
agcgatagcaaccggccctca

SEQ ID NO: 8206 - protein, 7 aa, Artificial Sequence
  Description of Artificial Sequence: Synthetic peptide
SDSNRPS

SEQ ID NO: 8207 - DNA, 33 bp, Artificial Sequence
  Description of Artificial Sequence: Synthetic oligonucleotide
gttaagagtgatggcagccacagcaagggggac

SEQ ID NO: 8208 - protein, 11 aa, Artificial Sequence
  Description of Artificial Sequence: Synthetic peptide
VKSDGSHSKGD

SEQ ID NO: 8209 - DNA, 21 bp, Artificial Sequence
  Description of Artificial Sequence: Synthetic oligonucleotide
caagatcgcaagcggccctca

SEQ ID NO: 8210 - protein, 7 aa, Artificial Sequence
  Description of Artificial Sequence: Synthetic peptide
QDRKRPS

SEQ ID NO: 8211 - DNA, 21 bp, Artificial Sequence
  Description of Artificial Sequence: Synthetic oligonucleotide
gaagtttcctaccggttctct

SEQ ID NO: 8212 - protein, 7 aa, Artificial Sequence
  Description of Artificial Sequence: Synthetic peptide
EVSYRFS

SEQ ID NO: 8213 - DNA, 21 bp, Artificial Sequence
  Description of Artificial Sequence: Synthetic oligonucleotide
gctgcatccagtttacaaagt

SEQ ID NO: 8214 - protein, 7 aa, Artificial Sequence
  Description of Artificial Sequence: Synthetic peptide
AASSLQS

SEQ ID NO: 8215 - DNA, 21 bp, Artificial Sequence
  Description of Artificial Sequence: Synthetic oligonucleotide
ggtgcatccagtttgcaaagt

SEQ ID NO: 8216 - protein, 7 aa, Artificial Sequence
  Description of Artificial Sequence: Synthetic peptide
GASSLQS

SEQ ID NO: 8217 - DNA, 21 bp, Artificial Sequence
  Description of Artificial Sequence: Synthetic oligonucleotide
gctgcatccagtttgcaaagt

SEQ ID NO: 8218 - protein, 7 aa, Artificial Sequence
  Description of Artificial Sequence: Synthetic peptide
AASSLQS

SEQ ID NO: 8219 - DNA, 21 bp, Artificial Sequence
  Description of Artificial Sequence: Synthetic oligonucleotide
gctgcatccagtttgcaaagt

SEQ ID NO: 8220 - protein, 7 aa, Artificial Sequence
  Description of Artificial Sequence: Synthetic peptide
AASSLQS

SEQ ID NO: 8221 - DNA, 21 bp, Artificial Sequence
  Description of Artificial Sequence: Synthetic oligonucleotide
gctgcatccagtttgcaaagt

SEQ ID NO: 8222 - protein, 7 aa, Artificial Sequence
  Description of Artificial Sequence: Synthetic peptide
AASSLQS

SEQ ID NO: 8223 - DNA, 21 bp, Artificial Sequence
  Description of Artificial Sequence: Synthetic oligonucleotide
gctgcatccagtttgcaaagt

SEQ ID NO: 8224 - protein, 7 aa, Artificial Sequence
  Description of Artificial Sequence: Synthetic peptide
AASSLQS

SEQ ID NO: 8225 - DNA, 21 bp, Artificial Sequence
  Description of Artificial Sequence: Synthetic oligonucleotide
gctgcatccagtttgcaaagt

SEQ ID NO: 8226 - protein, 7 aa, Artificial Sequence
  Description of Artificial Sequence: Synthetic peptide
AASSLQS

SEQ ID NO: 8227 - DNA, 21 bp, Artificial Sequence
  Description of Artificial Sequence: Synthetic oligonucleotide
gctgcatccagtttgcaaagt

SEQ ID NO: 8228 - protein, 7 aa, Artificial Sequence
  Description of Artificial Sequence: Synthetic peptide
AASSLQS

SEQ ID NO: 8229 - DNA, 21 bp, Artificial Sequence
  Description of Artificial Sequence: Synthetic oligonucleotide
gctgcttccagtttgcaaagt

SEQ ID NO: 8230 - protein, 7 aa, Artificial Sequence
  Description of Artificial Sequence: Synthetic peptide
AASSLQS

SEQ ID NO: 8231 - DNA, 21 bp, Artificial Sequence
  Description of Artificial Sequence: Synthetic oligonucleotide
gctgtatccagtttgcaaagt

SEQ ID NO: 8232 - protein, 7 aa, Artificial Sequence
  Description of Artificial Sequence: Synthetic peptide
AVSSLQS

SEQ ID NO: 8233 - DNA, 21 bp, Artificial Sequence
  Description of Artificial Sequence: Synthetic oligonucleotide
gctgcatccagtttacaaagt

SEQ ID NO: 8234 - protein, 7 aa, Artificial Sequence
  Description of Artificial Sequence: Synthetic peptide
AASSLQS

SEQ ID NO: 8235 - DNA, 21 bp, Artificial Sequence
  Description of Artificial Sequence: Synthetic oligonucleotide
gctgcatccagtttgcaaagt

SEQ ID NO: 8236 - protein, 7 aa, Artificial Sequence
  Description of Artificial Sequence: Synthetic peptide
AASSLQS

SEQ ID NO: 8237 - DNA, 21 bp, Artificial Sequence
  Description of Artificial Sequence: Synthetic oligonucleotide
gctgcatccaatttacaaagt

SEQ ID NO: 8238 - protein, 7 aa, Artificial Sequence
  Description of Artificial Sequence: Synthetic peptide
AASNLQS

SEQ ID NO: 8239 - DNA, 21 bp, Artificial Sequence
  Description of Artificial Sequence: Synthetic oligonucleotide
gctgcatccagtttccaaagt

SEQ ID NO: 8240 - protein, 7 aa, Artificial Sequence
  Description of Artificial Sequence: Synthetic peptide
AASSFQS

SEQ ID NO: 8241 - DNA, 21 bp, Artificial Sequence
  Description of Artificial Sequence: Synthetic oligonucleotide
gctgcatccagtttgcaaagt

SEQ ID NO: 8242 - protein, 7 aa, Artificial Sequence
  Description of Artificial Sequence: Synthetic peptide
AASSLQS

SEQ ID NO: 8243 - DNA, 21 bp, Artificial Sequence
  Description of Artificial Sequence: Synthetic oligonucleotide
gctgcatccagtttgcaaagt

SEQ ID NO: 8244 - protein, 7 aa, Artificial Sequence
  Description of Artificial Sequence: Synthetic peptide
AASSLQS

SEQ ID NO: 8245 - DNA, 21 bp, Artificial Sequence
  Description of Artificial Sequence: Synthetic oligonucleotide
gctgcatccagtttgcaaagt

SEQ ID NO: 8246 - protein, 7 aa, Artificial Sequence
  Description of Artificial Sequence: Synthetic peptide
AASSLQS

SEQ ID NO: 8247 - DNA, 21 bp, Artificial Sequence
  Description of Artificial Sequence: Synthetic oligonucleotide
gctgcatccagtttacaaagt

SEQ ID NO: 8248 - protein, 7 aa, Artificial Sequence
  Description of Artificial Sequence: Synthetic peptide
AASSLQS

SEQ ID NO: 8249 - DNA, 21 bp, Artificial Sequence
  Description of Artificial Sequence: Synthetic oligonucleotide
gctgcatccagtgtgcaaagt

SEQ ID NO: 8250 - protein, 7 aa, Artificial Sequence
  Description of Artificial Sequence: Synthetic peptide
AASSVQS

SEQ ID NO: 8251 - DNA, 21 bp, Artificial Sequence
  Description of Artificial Sequence: Synthetic oligonucleotide
gctgcatccagtttgcaaagt

SEQ ID NO: 8252 - protein, 7 aa, Artificial Sequence
  Description of Artificial Sequence: Synthetic peptide
AASSLQS

SEQ ID NO: 8253 - DNA, 21 bp, Artificial Sequence
  Description of Artificial Sequence: Synthetic oligonucleotide
gttgcatccagtttgcaaagt

SEQ ID NO: 8254 - protein, 7 aa, Artificial Sequence
  Description of Artificial Sequence: Synthetic peptide
VASSLQS

SEQ ID NO: 8255 - DNA, 21 bp, Artificial Sequence
  Description of Artificial Sequence: Synthetic oligonucleotide
actgcatccagtttgcaaagt

SEQ ID NO: 8256 - protein, 7 aa, Artificial Sequence
  Description of Artificial Sequence: Synthetic peptide
TASSLQS

SEQ ID NO: 8257 - DNA, 21 bp, Artificial Sequence
  Description of Artificial Sequence: Synthetic oligonucleotide
gctgcatccagtgtacaaagt

SEQ ID NO: 8258 - protein, 7 aa, Artificial Sequence
  Description of Artificial Sequence: Synthetic peptide
AASSVQS

SEQ ID NO: 8259 - DNA, 21 bp, Artificial Sequence
  Description of Artificial Sequence: Synthetic oligonucleotide
ggtgcatccagtttgcaaact

SEQ ID NO: 8260 - protein, 7 aa, Artificial Sequence
  Description of Artificial Sequence: Synthetic peptide
GASSLQT

SEQ ID NO: 8261 - DNA, 21 bp, Artificial Sequence
  Description of Artificial Sequence: Synthetic oligonucleotide
actgcatccagtttgcaaagt

SEQ ID NO: 8262 - protein, 7 aa, Artificial Sequence
  Description of Artificial Sequence: Synthetic peptide
TASSLQS

SEQ ID NO: 8263 - DNA, 21 bp, Artificial Sequence
  Description of Artificial Sequence: Synthetic oligonucleotide
gctgtttccagtttgcaaagt

SEQ ID NO: 8264 - protein, 7 aa, Artificial Sequence
  Description of Artificial Sequence: Synthetic peptide
AVSSLQS

SEQ ID NO: 8265 - DNA, 21 bp, Artificial Sequence
  Description of Artificial Sequence: Synthetic oligonucleotide
gctgcatccagtttgcaaagt

SEQ ID NO: 8266 - protein, 7 aa, Artificial Sequence
  Description of Artificial Sequence: Synthetic peptide
AASSLQS

SEQ ID NO: 8267 - DNA, 21 bp, Artificial Sequence
  Description of Artificial Sequence: Synthetic oligonucleotide
gctgcatccagtttgcaaagt

SEQ ID NO: 8268 - protein, 7 aa, Artificial Sequence
  Description of Artificial Sequence: Synthetic peptide
AASSLQS

SEQ ID NO: 8269 - DNA, 21 bp, Artificial Sequence
  Description of Artificial Sequence: Synthetic oligonucleotide
gctgcatccagtttgcaaagt

SEQ ID NO: 8270 - protein, 7 aa, Artificial Sequence
  Description of Artificial Sequence: Synthetic peptide
AASSLQS

SEQ ID NO: 8271 - DNA, 21 bp, Artificial Sequence
  Description of Artificial Sequence: Synthetic oligonucleotide
gctgcatccagtttgcaaagt

SEQ ID NO: 8272 - protein, 7 aa, Artificial Sequence
  Description of Artificial Sequence: Synthetic peptide
AASSLQS

SEQ ID NO: 8273 - DNA, 21 bp, Artificial Sequence
  Description of Artificial Sequence: Synthetic oligonucleotide
gctgcatccagtttgcaaagt

SEQ ID NO: 8274 - protein, 7 aa, Artificial Sequence
  Description of Artificial Sequence: Synthetic peptide
AASSLQS

SEQ ID NO: 8275 - DNA, 21 bp, Artificial Sequence
  Description of Artificial Sequence: Synthetic oligonucleotide
gctgcatccagtttgcaaagt

SEQ ID NO: 8276 - protein, 7 aa, Artificial Sequence
  Description of Artificial Sequence: Synthetic peptide
AASSLQS

SEQ ID NO: 8277 - DNA, 21 bp, Artificial Sequence
  Description of Artificial Sequence: Synthetic oligonucleotide
gttgcatccagtttgcaaagt

SEQ ID NO: 8278 - protein, 7 aa, Artificial Sequence
  Description of Artificial Sequence: Synthetic peptide
VASSLQS

SEQ ID NO: 8279 - DNA, 21 bp, Artificial Sequence
  Description of Artificial Sequence: Synthetic oligonucleotide
gttgcatccaatttacaaggt

SEQ ID NO: 8280 - protein, 7 aa, Artificial Sequence
  Description of Artificial Sequence: Synthetic peptide
VASNLQG

SEQ ID NO: 8281 - DNA, 21 bp, Artificial Sequence
  Description of Artificial Sequence: Synthetic oligonucleotide
gctgcatccagtttgcacagt

SEQ ID NO: 8282 - protein, 7 aa, Artificial Sequence
  Description of Artificial Sequence: Synthetic peptide
AASSLHS

SEQ ID NO: 8283 - DNA, 21 bp, Artificial Sequence
  Description of Artificial Sequence: Synthetic oligonucleotide
gctgcatccagtttacaaagt

SEQ ID NO: 8284 - protein, 7 aa, Artificial Sequence
  Description of Artificial Sequence: Synthetic peptide
AASSLQS

SEQ ID NO: 8285 - DNA, 21 bp, Artificial Sequence
  Description of Artificial Sequence: Synthetic oligonucleotide
gctgcttccagtttgcaaagt

SEQ ID NO: 8286 - protein, 7 aa, Artificial Sequence
  Description of Artificial Sequence: Synthetic peptide
AASSLQS

SEQ ID NO: 8287 - DNA, 21 bp, Artificial Sequence
  Description of Artificial Sequence: Synthetic oligonucleotide
gctacatccagtttacaaagt

SEQ ID NO: 8288 - protein, 7 aa, Artificial Sequence
  Description of Artificial Sequence: Synthetic peptide
ATSSLQS

SEQ ID NO: 8289 - DNA, 21 bp, Artificial Sequence
  Description of Artificial Sequence: Synthetic oligonucleotide
gttgcatccagtttgcaaagt

SEQ ID NO: 8290 - protein, 7 aa, Artificial Sequence
  Description of Artificial Sequence: Synthetic peptide
VASSLQS

SEQ ID NO: 8291 - DNA, 21 bp, Artificial Sequence
  Description of Artificial Sequence: Synthetic oligonucleotide
gttgcatccagtttgcaaagt

SEQ ID NO: 8292 - protein, 7 aa, Artificial Sequence
  Description of Artificial Sequence: Synthetic peptide
VASSLQS

SEQ ID NO: 8293 - DNA, 21 bp, Artificial Sequence
  Description of Artificial Sequence: Synthetic oligonucleotide
actgcatccagtttgcaaagt

SEQ ID NO: 8294 - protein, 7 aa, Artificial Sequence
  Description of Artificial Sequence: Synthetic peptide
TASSLQS

SEQ ID NO: 8295 - DNA, 21 bp, Artificial Sequence
  Description of Artificial Sequence: Synthetic oligonucleotide
gctgcatccagtttgcaaagt

SEQ ID NO: 8296 - protein, 7 aa, Artificial Sequence
  Description of Artificial Sequence: Synthetic peptide
AASSLQS

SEQ ID NO: 8297 - DNA, 21 bp, Artificial Sequence
  Description of Artificial Sequence: Synthetic oligonucleotide
gctgcatccaatttgcaaagt

SEQ ID NO: 8298 - protein, 7 aa, Artificial Sequence
  Description of Artificial Sequence: Synthetic peptide
AASNLQS

SEQ ID NO: 8299 - DNA, 21 bp, Artificial Sequence
  Description of Artificial Sequence: Synthetic oligonucleotide
ttgggttctcatcgggcctcc

SEQ ID NO: 8300 - protein, 7 aa, Artificial Sequence
  Description of Artificial Sequence: Synthetic peptide
LGSHRAS

SEQ ID NO: 8301 - DNA, 21 bp, Artificial Sequence
  Description of Artificial Sequence: Synthetic oligonucleotide
gctgcatccagtttgcaaagt

SEQ ID NO: 8302 - protein, 7 aa, Artificial Sequence
  Description of Artificial Sequence: Synthetic peptide
AASSLQS

SEQ ID NO: 8303 - DNA, 21 bp, Artificial Sequence
  Description of Artificial Sequence: Synthetic oligonucleotide
gctgcatccagtttacaaagt

SEQ ID NO: 8304 - protein, 7 aa, Artificial Sequence
  Description of Artificial Sequence: Synthetic peptide
AASSLQS

SEQ ID NO: 8305 - DNA, 21 bp, Artificial Sequence
  Description of Artificial Sequence: Synthetic oligonucleotide
gctgcatccactttgcaatca

SEQ ID NO: 8306 - protein, 7 aa, Artificial Sequence
  Description of Artificial Sequence: Synthetic peptide
AASTLQS

SEQ ID NO: 8307 - DNA, 21 bp, Artificial Sequence
  Description of Artificial Sequence: Synthetic oligonucleotide
gctgcatccagtttgcaaagt

SEQ ID NO: 8308 - protein, 7 aa, Artificial Sequence
  Description of Artificial Sequence: Synthetic peptide
AASSLQS

SEQ ID NO: 8309 - DNA, 21 bp, Artificial Sequence
  Description of Artificial Sequence: Synthetic oligonucleotide
actacatctagtttacaaagt

SEQ ID NO: 8310 - protein, 7 aa, Artificial Sequence
  Description of Artificial Sequence: Synthetic peptide
TTSSLQS

SEQ ID NO: 8311 - DNA, 21 bp, Artificial Sequence
  Description of Artificial Sequence: Synthetic oligonucleotide
actgcatccagtttgcaaagt

SEQ ID NO: 8312 - protein, 7 aa, Artificial Sequence
  Description of Artificial Sequence: Synthetic peptide
TASSLQS

SEQ ID NO: 8313 - DNA, 21 bp, Artificial Sequence
  Description of Artificial Sequence: Synthetic oligonucleotide
ggtgcatccaccagggccagt

SEQ ID NO: 8314 - protein, 7 aa, Artificial Sequence
  Description of Artificial Sequence: Synthetic peptide
GASTRAS

SEQ ID NO: 8315 - DNA, 21 bp, Artificial Sequence
  Description of Artificial Sequence: Synthetic oligonucleotide
actgcatccagtttgcaaagt

SEQ ID NO: 8316 - protein, 7 aa, Artificial Sequence
  Description of Artificial Sequence: Synthetic peptide
TASSLQS

SEQ ID NO: 8317 - DNA, 21 bp, Artificial Sequence
  Description of Artificial Sequence: Synthetic oligonucleotide
actgcatccagtttgcaaact

SEQ ID NO: 8318 - protein, 7 aa, Artificial Sequence
  Description of Artificial Sequence: Synthetic peptide
TASSLQT

SEQ ID NO: 8319 - DNA, 21 bp, Artificial Sequence
  Description of Artificial Sequence: Synthetic oligonucleotide
actgcatccaatttgcaaagt

SEQ ID NO: 8320 - protein, 7 aa, Artificial Sequence
  Description of Artificial Sequence: Synthetic peptide
TASNLQS

SEQ ID NO: 8321 - DNA, 21 bp, Artificial Sequence
  Description of Artificial Sequence: Synthetic oligonucleotide
gctgcatccagtttgcaaagt

SEQ ID NO: 8322 - protein, 7 aa, Artificial Sequence
  Description of Artificial Sequence: Synthetic peptide
AASSLQS

SEQ ID NO: 8323 - DNA, 21 bp, Artificial Sequence
  Description of Artificial Sequence: Synthetic oligonucleotide
gctgcatccagtttgcaaagt

SEQ ID NO: 8324 - protein, 7 aa, Artificial Sequence
  Description of Artificial Sequence: Synthetic peptide
AASSLQS

SEQ ID NO: 8325 - DNA, 21 bp, Artificial Sequence
  Description of Artificial Sequence: Synthetic oligonucleotide
gctgcatccagtttgcaaagt

SEQ ID NO: 8326 - protein, 7 aa, Artificial Sequence
  Description of Artificial Sequence: Synthetic peptide
AASSLQS

SEQ ID NO: 8327 - DNA, 21 bp, Artificial Sequence
  Description of Artificial Sequence: Synthetic oligonucleotide
gctgcatccagtttgctgagt

SEQ ID NO: 8328 - protein, 7 aa, Artificial Sequence
  Description of Artificial Sequence: Synthetic peptide
AASSLLS

SEQ ID NO: 8329 - DNA, 21 bp, Artificial Sequence
  Description of Artificial Sequence: Synthetic oligonucleotide
gctgcatccagtttgcaaagt

SEQ ID NO: 8330 - protein, 7 aa, Artificial Sequence
  Description of Artificial Sequence: Synthetic peptide
AASSLQS

SEQ ID NO: 8331 - DNA, 21 bp, Artificial Sequence
  Description of Artificial Sequence: Synthetic oligonucleotide
gctacatacagtttggaaagt

SEQ ID NO: 8332 - protein, 7 aa, Artificial Sequence
  Description of Artificial Sequence: Synthetic peptide
ATYSLES

SEQ ID NO: 8333 - DNA, 21 bp, Artificial Sequence
  Description of Artificial Sequence: Synthetic oligonucleotide
actgcatccagtttgcaaagt

SEQ ID NO: 8334 - protein, 7 aa, Artificial Sequence
  Description of Artificial Sequence: Synthetic peptide
TASSLQS

SEQ ID NO: 8335 - DNA, 21 bp, Artificial Sequence
  Description of Artificial Sequence: Synthetic oligonucleotide
gctgcttccagtttgcaaagt

SEQ ID NO: 8336 - protein, 7 aa, Artificial Sequence
  Description of Artificial Sequence: Synthetic peptide
AASSLQS

SEQ ID NO: 8337 - DNA, 21 bp, Artificial Sequence
  Description of Artificial Sequence: Synthetic oligonucleotide
gctgcatccagtttgcaaaat

SEQ ID NO: 8338 - protein, 7 aa, Artificial Sequence
  Description of Artificial Sequence: Synthetic peptide
AASSLQN

SEQ ID NO: 8339 - DNA, 21 bp, Artificial Sequence
  Description of Artificial Sequence: Synthetic oligonucleotide
gctgcatccagtttacaaagt

SEQ ID NO: 8340 - protein, 7 aa, Artificial Sequence
  Description of Artificial Sequence: Synthetic peptide
AASSLQS

SEQ ID NO: 8341 - DNA, 21 bp, Artificial Sequence
  Description of Artificial Sequence: Synthetic oligonucleotide
tctacatccagtttgcaaagt

SEQ ID NO: 8342 - protein, 7 aa, Artificial Sequence
  Description of Artificial Sequence: Synthetic peptide
STSSLQS

SEQ ID NO: 8343 - DNA, 21 bp, Artificial Sequence
  Description of Artificial Sequence: Synthetic oligonucleotide
ggtgcatccaccagggccagt

SEQ ID NO: 8344 - protein, 7 aa, Artificial Sequence
  Description of Artificial Sequence: Synthetic peptide
GASTRAS

SEQ ID NO: 8345 - DNA, 21 bp, Artificial Sequence
  Description of Artificial Sequence: Synthetic oligonucleotide
actgcatccagtttgcaaagt

SEQ ID NO: 8346 - protein, 7 aa, Artificial Sequence
  Description of Artificial Sequence: Synthetic peptide
TASSLQS

SEQ ID NO: 8347 - DNA, 21 bp, Artificial Sequence
  Description of Artificial Sequence: Synthetic oligonucleotide
gctgcatccagtttacaaagt

SEQ ID NO: 8348 - protein, 7 aa, Artificial Sequence
  Description of Artificial Sequence: Synthetic peptide
AASSLQS

SEQ ID NO: 8349 - DNA, 21 bp, Artificial Sequence
  Description of Artificial Sequence: Synthetic oligonucleotide
gctgcatccagtttgcaaagt

SEQ ID NO: 8350 - protein, 7 aa, Artificial Sequence
  Description of Artificial Sequence: Synthetic peptide
AASSLQS

SEQ ID NO: 8351 - DNA, 21 bp, Artificial Sequence
  Description of Artificial Sequence: Synthetic oligonucleotide
gctgcatccagtttgcaaagt

SEQ ID NO: 8352 - protein, 7 aa, Artificial Sequence
  Description of Artificial Sequence: Synthetic peptide
AASSLQS

SEQ ID NO: 8353 - DNA, 21 bp, Artificial Sequence
  Description of Artificial Sequence: Synthetic oligonucleotide
cctgcatccagtttgcaaact

SEQ ID NO: 8354 - protein, 7 aa, Artificial Sequence
  Description of Artificial Sequence: Synthetic peptide
PASSLQT

SEQ ID NO: 8355 - DNA, 21 bp, Artificial Sequence
  Description of Artificial Sequence: Synthetic oligonucleotide
actgcatccagtttgcaaagt

SEQ ID NO: 8356 - protein, 7 aa, Artificial Sequence
  Description of Artificial Sequence: Synthetic peptide
TASSLQS

SEQ ID NO: 8357 - DNA, 21 bp, Artificial Sequence
  Description of Artificial Sequence: Synthetic oligonucleotide
ggtgcatccagtttgcggagt

SEQ ID NO: 8358 - protein, 7 aa, Artificial Sequence
  Description of Artificial Sequence: Synthetic peptide
GASSLRS

SEQ ID NO: 8359 - DNA, 21 bp, Artificial Sequence
  Description of Artificial Sequence: Synthetic oligonucleotide
gctgcatccagtttgcaaagt

SEQ ID NO: 8360 - protein, 7 aa, Artificial Sequence
  Description of Artificial Sequence: Synthetic peptide
AASSLQS

SEQ ID NO: 8361 - DNA, 21 bp, Artificial Sequence
  Description of Artificial Sequence: Synthetic oligonucleotide
tgggcatctacccgggaatcc

SEQ ID NO: 8362 - protein, 7 aa, Artificial Sequence
  Description of Artificial Sequence: Synthetic peptide
WASTRES

SEQ ID NO: 8363 - DNA, 21 bp, Artificial Sequence
  Description of Artificial Sequence: Synthetic oligonucleotide
gctgcatccagtttgcaaagt

SEQ ID NO: 8364 - protein, 7 aa, Artificial Sequence
  Description of Artificial Sequence: Synthetic peptide
AASSLQS

SEQ ID NO: 8365 - DNA, 21 bp, Artificial Sequence
  Description of Artificial Sequence: Synthetic oligonucleotide
gttgcatacagtttgcaaagt

SEQ ID NO: 8366 - protein, 7 aa, Artificial Sequence
  Description of Artificial Sequence: Synthetic peptide
VAYSLQS

SEQ ID NO: 8367 - DNA, 21 bp, Artificial Sequence
  Description of Artificial Sequence: Synthetic oligonucleotide
actgcatccactttgcaatca

SEQ ID NO: 8368 - protein, 7 aa, Artificial Sequence
  Description of Artificial Sequence: Synthetic peptide
TASTLQS

SEQ ID NO: 8369 - DNA, 21 bp, Artificial Sequence
  Description of Artificial Sequence: Synthetic oligonucleotide
gctgcgtccagtgtgcaaact

SEQ ID NO: 8370 - protein, 7 aa, Artificial Sequence
  Description of Artificial Sequence: Synthetic peptide
AASSVQT

SEQ ID NO: 8371 - DNA, 21 bp, Artificial Sequence
  Description of Artificial Sequence: Synthetic oligonucleotide
gctgcatccagtttgcaaagt

SEQ ID NO: 8372 - protein, 7 aa, Artificial Sequence
  Description of Artificial Sequence: Synthetic peptide
AASSLQS

SEQ ID NO: 8373 - DNA, 21 bp, Artificial Sequence
  Description of Artificial Sequence: Synthetic oligonucleotide
attgcatccagtttgcaaagt

SEQ ID NO: 8374 - protein, 7 aa, Artificial Sequence
  Description of Artificial Sequence: Synthetic peptide
IASSLQS

SEQ ID NO: 8375 - DNA, 21 bp, Artificial Sequence
  Description of Artificial Sequence: Synthetic oligonucleotide
gctgcatccagtttgcagagt

SEQ ID NO: 8376 - protein, 7 aa, Artificial Sequence
  Description of Artificial Sequence: Synthetic peptide
AASSLQS

SEQ ID NO: 8377 - DNA, 21 bp, Artificial Sequence
  Description of Artificial Sequence: Synthetic oligonucleotide
gctgcatccagtttgcaaagt

SEQ ID NO: 8378 - protein, 7 aa, Artificial Sequence
  Description of Artificial Sequence: Synthetic peptide
AASSLQS

SEQ ID NO: 8379 - DNA, 21 bp, Artificial Sequence
  Description of Artificial Sequence: Synthetic oligonucleotide
tttgcatccatcagggccact

SEQ ID NO: 8380 - protein, 7 aa, Artificial Sequence
  Description of Artificial Sequence: Synthetic peptide
FASIRAT

SEQ ID NO: 8381 - DNA, 21 bp, Artificial Sequence
  Description of Artificial Sequence: Synthetic oligonucleotide
gctgcttccagtttgcaaagt

SEQ ID NO: 8382 - protein, 7 aa, Artificial Sequence
  Description of Artificial Sequence: Synthetic peptide
AASSLQS

SEQ ID NO: 8383 - DNA, 21 bp, Artificial Sequence
  Description of Artificial Sequence: Synthetic oligonucleotide
gctgcatccagtttgcaaagt

SEQ ID NO: 8384 - protein, 7 aa, Artificial Sequence
  Description of Artificial Sequence: Synthetic peptide
AASSLQS

SEQ ID NO: 8385 - DNA, 21 bp, Artificial Sequence
  Description of Artificial Sequence: Synthetic oligonucleotide
gctgcatccagtttgcaaagt

SEQ ID NO: 8386 - protein, 7 aa, Artificial Sequence
  Description of Artificial Sequence: Synthetic peptide
AASSLQS

SEQ ID NO: 8387 - DNA, 21 bp, Artificial Sequence
  Description of Artificial Sequence: Synthetic oligonucleotide
gaagtttccaaccggttctct

SEQ ID NO: 8388 - protein, 7 aa, Artificial Sequence
  Description of Artificial Sequence: Synthetic peptide
EVSNRFS

SEQ ID NO: 8389 - DNA, 21 bp, Artificial Sequence
  Description of Artificial Sequence: Synthetic oligonucleotide
gctgcatccagtttgcaaagt

SEQ ID NO: 8390 - protein, 7 aa, Artificial Sequence
  Description of Artificial Sequence: Synthetic peptide
AASSLQS

SEQ ID NO: 8391 - DNA, 21 bp, Artificial Sequence
  Description of Artificial Sequence: Synthetic oligonucleotide
gctgcatacagtttggaaagt

SEQ ID NO: 8392 - protein, 7 aa, Artificial Sequence
  Description of Artificial Sequence: Synthetic peptide
AAYSLES

SEQ ID NO: 8393 - DNA, 21 bp, Artificial Sequence
  Description of Artificial Sequence: Synthetic oligonucleotide
gctgcatccagtttacaaagt

SEQ ID NO: 8394 - protein, 7 aa, Artificial Sequence
  Description of Artificial Sequence: Synthetic peptide
AASSLQS

SEQ ID NO: 8395 - DNA, 21 bp, Artificial Sequence
  Description of Artificial Sequence: Synthetic oligonucleotide
ggtgcatccagtgtgcaaagt

SEQ ID NO: 8396 - protein, 7 aa, Artificial Sequence
  Description of Artificial Sequence: Synthetic peptide
GASSVQS

SEQ ID NO: 8397 - DNA, 21 bp, Artificial Sequence
  Description of Artificial Sequence: Synthetic oligonucleotide
gctgcatccagtttgcaaagt

SEQ ID NO: 8398 - protein, 7 aa, Artificial Sequence
  Description of Artificial Sequence: Synthetic peptide
AASSLQS

SEQ ID NO: 8399 - DNA, 21 bp, Artificial Sequence
  Description of Artificial Sequence: Synthetic oligonucleotide
gttgcatccagtttgcaaagt

SEQ ID NO: 8400 - protein, 7 aa, Artificial Sequence
  Description of Artificial Sequence: Synthetic peptide
VASSLQS

SEQ ID NO: 8401 - DNA, 21 bp, Artificial Sequence
  Description of Artificial Sequence: Synthetic oligonucleotide
gctgcatccagtttgcaaagt

SEQ ID NO: 8402 - protein, 7 aa, Artificial Sequence
  Description of Artificial Sequence: Synthetic peptide
AASSLQS

SEQ ID NO: 8403 - DNA, 21 bp, Artificial Sequence
  Description of Artificial Sequence: Synthetic oligonucleotide
gctgcatccagtttacaaagt

SEQ ID NO: 8404 - protein, 7 aa, Artificial Sequence
  Description of Artificial Sequence: Synthetic peptide
AASSLQS

SEQ ID NO: 8405 - DNA, 21 bp, Artificial Sequence
  Description of Artificial Sequence: Synthetic oligonucleotide
gctgcatccagtttgcaaagt

SEQ ID NO: 8406 - protein, 7 aa, Artificial Sequence
  Description of Artificial Sequence: Synthetic peptide
AASSLQS

SEQ ID NO: 8407 - DNA, 21 bp, Artificial Sequence
  Description of Artificial Sequence: Synthetic oligonucleotide
gctgcatccagtttgcaaagt

SEQ ID NO: 8408 - protein, 7 aa, Artificial Sequence
  Description of Artificial Sequence: Synthetic peptide
AASSLQS

SEQ ID NO: 8409 - DNA, 21 bp, Artificial Sequence
  Description of Artificial Sequence: Synthetic oligonucleotide
gctgcatccagtttgcaaagt

SEQ ID NO: 8410 - protein, 7 aa, Artificial Sequence
  Description of Artificial Sequence: Synthetic peptide
AASSLQS

SEQ ID NO: 8411 - DNA, 21 bp, Artificial Sequence
  Description of Artificial Sequence: Synthetic oligonucleotide
gctgcatccagtttacagagt

SEQ ID NO: 8412 - protein, 7 aa, Artificial Sequence
  Description of Artificial Sequence: Synthetic peptide
AASSLQS

SEQ ID NO: 8413 - DNA, 21 bp, Artificial Sequence
  Description of Artificial Sequence: Synthetic oligonucleotide
gctgcatccagtttgcaaagt

SEQ ID NO: 8414 - protein, 7 aa, Artificial Sequence
  Description of Artificial Sequence: Synthetic peptide
AASSLQS

SEQ ID NO: 8415 - DNA, 21 bp, Artificial Sequence
  Description of Artificial Sequence: Synthetic oligonucleotide
cctgcatccagtttgcaaagt

SEQ ID NO: 8416 - protein, 7 aa, Artificial Sequence
  Description of Artificial Sequence: Synthetic peptide
PASSLQS

SEQ ID NO: 8417 - DNA, 21 bp, Artificial Sequence
  Description of Artificial Sequence: Synthetic oligonucleotide
gctgcatccagtttgcacagt

SEQ ID NO: 8418 - protein, 7 aa, Artificial Sequence
  Description of Artificial Sequence: Synthetic peptide
AASSLHS

SEQ ID NO: 8419 - DNA, 21 bp, Artificial Sequence
  Description of Artificial Sequence: Synthetic oligonucleotide
gctgcatccagtttgcaaagt

SEQ ID NO: 8420 - protein, 7 aa, Artificial Sequence
  Description of Artificial Sequence: Synthetic peptide
AASSLQS

SEQ ID NO: 8421 - DNA, 21 bp, Artificial Sequence
  Description of Artificial Sequence: Synthetic oligonucleotide
gctgcatccagtttgcaaagt

SEQ ID NO: 8422 - protein, 7 aa, Artificial Sequence
  Description of Artificial Sequence: Synthetic peptide
AASSLQS

SEQ ID NO: 8423 - DNA, 21 bp, Artificial Sequence
  Description of Artificial Sequence: Synthetic oligonucleotide
gctgcatccagtttgcaaagt

SEQ ID NO: 8424 - protein, 7 aa, Artificial Sequence
  Description of Artificial Sequence: Synthetic peptide
AASSLQS

SEQ ID NO: 8425 - DNA, 21 bp, Artificial Sequence
  Description of Artificial Sequence: Synthetic oligonucleotide
gctacatccagtttgcaaagt

SEQ ID NO: 8426 - protein, 7 aa, Artificial Sequence
  Description of Artificial Sequence: Synthetic peptide
ATSSLQS

SEQ ID NO: 8427 - DNA, 21 bp, Artificial Sequence
  Description of Artificial Sequence: Synthetic oligonucleotide
gctgcatccagtttgcaaagt

SEQ ID NO: 8428 - protein, 7 aa, Artificial Sequence
  Description of Artificial Sequence: Synthetic peptide
AASSLQS

SEQ ID NO: 8429 - DNA, 21 bp, Artificial Sequence
  Description of Artificial Sequence: Synthetic oligonucleotide
gctgcatccagtgtgcaaagt

SEQ ID NO: 8430 - protein, 7 aa, Artificial Sequence
  Description of Artificial Sequence: Synthetic peptide
AASSVQS

SEQ ID NO: 8431 - DNA, 21 bp, Artificial Sequence
  Description of Artificial Sequence: Synthetic oligonucleotide
gaagtttccaaccggttctct

SEQ ID NO: 8432 - protein, 7 aa, Artificial Sequence
  Description of Artificial Sequence: Synthetic peptide
EVSNRFS

SEQ ID NO: 8433 - DNA, 21 bp, Artificial Sequence
  Description of Artificial Sequence: Synthetic oligonucleotide
ggtgcatccagcagggccagt

SEQ ID NO: 8434 - protein, 7 aa, Artificial Sequence
  Description of Artificial Sequence: Synthetic peptide
GASSRAS

SEQ ID NO: 8435 - DNA, 21 bp, Artificial Sequence
  Description of Artificial Sequence: Synthetic oligonucleotide
gctgcatccagtttgcaaagt

SEQ ID NO: 8436 - protein, 7 aa, Artificial Sequence
  Description of Artificial Sequence: Synthetic peptide
AASSLQS

SEQ ID NO: 8437 - DNA, 21 bp, Artificial Sequence
  Description of Artificial Sequence: Synthetic oligonucleotide
gatgcatccgatttggaaaca

SEQ ID NO: 8438 - protein, 7 aa, Artificial Sequence
  Description of Artificial Sequence: Synthetic peptide
DASDLET

SEQ ID NO: 8439 - DNA, 21 bp, Artificial Sequence
  Description of Artificial Sequence: Synthetic oligonucleotide
gctgcatccagtttgcaaagt

SEQ ID NO: 8440 - protein, 7 aa, Artificial Sequence
  Description of Artificial Sequence: Synthetic peptide
AASSLQS

SEQ ID NO: 8441 - DNA, 21 bp, Artificial Sequence
  Description of Artificial Sequence: Synthetic oligonucleotide
gctgcatccagtttgcatagt

SEQ ID NO: 8442 - protein, 7 aa, Artificial Sequence
  Description of Artificial Sequence: Synthetic peptide
AASSLHS

SEQ ID NO: 8443 - DNA, 21 bp, Artificial Sequence
  Description of Artificial Sequence: Synthetic oligonucleotide
gatacatccagtttgcaaagt

SEQ ID NO: 8444 - protein, 7 aa, Artificial Sequence
  Description of Artificial Sequence: Synthetic peptide
DTSSLQS

SEQ ID NO: 8445 - DNA, 21 bp, Artificial Sequence
  Description of Artificial Sequence: Synthetic oligonucleotide
gctgcatccaattttcaaagt

SEQ ID NO: 8446 - protein, 7 aa, Artificial Sequence
  Description of Artificial Sequence: Synthetic peptide
AASNFQS

SEQ ID NO: 8447 - DNA, 21 bp, Artificial Sequence
  Description of Artificial Sequence: Synthetic oligonucleotide
gctgcatccgttttgcaacat

SEQ ID NO: 8448 - protein, 7 aa, Artificial Sequence
  Description of Artificial Sequence: Synthetic peptide
AASVLQH

SEQ ID NO: 8449 - DNA, 21 bp, Artificial Sequence
  Description of Artificial Sequence: Synthetic oligonucleotide
gctgcatccagtttacaaagt

SEQ ID NO: 8450 - protein, 7 aa, Artificial Sequence
  Description of Artificial Sequence: Synthetic peptide
AASSLQS

SEQ ID NO: 8451 - DNA, 21 bp, Artificial Sequence
  Description of Artificial Sequence: Synthetic oligonucleotide
gctgcatccagtgtgcaaagt

SEQ ID NO: 8452 - protein, 7 aa, Artificial Sequence
  Description of Artificial Sequence: Synthetic peptide
AASSVQS

SEQ ID NO: 8453 - DNA, 21 bp, Artificial Sequence
  Description of Artificial Sequence: Synthetic oligonucleotide
gctgcatccagtttgcaaagt

SEQ ID NO: 8454 - protein, 7 aa, Artificial Sequence
  Description of Artificial Sequence: Synthetic peptide
AASSLQS

SEQ ID NO: 8455 - DNA, 21 bp, Artificial Sequence
  Description of Artificial Sequence: Synthetic oligonucleotide
tggacatctacccgggaatcc

SEQ ID NO: 8456 - protein, 7 aa, Artificial Sequence
  Description of Artificial Sequence: Synthetic peptide
WTSTRES

SEQ ID NO: 8457 - DNA, 21 bp, Artificial Sequence
  Description of Artificial Sequence: Synthetic oligonucleotide
gaaatttccaaccggttctct

SEQ ID NO: 8458 - protein, 7 aa, Artificial Sequence
  Description of Artificial Sequence: Synthetic peptide
EISNRFS

SEQ ID NO: 8459 - DNA, 21 bp, Artificial Sequence
  Description of Artificial Sequence: Synthetic oligonucleotide
gctgcatccagtttgcaaagt

SEQ ID NO: 8460 - protein, 7 aa, Artificial Sequence
  Description of Artificial Sequence: Synthetic peptide
AASSLQS

SEQ ID NO: 8461 - DNA, 21 bp, Artificial Sequence
  Description of Artificial Sequence: Synthetic oligonucleotide
gctgcatccagtttgcaaagt

SEQ ID NO: 8462 - protein, 7 aa, Artificial Sequence
  Description of Artificial Sequence: Synthetic peptide
AASSLQS

SEQ ID NO: 8463 - DNA, 21 bp, Artificial Sequence
  Description of Artificial Sequence: Synthetic oligonucleotide
acttcatccagtttgcaaagt

SEQ ID NO: 8464 - protein, 7 aa, Artificial Sequence
  Description of Artificial Sequence: Synthetic peptide
TSSSLQS

SEQ ID NO: 8465 - DNA, 21 bp, Artificial Sequence
  Description of Artificial Sequence: Synthetic oligonucleotide
gctgcatccagtttgcaaagt

SEQ ID NO: 8466 - protein, 7 aa, Artificial Sequence
  Description of Artificial Sequence: Synthetic peptide
AASSLQS

SEQ ID NO: 8467 - DNA, 21 bp, Artificial Sequence
  Description of Artificial Sequence: Synthetic oligonucleotide
ggtgcatccagcagggccact

SEQ ID NO: 8468 - protein, 7 aa, Artificial Sequence
  Description of Artificial Sequence: Synthetic peptide
GASSRAT

SEQ ID NO: 8469 - DNA, 21 bp, Artificial Sequence
  Description of Artificial Sequence: Synthetic oligonucleotide
gctgcatccagtttacaaagt

SEQ ID NO: 8470 - protein, 7 aa, Artificial Sequence
  Description of Artificial Sequence: Synthetic peptide
AASSLQS

SEQ ID NO: 8471 - DNA, 21 bp, Artificial Sequence
  Description of Artificial Sequence: Synthetic oligonucleotide
gctgcatccagtttgcaaagt

SEQ ID NO: 8472 - protein, 7 aa, Artificial Sequence
  Description of Artificial Sequence: Synthetic peptide
AASSLQS

SEQ ID NO: 8473 - DNA, 21 bp, Artificial Sequence
  Description of Artificial Sequence: Synthetic oligonucleotide
gctgcttccagtttgcaaagt

SEQ ID NO: 8474 - protein, 7 aa, Artificial Sequence
  Description of Artificial Sequence: Synthetic peptide
AASSLQS

SEQ ID NO: 8475 - DNA, 21 bp, Artificial Sequence
  Description of Artificial Sequence: Synthetic oligonucleotide
gttgcatccagtttgcaaagt

SEQ ID NO: 8476 - protein, 7 aa, Artificial Sequence
  Description of Artificial Sequence: Synthetic peptide
VASSLQS

SEQ ID NO: 8477 - DNA, 21 bp, Artificial Sequence
  Description of Artificial Sequence: Synthetic oligonucleotide
gctgcatccagtttgcaaagt

SEQ ID NO: 8478 - protein, 7 aa, Artificial Sequence
  Description of Artificial Sequence: Synthetic peptide
AASSLQS

SEQ ID NO: 8479 - DNA, 21 bp, Artificial Sequence
  Description of Artificial Sequence: Synthetic oligonucleotide
gctgcatccagtttacaaagt

SEQ ID NO: 8480 - protein, 7 aa, Artificial Sequence
  Description of Artificial Sequence: Synthetic peptide
AASSLQS

SEQ ID NO: 8481 - DNA, 21 bp, Artificial Sequence
  Description of Artificial Sequence: Synthetic oligonucleotide
ggtgcatccagtttgcaaagt

SEQ ID NO: 8482 - protein, 7 aa, Artificial Sequence
  Description of Artificial Sequence: Synthetic peptide
GASSLQS

SEQ ID NO: 8483 - DNA, 21 bp, Artificial Sequence
  Description of Artificial Sequence: Synthetic oligonucleotide
actgcatccagtttgcaaagt

SEQ ID NO: 8484 - protein, 7 aa, Artificial Sequence
  Description of Artificial Sequence: Synthetic peptide
TASSLQS

SEQ ID NO: 8485 - DNA, 21 bp, Artificial Sequence
  Description of Artificial Sequence: Synthetic oligonucleotide
gctgcatccagtttgcaaagt

SEQ ID NO: 8486 - protein, 7 aa, Artificial Sequence
  Description of Artificial Sequence: Synthetic peptide
AASSLQS

SEQ ID NO: 8487 - DNA, 21 bp, Artificial Sequence
  Description of Artificial Sequence: Synthetic oligonucleotide
actgcatccagtttgcaaggt

SEQ ID NO: 8488 - protein, 7 aa, Artificial Sequence
  Description of Artificial Sequence: Synthetic peptide
TASSLQG

SEQ ID NO: 8489 - DNA, 21 bp, Artificial Sequence
  Description of Artificial Sequence: Synthetic oligonucleotide
gaactttccaaccggttctct

SEQ ID NO: 8490 - protein, 7 aa, Artificial Sequence
  Description of Artificial Sequence: Synthetic peptide
ELSNRFS

SEQ ID NO: 8491 - DNA, 21 bp, Artificial Sequence
  Description of Artificial Sequence: Synthetic oligonucleotide
tgggcatctacccgggaatcc

SEQ ID NO: 8492 - protein, 7 aa, Artificial Sequence
  Description of Artificial Sequence: Synthetic peptide
WASTRES

SEQ ID NO: 8493 - DNA, 21 bp, Artificial Sequence
  Description of Artificial Sequence: Synthetic oligonucleotide
gaagtttccaatcggttctct

SEQ ID NO: 8494 - protein, 7 aa, Artificial Sequence
  Description of Artificial Sequence: Synthetic peptide
EVSNRFS

SEQ ID NO: 8495 - DNA, 21 bp, Artificial Sequence
  Description of Artificial Sequence: Synthetic oligonucleotide
gctgcatccagtttgcaaagt

SEQ ID NO: 8496 - protein, 7 aa, Artificial Sequence
  Description of Artificial Sequence: Synthetic peptide
AASSLQS

SEQ ID NO: 8497 - DNA, 21 bp, Artificial Sequence
  Description of Artificial Sequence: Synthetic oligonucleotide
aaggtttctaactgggactct

SEQ ID NO: 8498 - protein, 7 aa, Artificial Sequence
  Description of Artificial Sequence: Synthetic peptide
KVSNWDS

SEQ ID NO: 8499 - DNA, 21 bp, Artificial Sequence
  Description of Artificial Sequence: Synthetic oligonucleotide
gaggtttcccaccggttctct

SEQ ID NO: 8500 - protein, 7 aa, Artificial Sequence
  Description of Artificial Sequence: Synthetic peptide
EVSHRFS

SEQ ID NO: 8501 - DNA, 21 bp, Artificial Sequence
  Description of Artificial Sequence: Synthetic oligonucleotide
gctgcatccagtttgcaaagt

SEQ ID NO: 8502 - protein, 7 aa, Artificial Sequence
  Description of Artificial Sequence: Synthetic peptide
AASSLQS

SEQ ID NO: 8503 - DNA, 21 bp, Artificial Sequence
  Description of Artificial Sequence: Synthetic oligonucleotide
ggtgcattcagcttgcaaagt

SEQ ID NO: 8504 - protein, 7 aa, Artificial Sequence
  Description of Artificial Sequence: Synthetic peptide
GAFSLQS

SEQ ID NO: 8505 - DNA, 21 bp, Artificial Sequence
  Description of Artificial Sequence: Synthetic oligonucleotide
gctgcatccagtttgcaaagt

SEQ ID NO: 8506 - protein, 7 aa, Artificial Sequence
  Description of Artificial Sequence: Synthetic peptide
AASSLQS

SEQ ID NO: 8507 - DNA, 21 bp, Artificial Sequence
  Description of Artificial Sequence: Synthetic oligonucleotide
gctgcatccagtttgcaaagt

SEQ ID NO: 8508 - protein, 7 aa, Artificial Sequence
  Description of Artificial Sequence: Synthetic peptide
AASSLQS

SEQ ID NO: 8509 - DNA, 21 bp, Artificial Sequence
  Description of Artificial Sequence: Synthetic oligonucleotide
gctgcatccagtttgcaaagt

SEQ ID NO: 8510 - protein, 7 aa, Artificial Sequence
  Description of Artificial Sequence: Synthetic peptide
AASSLQS

SEQ ID NO: 8511 - DNA, 21 bp, Artificial Sequence
  Description of Artificial Sequence: Synthetic oligonucleotide
gctgcatccagtttgcgaagt

SEQ ID NO: 8512 - protein, 7 aa, Artificial Sequence
  Description of Artificial Sequence: Synthetic peptide
AASSLRS

SEQ ID NO: 8513 - DNA, 21 bp, Artificial Sequence
  Description of Artificial Sequence: Synthetic oligonucleotide
gctgcatccagcttgcaaagt

SEQ ID NO: 8514 - protein, 7 aa, Artificial Sequence
  Description of Artificial Sequence: Synthetic peptide
AASSLQS

SEQ ID NO: 8515 - DNA, 21 bp, Artificial Sequence
  Description of Artificial Sequence: Synthetic oligonucleotide
ggtgcatccagtttgcaaagt

SEQ ID NO: 8516 - protein, 7 aa, Artificial Sequence
  Description of Artificial Sequence: Synthetic peptide
GASSLQS

SEQ ID NO: 8517 - DNA, 21 bp, Artificial Sequence
  Description of Artificial Sequence: Synthetic oligonucleotide
attgcatccagtttgcaaagt

SEQ ID NO: 8518 - protein, 7 aa, Artificial Sequence
  Description of Artificial Sequence: Synthetic peptide
IASSLQS

SEQ ID NO: 8519 - DNA, 21 bp, Artificial Sequence
  Description of Artificial Sequence: Synthetic oligonucleotide
tgggcatcttcccgggaatcc

SEQ ID NO: 8520 - protein, 7 aa, Artificial Sequence
  Description of Artificial Sequence: Synthetic peptide
WASSRES

SEQ ID NO: 8521 - DNA, 21 bp, Artificial Sequence
  Description of Artificial Sequence: Synthetic oligonucleotide
gctgcatccagtttgcaaact

SEQ ID NO: 8522 - protein, 7 aa, Artificial Sequence
  Description of Artificial Sequence: Synthetic peptide
AASSLQT

SEQ ID NO: 8523 - DNA, 21 bp, Artificial Sequence
  Description of Artificial Sequence: Synthetic oligonucleotide
gctgtatccagtttgcaaagt

SEQ ID NO: 8524 - protein, 7 aa, Artificial Sequence
  Description of Artificial Sequence: Synthetic peptide
AVSSLQS

SEQ ID NO: 8525 - DNA, 21 bp, Artificial Sequence
  Description of Artificial Sequence: Synthetic oligonucleotide
gatacatccagtttgcaaagt

SEQ ID NO: 8526 - protein, 7 aa, Artificial Sequence
  Description of Artificial Sequence: Synthetic peptide
DTSSLQS

SEQ ID NO: 8527 - DNA, 21 bp, Artificial Sequence
  Description of Artificial Sequence: Synthetic oligonucleotide
cgtgcatccagtttgcaaagt

SEQ ID NO: 8528 - protein, 7 aa, Artificial Sequence
  Description of Artificial Sequence: Synthetic peptide
RASSLQS

SEQ ID NO: 8529 - DNA, 21 bp, Artificial Sequence
  Description of Artificial Sequence: Synthetic oligonucleotide
actgcatccagtttgcagagt

SEQ ID NO: 8530 - protein, 7 aa, Artificial Sequence
  Description of Artificial Sequence: Synthetic peptide
TASSLQS

SEQ ID NO: 8531 - DNA, 21 bp, Artificial Sequence
  Description of Artificial Sequence: Synthetic oligonucleotide
gctgcatccagtttgcaaagt

SEQ ID NO: 8532 - protein, 7 aa, Artificial Sequence
  Description of Artificial Sequence: Synthetic peptide
AASSLQS

SEQ ID NO: 8533 - DNA, 21 bp, Artificial Sequence
  Description of Artificial Sequence: Synthetic oligonucleotide
ggtgcatccagtttgcaaagt

SEQ ID NO: 8534 - protein, 7 aa, Artificial Sequence
  Description of Artificial Sequence: Synthetic peptide
GASSLQS

SEQ ID NO: 8535 - DNA, 21 bp, Artificial Sequence
  Description of Artificial Sequence: Synthetic oligonucleotide
gctgcatccagtttgcaaagt

SEQ ID NO: 8536 - protein, 7 aa, Artificial Sequence
  Description of Artificial Sequence: Synthetic peptide
AASSLQS

SEQ ID NO: 8537 - DNA, 21 bp, Artificial Sequence
  Description of Artificial Sequence: Synthetic oligonucleotide
gctgcatccagtttgcaaagt

SEQ ID NO: 8538 - protein, 7 aa, Artificial Sequence
  Description of Artificial Sequence: Synthetic peptide
AASSLQS

SEQ ID NO: 8539 - DNA, 21 bp, Artificial Sequence
  Description of Artificial Sequence: Synthetic oligonucleotide
gctgcatccagtttgcaaagt

SEQ ID NO: 8540 - protein, 7 aa, Artificial Sequence
  Description of Artificial Sequence: Synthetic peptide
AASSLQS

SEQ ID NO: 8541 - DNA, 21 bp, Artificial Sequence
  Description of Artificial Sequence: Synthetic oligonucleotide
gctgcatccagtttgcaaagt

SEQ ID NO: 8542 - protein, 7 aa, Artificial Sequence
  Description of Artificial Sequence: Synthetic peptide
AASSLQS

SEQ ID NO: 8543 - DNA, 21 bp, Artificial Sequence
  Description of Artificial Sequence: Synthetic oligonucleotide
ggtgcatccagtttgcaaagt

SEQ ID NO: 8544 - protein, 7 aa, Artificial Sequence
  Description of Artificial Sequence: Synthetic peptide
GASSLQS

SEQ ID NO: 8545 - DNA, 21 bp, Artificial Sequence
  Description of Artificial Sequence: Synthetic oligonucleotide
gctgcatccagtttgcaaagt

SEQ ID NO: 8546 - protein, 7 aa, Artificial Sequence
  Description of Artificial Sequence: Synthetic peptide
AASSLQS

SEQ ID NO: 8547 - DNA, 21 bp, Artificial Sequence
  Description of Artificial Sequence: Synthetic oligonucleotide
gctgcattcagtttgcaaagt

SEQ ID NO: 8548 - protein, 7 aa, Artificial Sequence
  Description of Artificial Sequence: Synthetic peptide
AAFSLQS

SEQ ID NO: 8549 - DNA, 21 bp, Artificial Sequence
  Description of Artificial Sequence: Synthetic oligonucleotide
tgggcatctacccgggaatcc

SEQ ID NO: 8550 - protein, 7 aa, Artificial Sequence
  Description of Artificial Sequence: Synthetic peptide
WASTRES

SEQ ID NO: 8551 - DNA, 21 bp, Artificial Sequence
  Description of Artificial Sequence: Synthetic oligonucleotide
gaagtttccaaccggttctct

SEQ ID NO: 8552 - protein, 7 aa, Artificial Sequence
  Description of Artificial Sequence: Synthetic peptide
EVSNRFS

SEQ ID NO: 8553 - DNA, 21 bp, Artificial Sequence
  Description of Artificial Sequence: Synthetic oligonucleotide
gctgcatccagtttccaaagt

SEQ ID NO: 8554 - protein, 7 aa, Artificial Sequence
  Description of Artificial Sequence: Synthetic peptide
AASSFQS

SEQ ID NO: 8555 - DNA, 21 bp, Artificial Sequence
  Description of Artificial Sequence: Synthetic oligonucleotide
gctgcttctagtttgcaaaat

SEQ ID NO: 8556 - protein, 7 aa, Artificial Sequence
  Description of Artificial Sequence: Synthetic peptide
AASSLQN

SEQ ID NO: 8557 - DNA, 21 bp, Artificial Sequence
  Description of Artificial Sequence: Synthetic oligonucleotide
gctgcatccagtttacaaagt

SEQ ID NO: 8558 - protein, 7 aa, Artificial Sequence
  Description of Artificial Sequence: Synthetic peptide
AASSLQS

SEQ ID NO: 8559 - DNA, 21 bp, Artificial Sequence
  Description of Artificial Sequence: Synthetic oligonucleotide
gctgcatccagtttgcatagt

SEQ ID NO: 8560 - protein, 7 aa, Artificial Sequence
  Description of Artificial Sequence: Synthetic peptide
AASSLHS

SEQ ID NO: 8561 - DNA, 21 bp, Artificial Sequence
  Description of Artificial Sequence: Synthetic oligonucleotide
gctgcatccagtttgcaaagt

SEQ ID NO: 8562 - protein, 7 aa, Artificial Sequence
  Description of Artificial Sequence: Synthetic peptide
AASSLQS

SEQ ID NO: 8563 - DNA, 21 bp, Artificial Sequence
  Description of Artificial Sequence: Synthetic oligonucleotide
cctgcatccagtttgcaaagt

SEQ ID NO: 8564 - protein, 7 aa, Artificial Sequence
  Description of Artificial Sequence: Synthetic peptide
PASSLQS

SEQ ID NO: 8565 - DNA, 21 bp, Artificial Sequence
  Description of Artificial Sequence: Synthetic oligonucleotide
actgcatccagtttgcaaggt

SEQ ID NO: 8566 - protein, 7 aa, Artificial Sequence
  Description of Artificial Sequence: Synthetic peptide
TASSLQG

SEQ ID NO: 8567 - DNA, 21 bp, Artificial Sequence
  Description of Artificial Sequence: Synthetic oligonucleotide
gaagtttcccaccggctctct

SEQ ID NO: 8568 - protein, 7 aa, Artificial Sequence
  Description of Artificial Sequence: Synthetic peptide
EVSHRLS

SEQ ID NO: 8569 - DNA, 21 bp, Artificial Sequence
  Description of Artificial Sequence: Synthetic oligonucleotide
ggtgcatccagtttgcaaagt

SEQ ID NO: 8570 - protein, 7 aa, Artificial Sequence
  Description of Artificial Sequence: Synthetic peptide
GASSLQS

SEQ ID NO: 8571 - DNA, 21 bp, Artificial Sequence
  Description of Artificial Sequence: Synthetic oligonucleotide
gctgcatccaatttgcaaagt

SEQ ID NO: 8572 - protein, 7 aa, Artificial Sequence
  Description of Artificial Sequence: Synthetic peptide
AASNLQS

SEQ ID NO: 8573 - DNA, 21 bp, Artificial Sequence
  Description of Artificial Sequence: Synthetic oligonucleotide
gctgcatccagtttgcaaagt

SEQ ID NO: 8574 - protein, 7 aa, Artificial Sequence
  Description of Artificial Sequence: Synthetic peptide
AASSLQS

SEQ ID NO: 8575 - DNA, 21 bp, Artificial Sequence
  Description of Artificial Sequence: Synthetic oligonucleotide
gatggatccagtttggaaaca

SEQ ID NO: 8576 - protein, 7 aa, Artificial Sequence
  Description of Artificial Sequence: Synthetic peptide
DGSSLET

SEQ ID NO: 8577 - DNA, 21 bp, Artificial Sequence
  Description of Artificial Sequence: Synthetic oligonucleotide
cctgcatccagtttgcaaagt

SEQ ID NO: 8578 - protein, 7 aa, Artificial Sequence
  Description of Artificial Sequence: Synthetic peptide
PASSLQS

SEQ ID NO: 8579 - DNA, 21 bp, Artificial Sequence
  Description of Artificial Sequence: Synthetic oligonucleotide
gatacatccagtttgcaaagt

SEQ ID NO: 8580 - protein, 7 aa, Artificial Sequence
  Description of Artificial Sequence: Synthetic peptide
DTSSLQS

SEQ ID NO: 8581 - DNA, 21 bp, Artificial Sequence
  Description of Artificial Sequence: Synthetic oligonucleotide
attgcatccagtttgcaaagt

SEQ ID NO: 8582 - protein, 7 aa, Artificial Sequence
  Description of Artificial Sequence: Synthetic peptide
IASSLQS

SEQ ID NO: 8583 - DNA, 21 bp, Artificial Sequence
  Description of Artificial Sequence: Synthetic oligonucleotide
gctgcatccagtttgcaaagt

SEQ ID NO: 8584 - protein, 7 aa, Artificial Sequence
  Description of Artificial Sequence: Synthetic peptide
AASSLQS

SEQ ID NO: 8585 - DNA, 21 bp, Artificial Sequence
  Description of Artificial Sequence: Synthetic oligonucleotide
gctgcatccagtttacaaagt

SEQ ID NO: 8586 - protein, 7 aa, Artificial Sequence
  Description of Artificial Sequence: Synthetic peptide
AASSLQS

SEQ ID NO: 8587 - DNA, 21 bp, Artificial Sequence
  Description of Artificial Sequence: Synthetic oligonucleotide
gaagtttccaaccggttctct

SEQ ID NO: 8588 - protein, 7 aa, Artificial Sequence
  Description of Artificial Sequence: Synthetic peptide
EVSNRFS

SEQ ID NO: 8589 - DNA, 21 bp, Artificial Sequence
  Description of Artificial Sequence: Synthetic oligonucleotide
gttgcatccagtttgcaaagt

SEQ ID NO: 8590 - protein, 7 aa, Artificial Sequence
  Description of Artificial Sequence: Synthetic peptide
VASSLQS

SEQ ID NO: 8591 - DNA, 21 bp, Artificial Sequence
  Description of Artificial Sequence: Synthetic oligonucleotide
gaagtttccaaccggttctct

SEQ ID NO: 8592 - protein, 7 aa, Artificial Sequence
  Description of Artificial Sequence: Synthetic peptide
EVSNRFS

SEQ ID NO: 8593 - DNA, 21 bp, Artificial Sequence
  Description of Artificial Sequence: Synthetic oligonucleotide
actgcatccagtttgcaaagt

SEQ ID NO: 8594 - protein, 7 aa, Artificial Sequence
  Description of Artificial Sequence: Synthetic peptide
TASSLQS

SEQ ID NO: 8595 - DNA, 21 bp, Artificial Sequence
  Description of Artificial Sequence: Synthetic oligonucleotide
gctgcattcagcttgcaaagt

SEQ ID NO: 8596 - protein, 7 aa, Artificial Sequence
  Description of Artificial Sequence: Synthetic peptide
AAFSLQS

SEQ ID NO: 8597 - DNA, 21 bp, Artificial Sequence
  Description of Artificial Sequence: Synthetic oligonucleotide
gctgcatccagttcgcaaagt

SEQ ID NO: 8598 - protein, 7 aa, Artificial Sequence
  Description of Artificial Sequence: Synthetic peptide
AASSSQS

SEQ ID NO: 8599 - DNA, 21 bp, Artificial Sequence
  Description of Artificial Sequence: Synthetic oligonucleotide
ggtgcatccaccagggccact

SEQ ID NO: 8600 - protein, 7 aa, Artificial Sequence
  Description of Artificial Sequence: Synthetic peptide
GASTRAT

SEQ ID NO: 8601 - DNA, 21 bp, Artificial Sequence
  Description of Artificial Sequence: Synthetic oligonucleotide
gctgcatccagtttgcaaagt

SEQ ID NO: 8602 - protein, 7 aa, Artificial Sequence
  Description of Artificial Sequence: Synthetic peptide
AASSLQS

SEQ ID NO: 8603 - DNA, 21 bp, Artificial Sequence
  Description of Artificial Sequence: Synthetic oligonucleotide
gctgcatccagtttgcaaagt

SEQ ID NO: 8604 - protein, 7 aa, Artificial Sequence
  Description of Artificial Sequence: Synthetic peptide
AASSLQS

SEQ ID NO: 8605 - DNA, 21 bp, Artificial Sequence
  Description of Artificial Sequence: Synthetic oligonucleotide
ggtgcatccaccagggccact

SEQ ID NO: 8606 - protein, 7 aa, Artificial Sequence
  Description of Artificial Sequence: Synthetic peptide
GASTRAT

SEQ ID NO: 8607 - DNA, 21 bp, Artificial Sequence
  Description of Artificial Sequence: Synthetic oligonucleotide
gctgcatccagtttgcaaagt

SEQ ID NO: 8608 - protein, 7 aa, Artificial Sequence
  Description of Artificial Sequence: Synthetic peptide
AASSLQS

SEQ ID NO: 8609 - DNA, 21 bp, Artificial Sequence
  Description of Artificial Sequence: Synthetic oligonucleotide
actgcatccagtttacaaagt

SEQ ID NO: 8610 - protein, 7 aa, Artificial Sequence
  Description of Artificial Sequence: Synthetic peptide
TASSLQS

SEQ ID NO: 8611 - DNA, 21 bp, Artificial Sequence
  Description of Artificial Sequence: Synthetic oligonucleotide
gctgcattcagcttgcaaagt

SEQ ID NO: 8612 - protein, 7 aa, Artificial Sequence
  Description of Artificial Sequence: Synthetic peptide
AAFSLQS

SEQ ID NO: 8613 - DNA, 21 bp, Artificial Sequence
  Description of Artificial Sequence: Synthetic oligonucleotide
gctgcatccagtttgcaaagt

SEQ ID NO: 8614 - protein, 7 aa, Artificial Sequence
  Description of Artificial Sequence: Synthetic peptide
AASSLQS

SEQ ID NO: 8615 - DNA, 21 bp, Artificial Sequence
  Description of Artificial Sequence: Synthetic oligonucleotide
gatgcatccaatttggtaaca

SEQ ID NO: 8616 - protein, 7 aa, Artificial Sequence
  Description of Artificial Sequence: Synthetic peptide
DASNLVT

SEQ ID NO: 8617 - DNA, 21 bp, Artificial Sequence
  Description of Artificial Sequence: Synthetic oligonucleotide
gctgcatccagtttgcaaagt

SEQ ID NO: 8618 - protein, 7 aa, Artificial Sequence
  Description of Artificial Sequence: Synthetic peptide
AASSLQS

SEQ ID NO: 8619 - DNA, 21 bp, Artificial Sequence
  Description of Artificial Sequence: Synthetic oligonucleotide
gctgcatccagtttgcatagt

SEQ ID NO: 8620 - protein, 7 aa, Artificial Sequence
  Description of Artificial Sequence: Synthetic peptide
AASSLHS

SEQ ID NO: 8621 - DNA, 21 bp, Artificial Sequence
  Description of Artificial Sequence: Synthetic oligonucleotide
gctgcatccagtttgcaaagt

SEQ ID NO: 8622 - protein, 7 aa, Artificial Sequence
  Description of Artificial Sequence: Synthetic peptide
AASSLQS

SEQ ID NO: 8623 - DNA, 21 bp, Artificial Sequence
  Description of Artificial Sequence: Synthetic oligonucleotide
gctgcatccagtttgcaaagt

SEQ ID NO: 8624 - protein, 7 aa, Artificial Sequence
  Description of Artificial Sequence: Synthetic peptide
AASSLQS

SEQ ID NO: 8625 - DNA, 21 bp, Artificial Sequence
  Description of Artificial Sequence: Synthetic oligonucleotide
actgcatccagtttgcaaagt

SEQ ID NO: 8626 - protein, 7 aa, Artificial Sequence
  Description of Artificial Sequence: Synthetic peptide
TASSLQS

SEQ ID NO: 8627 - DNA, 21 bp, Artificial Sequence
  Description of Artificial Sequence: Synthetic oligonucleotide
gctgcatccagtttgcaacgt

SEQ ID NO: 8628 - protein, 7 aa, Artificial Sequence
  Description of Artificial Sequence: Synthetic peptide
AASSLQR

SEQ ID NO: 8629 - DNA, 21 bp, Artificial Sequence
  Description of Artificial Sequence: Synthetic oligonucleotide
gctgcatccagtttgcaaggt

SEQ ID NO: 8630 - protein, 7 aa, Artificial Sequence
  Description of Artificial Sequence: Synthetic peptide
AASSLQG

SEQ ID NO: 8631 - DNA, 21 bp, Artificial Sequence
  Description of Artificial Sequence: Synthetic oligonucleotide
gctgcatccagtttgcaaagt

SEQ ID NO: 8632 - protein, 7 aa, Artificial Sequence
  Description of Artificial Sequence: Synthetic peptide
AASSLQS

SEQ ID NO: 8633 - DNA, 21 bp, Artificial Sequence
  Description of Artificial Sequence: Synthetic oligonucleotide
ggtgcatccactttgcaaagt

SEQ ID NO: 8634 - protein, 7 aa, Artificial Sequence
  Description of Artificial Sequence: Synthetic peptide
GASTLQS

SEQ ID NO: 8635 - DNA, 21 bp, Artificial Sequence
  Description of Artificial Sequence: Synthetic oligonucleotide
gctgcatccagtttgcagagt

SEQ ID NO: 8636 - protein, 7 aa, Artificial Sequence
  Description of Artificial Sequence: Synthetic peptide
AASSLQS

SEQ ID NO: 8637 - DNA, 21 bp, Artificial Sequence
  Description of Artificial Sequence: Synthetic oligonucleotide
gctgcatcccgtttgcaaagt

SEQ ID NO: 8638 - protein, 7 aa, Artificial Sequence
  Description of Artificial Sequence: Synthetic peptide
AASRLQS

SEQ ID NO: 8639 - DNA, 21 bp, Artificial Sequence
  Description of Artificial Sequence: Synthetic oligonucleotide
tgggcatctacccgggaatcc

SEQ ID NO: 8640 - protein, 7 aa, Artificial Sequence
  Description of Artificial Sequence: Synthetic peptide
WASTRES

SEQ ID NO: 8641 - DNA, 21 bp, Artificial Sequence
  Description of Artificial Sequence: Synthetic oligonucleotide
gctgcatccagtttgcaaagt

SEQ ID NO: 8642 - protein, 7 aa, Artificial Sequence
  Description of Artificial Sequence: Synthetic peptide
AASSLQS

SEQ ID NO: 8643 - DNA, 21 bp, Artificial Sequence
  Description of Artificial Sequence: Synthetic oligonucleotide
gttgcatccagtttgcaaggt

SEQ ID NO: 8644 - protein, 7 aa, Artificial Sequence
  Description of Artificial Sequence: Synthetic peptide
VASSLQG

SEQ ID NO: 8645 - DNA, 21 bp, Artificial Sequence
  Description of Artificial Sequence: Synthetic oligonucleotide
actgcatccaatttgcaaagt

SEQ ID NO: 8646 - protein, 7 aa, Artificial Sequence
  Description of Artificial Sequence: Synthetic peptide
TASNLQS

SEQ ID NO: 8647 - DNA, 21 bp, Artificial Sequence
  Description of Artificial Sequence: Synthetic oligonucleotide
gctgcatccagtttgcaaagt

SEQ ID NO: 8648 - protein, 7 aa, Artificial Sequence
  Description of Artificial Sequence: Synthetic peptide
AASSLQS

SEQ ID NO: 8649 - DNA, 21 bp, Artificial Sequence
  Description of Artificial Sequence: Synthetic oligonucleotide
gctgcatccaggttgcaaagt

SEQ ID NO: 8650 - protein, 7 aa, Artificial Sequence
  Description of Artificial Sequence: Synthetic peptide
AASRLQS

SEQ ID NO: 8651 - DNA, 21 bp, Artificial Sequence
  Description of Artificial Sequence: Synthetic oligonucleotide
gttgcatccagtttgcaaagt

SEQ ID NO: 8652 - protein, 7 aa, Artificial Sequence
  Description of Artificial Sequence: Synthetic peptide
VASSLQS

SEQ ID NO: 8653 - DNA, 21 bp, Artificial Sequence
  Description of Artificial Sequence: Synthetic oligonucleotide
gctgcatccagtttgcaaagt

SEQ ID NO: 8654 - protein, 7 aa, Artificial Sequence
  Description of Artificial Sequence: Synthetic peptide
AASSLQS

SEQ ID NO: 8655 - DNA, 21 bp, Artificial Sequence
  Description of Artificial Sequence: Synthetic oligonucleotide
gttgcatccagtttgcaaagt

SEQ ID NO: 8656 - protein, 7 aa, Artificial Sequence
  Description of Artificial Sequence: Synthetic peptide
VASSLQS

SEQ ID NO: 8657 - DNA, 21 bp, Artificial Sequence
  Description of Artificial Sequence: Synthetic oligonucleotide
gctgcatccagtttgcaaagt

SEQ ID NO: 8658 - protein, 7 aa, Artificial Sequence
  Description of Artificial Sequence: Synthetic peptide
AASSLQS

SEQ ID NO: 8659 - DNA, 21 bp, Artificial Sequence
  Description of Artificial Sequence: Synthetic oligonucleotide
ggtgcatccagtttgcaaagt

SEQ ID NO: 8660 - protein, 7 aa, Artificial Sequence
  Description of Artificial Sequence: Synthetic peptide
GASSLQS

SEQ ID NO: 8661 - DNA, 21 bp, Artificial Sequence
  Description of Artificial Sequence: Synthetic oligonucleotide
gctgcatccagtttgcaaagt

SEQ ID NO: 8662 - protein, 7 aa, Artificial Sequence
  Description of Artificial Sequence: Synthetic peptide
AASSLQS

SEQ ID NO: 8663 - DNA, 21 bp, Artificial Sequence
  Description of Artificial Sequence: Synthetic oligonucleotide
ggtgcatacagtctgcaaagt

SEQ ID NO: 8664 - protein, 7 aa, Artificial Sequence
  Description of Artificial Sequence: Synthetic peptide
GAYSLQS

SEQ ID NO: 8665 - DNA, 21 bp, Artificial Sequence
  Description of Artificial Sequence: Synthetic oligonucleotide
gctgcatccagtttgcaaagt

SEQ ID NO: 8666 - protein, 7 aa, Artificial Sequence
  Description of Artificial Sequence: Synthetic peptide
AASSLQS

SEQ ID NO: 8667 - DNA, 21 bp, Artificial Sequence
  Description of Artificial Sequence: Synthetic oligonucleotide
gctgcatccagtttgcaaagt

SEQ ID NO: 8668 - protein, 7 aa, Artificial Sequence
  Description of Artificial Sequence: Synthetic peptide
AASSLQS

SEQ ID NO: 8669 - DNA, 21 bp, Artificial Sequence
  Description of Artificial Sequence: Synthetic oligonucleotide
gctacatccagtttgcaaagt

SEQ ID NO: 8670 - protein, 7 aa, Artificial Sequence
  Description of Artificial Sequence: Synthetic peptide
ATSSLQS

SEQ ID NO: 8671 - DNA, 21 bp, Artificial Sequence
  Description of Artificial Sequence: Synthetic oligonucleotide
ggtgcgtccggtttgcaaagt

SEQ ID NO: 8672 - protein, 7 aa, Artificial Sequence
  Description of Artificial Sequence: Synthetic peptide
GASGLQS

SEQ ID NO: 8673 - DNA, 21 bp, Artificial Sequence
  Description of Artificial Sequence: Synthetic oligonucleotide
gttgcatccagtttgcaaagt

SEQ ID NO: 8674 - protein, 7 aa, Artificial Sequence
  Description of Artificial Sequence: Synthetic peptide
VASSLQS

SEQ ID NO: 8675 - DNA, 21 bp, Artificial Sequence
  Description of Artificial Sequence: Synthetic oligonucleotide
gctgcatccagtttgcaaagt

SEQ ID NO: 8676 - protein, 7 aa, Artificial Sequence
  Description of Artificial Sequence: Synthetic peptide
AASSLQS

SEQ ID NO: 8677 - DNA, 21 bp, Artificial Sequence
  Description of Artificial Sequence: Synthetic oligonucleotide
gctgcatccagtttgcaaagt

SEQ ID NO: 8678 - protein, 7 aa, Artificial Sequence
  Description of Artificial Sequence: Synthetic peptide
AASSLQS

SEQ ID NO: 8679 - DNA, 21 bp, Artificial Sequence
  Description of Artificial Sequence: Synthetic oligonucleotide
gctgcatccagtttgcaaagt

SEQ ID NO: 8680 - protein, 7 aa, Artificial Sequence
  Description of Artificial Sequence: Synthetic peptide
AASSLQS

SEQ ID NO: 8681 - DNA, 21 bp, Artificial Sequence
  Description of Artificial Sequence: Synthetic oligonucleotide
gctgcacccagtttgcaaagt

SEQ ID NO: 8682 - protein, 7 aa, Artificial Sequence
  Description of Artificial Sequence: Synthetic peptide
AAPSLQS

SEQ ID NO: 8683 - DNA, 21 bp, Artificial Sequence
  Description of Artificial Sequence: Synthetic oligonucleotide
gctgcatccaggttgcaaagt

SEQ ID NO: 8684 - protein, 7 aa, Artificial Sequence
  Description of Artificial Sequence: Synthetic peptide
AASRLQS

SEQ ID NO: 8685 - DNA, 21 bp, Artificial Sequence
  Description of Artificial Sequence: Synthetic oligonucleotide
gttgcatccagtttgcaaagt

SEQ ID NO: 8686 - protein, 7 aa, Artificial Sequence
  Description of Artificial Sequence: Synthetic peptide
VASSLQS

SEQ ID NO: 8687 - DNA, 21 bp, Artificial Sequence
  Description of Artificial Sequence: Synthetic oligonucleotide
gttgcatccagtttgcaaagt

SEQ ID NO: 8688 - protein, 7 aa, Artificial Sequence
  Description of Artificial Sequence: Synthetic peptide
VASSLQS

SEQ ID NO: 8689 - DNA, 21 bp, Artificial Sequence
  Description of Artificial Sequence: Synthetic oligonucleotide
gatgcctccaatttggaaaca

SEQ ID NO: 8690 - protein, 7 aa, Artificial Sequence
  Description of Artificial Sequence: Synthetic peptide
DASNLET

SEQ ID NO: 8691 - DNA, 21 bp, Artificial Sequence
  Description of Artificial Sequence: Synthetic oligonucleotide
gctgcatcccgtttgcaaagt

SEQ ID NO: 8692 - protein, 7 aa, Artificial Sequence
  Description of Artificial Sequence: Synthetic peptide
AASRLQS

SEQ ID NO: 8693 - DNA, 21 bp, Artificial Sequence
  Description of Artificial Sequence: Synthetic oligonucleotide
gctgcatccagtttgcaaagt

SEQ ID NO: 8694 - protein, 7 aa, Artificial Sequence
  Description of Artificial Sequence: Synthetic peptide
AASSLQS

SEQ ID NO: 8695 - DNA, 21 bp, Artificial Sequence
  Description of Artificial Sequence: Synthetic oligonucleotide
gaagtttccaaccggttctct

SEQ ID NO: 8696 - protein, 7 aa, Artificial Sequence
  Description of Artificial Sequence: Synthetic peptide
EVSNRFS

SEQ ID NO: 8697 - DNA, 21 bp, Artificial Sequence
  Description of Artificial Sequence: Synthetic oligonucleotide
gctgcatccagtttgcaaagt

SEQ ID NO: 8698 - protein, 7 aa, Artificial Sequence
  Description of Artificial Sequence: Synthetic peptide
AASSLQS

SEQ ID NO: 8699 - DNA, 21 bp, Artificial Sequence
  Description of Artificial Sequence: Synthetic oligonucleotide
ggtgcatccagtttccaaagt

SEQ ID NO: 8700 - protein, 7 aa, Artificial Sequence
  Description of Artificial Sequence: Synthetic peptide
GASSFQS

SEQ ID NO: 8701 - DNA, 21 bp, Artificial Sequence
  Description of Artificial Sequence: Synthetic oligonucleotide
gctgcatccagtttgcaaagt

SEQ ID NO: 8702 - protein, 7 aa, Artificial Sequence
  Description of Artificial Sequence: Synthetic peptide
AASSLQS

SEQ ID NO: 8703 - DNA, 21 bp, Artificial Sequence
  Description of Artificial Sequence: Synthetic oligonucleotide
ggtgcatccagtttgcaaagt

SEQ ID NO: 8704 - protein, 7 aa, Artificial Sequence
  Description of Artificial Sequence: Synthetic peptide
GASSLQS

SEQ ID NO: 8705 - DNA, 21 bp, Artificial Sequence
  Description of Artificial Sequence: Synthetic oligonucleotide
caagataggaagcggccctca

SEQ ID NO: 8706 - protein, 7 aa, Artificial Sequence
  Description of Artificial Sequence: Synthetic peptide
QDRKRPS

SEQ ID NO: 8707 - DNA, 21 bp, Artificial Sequence
  Description of Artificial Sequence: Synthetic oligonucleotide
caagatagtaagcggtcctca

SEQ ID NO: 8708 - protein, 7 aa, Artificial Sequence
  Description of Artificial Sequence: Synthetic peptide
QDSKRSS

SEQ ID NO: 8709 - DNA, 21 bp, Artificial Sequence
  Description of Artificial Sequence: Synthetic oligonucleotide
caagataggaagcggccctca

SEQ ID NO: 8710 - protein, 7 aa, Artificial Sequence
  Description of Artificial Sequence: Synthetic peptide
QDRKRPS

SEQ ID NO: 8711 - DNA, 33 bp, Artificial Sequence; identical to SEQ ID NO: 8207
  Description of Artificial Sequence: Synthetic oligonucleotide

SEQ ID NO: 8712 - protein, 11 aa, Artificial Sequence
  Description of Artificial Sequence: Synthetic peptide
VKSDGSHSKGD

SEQ ID NO: 8713 - DNA, 21 bp, Artificial Sequence
  Description of Artificial Sequence: Synthetic oligonucleotide
caagatagcaagcggccctta

SEQ ID NO: 8714 - protein, 7 aa, Artificial Sequence
  Description of Artificial Sequence: Synthetic peptide
QDSKRPL

SEQ ID NO: 8715 - DNA, 21 bp, Artificial Sequence
  Description of Artificial Sequence: Synthetic oligonucleotide
caagatagcaagcggccctca

SEQ ID NO: 8716 - protein, 7 aa, Artificial Sequence
  Description of Artificial Sequence: Synthetic peptide
QDSKRPS

SEQ ID NO: 8717 - DNA, 21 bp, Artificial Sequence
  Description of Artificial Sequence: Synthetic oligonucleotide
attaataatcagcggccctca

SEQ ID NO: 8718 - protein, 7 aa, Artificial Sequence
  Description of Artificial Sequence: Synthetic peptide
INNQRPS

SEQ ID NO: 8719 - DNA, 21 bp, Artificial Sequence
  Description of Artificial Sequence: Synthetic oligonucleotide
caagatcgcaagcggccctca

SEQ ID NO: 8720 - protein, 7 aa, Artificial Sequence
  Description of Artificial Sequence: Synthetic peptide
QDRKRPS

SEQ ID NO: 8721 - DNA, 21 bp, Artificial Sequence
  Description of Artificial Sequence: Synthetic oligonucleotide
caagataggaagcggccctca

SEQ ID NO: 8722 - protein, 7 aa, Artificial Sequence
  Description of Artificial Sequence: Synthetic peptide
QDRKRPS

SEQ ID NO: 8723 - DNA, 21 bp, Artificial Sequence
  Description of Artificial Sequence: Synthetic oligonucleotide
caagatagcaagcggccctca

SEQ ID NO: 8724 - protein, 7 aa, Artificial Sequence
  Description of Artificial Sequence: Synthetic peptide
QDSKRPS

SEQ ID NO: 8725 - DNA, 21 bp, Artificial Sequence
  Description of Artificial Sequence: Synthetic oligonucleotide
caagatagtaagcggccctca

SEQ ID NO: 8726 - protein, 7 aa, Artificial Sequence
  Description of Artificial Sequence: Synthetic peptide
QDSKRPS

SEQ ID NO: 8727 - DNA, 21 bp, Artificial Sequence
  Description of Artificial Sequence: Synthetic oligonucleotide
caagatcgcaagcggccctca

SEQ ID NO: 8728 - protein, 7 aa, Artificial Sequence
  Description of Artificial Sequence: Synthetic peptide
QDRKRPS

SEQ ID NO: 8729 - DNA, 21 bp, Artificial Sequence
  Description of Artificial Sequence: Synthetic oligonucleotide
caagatagcaagcggccctca

SEQ ID NO: 8730 - protein, 7 aa, Artificial Sequence
  Description of Artificial Sequence: Synthetic peptide
QDSKRPS

SEQ ID NO: 8731 - DNA, 21 bp, Artificial Sequence
  Description of Artificial Sequence: Synthetic oligonucleotide
caagataggaagcggccctca

SEQ ID NO: 8732 - protein, 7 aa, Artificial Sequence
  Description of Artificial Sequence: Synthetic peptide
QDRKRPS

SEQ ID NO: 8733 - DNA, 21 bp, Artificial Sequence
  Description of Artificial Sequence: Synthetic oligonucleotide
caagatagcaagcggccctca

SEQ ID NO: 8734 - protein, 7 aa, Artificial Sequence
  Description of Artificial Sequence: Synthetic peptide
QDSKRPS

SEQ ID NO: 8735 - DNA, 21 bp, Artificial Sequence
  Description of Artificial Sequence: Synthetic oligonucleotide
caagataggaagcggccctca

SEQ ID NO: 8736 - protein, 7 aa, Artificial Sequence
  Description of Artificial Sequence: Synthetic peptide
QDRKRPS

SEQ ID NO: 8737 - DNA, 21 bp, Artificial Sequence
  Description of Artificial Sequence: Synthetic oligonucleotide
caagatcgcaagcggccctca

SEQ ID NO: 8738 - protein, 7 aa, Artificial Sequence
  Description of Artificial Sequence: Synthetic peptide
QDRKRPS

SEQ ID NO: 8739 - DNA, 21 bp, Artificial Sequence
  Description of Artificial Sequence: Synthetic oligonucleotide
agcgatagcaaccggccctca

SEQ ID NO: 8740 - protein, 7 aa, Artificial Sequence
  Description of Artificial Sequence: Synthetic peptide
SDSNRPS

SEQ ID NO: 8741 - DNA, 21 bp, Artificial Sequence
  Description of Artificial Sequence: Synthetic oligonucleotide
caagatagcaagcggccctca

SEQ ID NO: 8742 - protein, 7 aa, Artificial Sequence
  Description of Artificial Sequence: Synthetic peptide
QDSKRPS

SEQ ID NO: 8743 - DNA, 21 bp, Artificial Sequence
  Description of Artificial Sequence: Synthetic oligonucleotide
gatgataccgaccggccctca

SEQ ID NO: 8744 - protein, 7 aa, Artificial Sequence
  Description of Artificial Sequence: Synthetic peptide
DDTDRPS

SEQ ID NO: 8745 - DNA, 21 bp, Artificial Sequence
  Description of Artificial Sequence: Synthetic oligonucleotide
caagataggaagcggccctca

SEQ ID NO: 8746 - protein, 7 aa, Artificial Sequence
  Description of Artificial Sequence: Synthetic peptide
QDRKRPS

SEQ ID NO: 8747 - DNA, 21 bp, Artificial Sequence
  Description of Artificial Sequence: Synthetic oligonucleotide
caagatagcaagcggccctca

SEQ ID NO: 8748 - protein, 7 aa, Artificial Sequence
  Description of Artificial Sequence: Synthetic peptide
QDSKRPS

SEQ ID NO: 8749 - DNA, 21 bp, Artificial Sequence
  Description of Artificial Sequence: Synthetic oligonucleotide
caagatagcaagcggccctca

SEQ ID NO: 8750 - protein, 7 aa, Artificial Sequence
  Description of Artificial Sequence: Synthetic peptide
QDSKRPS

SEQ ID NO: 8751 - DNA, 21 bp, Artificial Sequence
  Description of Artificial Sequence: Synthetic oligonucleotide
caagatcgcaagcggccctca

SEQ ID NO: 8752 - protein, 7 aa, Artificial Sequence
  Description of Artificial Sequence: Synthetic peptide
QDRKRPS

SEQ ID NO: 8753 - DNA, 21 bp, Artificial Sequence
  Description of Artificial Sequence: Synthetic oligonucleotide
caagatagaaagcggccctca

SEQ ID NO: 8754 - protein, 7 aa, Artificial Sequence
  Description of Artificial Sequence: Synthetic peptide
QDRKRPS

SEQ ID NO: 8755 - DNA, 21 bp, Artificial Sequence
  Description of Artificial Sequence: Synthetic oligonucleotide
caagattccaagcggccctca

SEQ ID NO: 8756 - protein, 7 aa, Artificial Sequence
  Description of Artificial Sequence: Synthetic peptide
QDSKRPS

SEQ ID NO: 8757 - DNA, 21 bp, Artificial Sequence
  Description of Artificial Sequence: Synthetic oligonucleotide
caagataggaagcggccctca

SEQ ID NO: 8758 - protein, 7 aa, Artificial Sequence
  Description of Artificial Sequence: Synthetic peptide
QDRKRPS

SEQ ID NO: 8759 - DNA, 21 bp, Artificial Sequence
  Description of Artificial Sequence: Synthetic oligonucleotide
attaataatcagcggccctca

SEQ ID NO: 8760 - protein, 7 aa, Artificial Sequence
  Description of Artificial Sequence: Synthetic peptide
INNQRPS

SEQ ID NO: 8761 - DNA, 21 bp, Artificial Sequence
  Description of Artificial Sequence: Synthetic oligonucleotide
gaggtcagtaatcggccctca

SEQ ID NO: 8762 - protein, 7 aa, Artificial Sequence
  Description of Artificial Sequence: Synthetic peptide
EVSNRPS

SEQ ID NO: 8763 - DNA, 21 bp, Artificial Sequence
  Description of Artificial Sequence: Synthetic oligonucleotide
caagatagcaagcggccctca

SEQ ID NO: 8764 - protein, 7 aa, Artificial Sequence
  Description of Artificial Sequence: Synthetic peptide
QDSKRPS

SEQ ID NO: 8765 - DNA, 21 bp, Artificial Sequence
  Description of Artificial Sequence: Synthetic oligonucleotide
caagataggaagcggccctca

SEQ ID NO: 8766 - protein, 7 aa, Artificial Sequence
  Description of Artificial Sequence: Synthetic peptide
QDRKRPS

SEQ ID NO: 8767 - DNA, 21 bp, Artificial Sequence
  Description of Artificial Sequence: Synthetic oligonucleotide
tgggcatctacccgggaatcc

SEQ ID NO: 8768 - protein, 7 aa, Artificial Sequence
  Description of Artificial Sequence: Synthetic peptide
WASTRES

SEQ ID NO: 8769 - DNA, 21 bp, Artificial Sequence
  Description of Artificial Sequence: Synthetic oligonucleotide
caagatatgaagcggccctca

SEQ ID NO: 8770 - protein, 7 aa, Artificial Sequence
  Description of Artificial Sequence: Synthetic peptide
QDMKRPS

SEQ ID NO: 8771 - DNA, 21 bp, Artificial Sequence
  Description of Artificial Sequence: Synthetic oligonucleotide
ggtacatccagcagggccact

SEQ ID NO: 8772 - protein, 7 aa, Artificial Sequence
  Description of Artificial Sequence: Synthetic peptide
GTSSRAT

SEQ ID NO: 8773 - DNA, 21 bp, Artificial Sequence
  Description of Artificial Sequence: Synthetic oligonucleotide
gttacatccagtttgcaaggt

SEQ ID NO: 8774 - protein, 7 aa, Artificial Sequence
  Description of Artificial Sequence: Synthetic peptide
VTSSLQG

SEQ ID NO: 8775 - DNA, 21 bp, Artificial Sequence
  Description of Artificial Sequence: Synthetic oligonucleotide
gctgcatccagtttgcaaagt

SEQ ID NO: 8776 - protein, 7 aa, Artificial Sequence
  Description of Artificial Sequence: Synthetic peptide
AASSLQS

SEQ ID NO: 8777 - DNA, 21 bp, Artificial Sequence
  Description of Artificial Sequence: Synthetic oligonucleotide
gctgcatccagtttgcaaagt

SEQ ID NO: 8778 - protein, 7 aa, Artificial Sequence
  Description of Artificial Sequence: Synthetic peptide
AASSLQS

SEQ ID NO: 8779 - DNA, 21 bp, Artificial Sequence
  Description of Artificial Sequence: Synthetic oligonucleotide
gatgcatccagtttgcaaagt

SEQ ID NO: 8780 - protein, 7 aa, Artificial Sequence
  Description of Artificial Sequence: Synthetic peptide
DASSLQS

SEQ ID NO: 8781 - DNA, 21 bp, Artificial Sequence
  Description of Artificial Sequence: Synthetic oligonucleotide
gctgcatccagtttgcaaagt

SEQ ID NO: 8782 - protein, 7 aa, Artificial Sequence
  Description of Artificial Sequence: Synthetic peptide
AASSLQS

SEQ ID NO: 8783 - DNA, 21 bp, Artificial Sequence
  Description of Artificial Sequence: Synthetic oligonucleotide
gctgcatccaatttgcaaagt

SEQ ID NO: 8784 - protein, 7 aa, Artificial Sequence
  Description of Artificial Sequence: Synthetic peptide
AASNLQS

SEQ ID NO: 8785 - DNA, 21 bp, Artificial Sequence
  Description of Artificial Sequence: Synthetic oligonucleotide
gctgcatccagtttgcaaagt

SEQ ID NO: 8786 - protein, 7 aa, Artificial Sequence
  Description of Artificial Sequence: Synthetic peptide
AASSLQS

SEQ ID NO: 8787 - DNA, 21 bp, Artificial Sequence
  Description of Artificial Sequence: Synthetic oligonucleotide
gctgcatccactttgcaaagt

SEQ ID NO: 8788 - protein, 7 aa, Artificial Sequence
  Description of Artificial Sequence: Synthetic peptide
AASTLQS

SEQ ID NO: 8789 - DNA, 21 bp, Artificial Sequence
  Description of Artificial Sequence: Synthetic oligonucleotide
gctgcatccagtttgcaaagt

SEQ ID NO: 8790 - protein, 7 aa, Artificial Sequence
  Description of Artificial Sequence: Synthetic peptide
AASSLQS

SEQ ID NO: 8791 - DNA, 21 bp, Artificial Sequence
  Description of Artificial Sequence: Synthetic oligonucleotide
gctgcatccagtttgcaaagt

SEQ ID NO: 8792 - protein, 7 aa, Artificial Sequence
  Description of Artificial Sequence: Synthetic peptide
AASSLQS

SEQ ID NO: 8793 - DNA, 21 bp, Artificial Sequence
  Description of Artificial Sequence: Synthetic oligonucleotide
gctgcatccagtttgcaaagt

SEQ ID NO: 8794 - protein, 7 aa, Artificial Sequence
  Description of Artificial Sequence: Synthetic peptide
AASSLQS

SEQ ID NO: 8795 - DNA, 21 bp, Artificial Sequence
  Description of Artificial Sequence: Synthetic oligonucleotide
gctgcatccagtttgcaaagt

SEQ ID NO: 8796 - protein, 7 aa, Artificial Sequence
  Description of Artificial Sequence: Synthetic peptide
AASSLQS

SEQ ID NO: 8797 - DNA, 21 bp, Artificial Sequence
  Description of Artificial Sequence: Synthetic oligonucleotide
ggtgcatccagtttgcaaagt

SEQ ID NO: 8798 - protein, 7 aa, Artificial Sequence
  Description of Artificial Sequence: Synthetic peptide
GASSLQS

SEQ ID NO: 8799 - DNA, 21 bp, Artificial Sequence
  Description of Artificial Sequence: Synthetic oligonucleotide
gctgcatccagtttgcaaagt

SEQ ID NO: 8800 - protein, 7 aa, Artificial Sequence
  Description of Artificial Sequence: Synthetic peptide
AASSLQS

SEQ ID NO: 8801 - DNA, 21 bp, Artificial Sequence
  Description of Artificial Sequence: Synthetic oligonucleotide
gttacatccagtttgcaaggt

SEQ ID NO: 8802 - protein, 7 aa, Artificial Sequence
  Description of Artificial Sequence: Synthetic peptide
VTSSLQG

SEQ ID NO: 8803 - DNA, 21 bp, Artificial Sequence
  Description of Artificial Sequence: Synthetic oligonucleotide
gctgcatccagtttgcaaagt

SEQ ID NO: 8804 - protein, 7 aa, Artificial Sequence
  Description of Artificial Sequence: Synthetic peptide
AASSLQS

SEQ ID NO: 8805 - DNA, 21 bp, Artificial Sequence
  Description of Artificial Sequence: Synthetic oligonucleotide
gctgcatccagtctgcaaagt

SEQ ID NO: 8806 - protein, 7 aa, Artificial Sequence
  Description of Artificial Sequence: Synthetic peptide
AASSLQS

SEQ ID NO: 8807 - DNA, 21 bp, Artificial Sequence
  Description of Artificial Sequence: Synthetic oligonucleotide
actacatccagtttgcaaagt

SEQ ID NO: 8808 - protein, 7 aa, Artificial Sequence
  Description of Artificial Sequence: Synthetic peptide
TTSSLQS

SEQ ID NO: 8809 - DNA, 21 bp, Artificial Sequence
  Description of Artificial Sequence: Synthetic oligonucleotide
gctgcatccagttcgcaaagt

SEQ ID NO: 8810 - protein, 7 aa, Artificial Sequence
  Description of Artificial Sequence: Synthetic peptide
AASSSQS

SEQ ID NO: 8811 - DNA, 21 bp, Artificial Sequence
  Description of Artificial Sequence: Synthetic oligonucleotide
gctgcatccagcttgcaaagt

SEQ ID NO: 8812 - protein, 7 aa, Artificial Sequence
  Description of Artificial Sequence: Synthetic peptide
AASSLQS

SEQ ID NO: 8813 - DNA, 21 bp, Artificial Sequence
  Description of Artificial Sequence: Synthetic oligonucleotide
actgcatccagtttgcaaagt

SEQ ID NO: 8814 - protein, 7 aa, Artificial Sequence
  Description of Artificial Sequence: Synthetic peptide
TASSLQS

SEQ ID NO: 8815 - DNA, 21 bp, Artificial Sequence
  Description of Artificial Sequence: Synthetic oligonucleotide
gttgcatgtagtttccaaagt

SEQ ID NO: 8816 - protein, 7 aa, Artificial Sequence
  Description of Artificial Sequence: Synthetic peptide
VACSFQS

SEQ ID NO: 8817 - DNA, 21 bp, Artificial Sequence
  Description of Artificial Sequence: Synthetic oligonucleotide
gctgcatccagtttgcaaagt

SEQ ID NO: 8818 - protein, 7 aa, Artificial Sequence
  Description of Artificial Sequence: Synthetic peptide
AASSLQS

SEQ ID NO: 8819 - DNA, 21 bp, Artificial Sequence
  Description of Artificial Sequence: Synthetic oligonucleotide
ggtgcatccagtttgcaaagt

SEQ ID NO: 8820 - protein, 7 aa, Artificial Sequence
  Description of Artificial Sequence: Synthetic peptide
GASSLQS

SEQ ID NO: 8821 - DNA, 21 bp, Artificial Sequence
  Description of Artificial Sequence: Synthetic oligonucleotide
gctgcatccaatttgcaaagt

SEQ ID NO: 8822 - protein, 7 aa, Artificial Sequence
  Description of Artificial Sequence: Synthetic peptide
AASNLQS

SEQ ID NO: 8823 - DNA, 21 bp, Artificial Sequence
  Description of Artificial Sequence: Synthetic oligonucleotide
tctgcatccagtttgcaaagt

SEQ ID NO: 8824 - protein, 7 aa, Artificial Sequence
  Description of Artificial Sequence: Synthetic peptide
SASSLQS

SEQ ID NO: 8825 - DNA, 21 bp, Artificial Sequence
  Description of Artificial Sequence: Synthetic oligonucleotide
gttgcatccagtttgcaaagt

SEQ ID NO: 8826 - protein, 7 aa, Artificial Sequence
  Description of Artificial Sequence: Synthetic peptide
VASSLQS

SEQ ID NO: 8827 - DNA, 21 bp, Artificial Sequence
  Description of Artificial Sequence: Synthetic oligonucleotide
gctgcatccagtttacaaagt

SEQ ID NO: 8828 - protein, 7 aa, Artificial Sequence
  Description of Artificial Sequence: Synthetic peptide
AASSLQS

SEQ ID NO: 8829 - DNA, 21 bp, Artificial Sequence
  Description of Artificial Sequence: Synthetic oligonucleotide
gctgcatccagtttgcaaagt

SEQ ID NO: 8830 - protein, 7 aa, Artificial Sequence
  Description of Artificial Sequence: Synthetic peptide
AASSLQS

SEQ ID NO: 8831 - DNA, 21 bp, Artificial Sequence
  Description of Artificial Sequence: Synthetic oligonucleotide
gctgcatccagtttgcaaagt

SEQ ID NO: 8832 - protein, 7 aa, Artificial Sequence
  Description of Artificial Sequence: Synthetic peptide
AASSLQS

SEQ ID NO: 8833 - DNA, 21 bp, Artificial Sequence
  Description of Artificial Sequence: Synthetic oligonucleotide
actgcatccagtttgcaaagt

SEQ ID NO: 8834 - protein, 7 aa, Artificial Sequence
  Description of Artificial Sequence: Synthetic peptide
TASSLQS

SEQ ID NO: 8835 - DNA, 21 bp, Artificial Sequence
  Description of Artificial Sequence: Synthetic oligonucleotide
actgcatccagtttgcaaagt

SEQ ID NO: 8836 - protein, 7 aa, Artificial Sequence
  Description of Artificial Sequence: Synthetic peptide
TASSLQS

SEQ ID NO: 8837 - DNA, 21 bp, Artificial Sequence
  Description of Artificial Sequence: Synthetic oligonucleotide
gctgcatccagtttacaaagt

SEQ ID NO: 8838 - protein, 7 aa, Artificial Sequence
  Description of Artificial Sequence: Synthetic peptide
AASSLQS

SEQ ID NO: 8839 - DNA, 21 bp, Artificial Sequence
  Description of Artificial Sequence: Synthetic oligonucleotide
gctgcatccagttcgcaaagt

SEQ ID NO: 8840 - protein, 7 aa, Artificial Sequence
  Description of Artificial Sequence: Synthetic peptide
AASSSQS

SEQ ID NO: 8841 - DNA, 21 bp, Artificial Sequence
  Description of Artificial Sequence: Synthetic oligonucleotide
gttgcatccagtttgcaaagt

SEQ ID NO: 8842 - protein, 7 aa, Artificial Sequence
  Description of Artificial Sequence: Synthetic peptide
VASSLQS

SEQ ID NO: 8843 - DNA, 21 bp, Artificial Sequence
  Description of Artificial Sequence: Synthetic oligonucleotide
gctgcatccagtttgcaaagt

SEQ ID NO: 8844 - protein, 7 aa, Artificial Sequence
  Description of Artificial Sequence: Synthetic peptide
AASSLQS

SEQ ID NO: 8845 - DNA, 21 bp, Artificial Sequence
  Description of Artificial Sequence: Synthetic oligonucleotide
ggtacatccagtttgcaaagt

SEQ ID NO: 8846 - protein, 7 aa, Artificial Sequence
  Description of Artificial Sequence: Synthetic peptide
GTSSLQS

SEQ ID NO: 8847 - DNA, 21 bp, Artificial Sequence
  Description of Artificial Sequence: Synthetic oligonucleotide
gctgcatccagtttgcaaagt

SEQ ID NO: 8848 - protein, 7 aa, Artificial Sequence
  Description of Artificial Sequence: Synthetic peptide
AASSLQS

SEQ ID NO: 8849 - DNA, 21 bp, Artificial Sequence
  Description of Artificial Sequence: Synthetic oligonucleotide
gatgcatccactttggaaaca

SEQ ID NO: 8850 - protein, 7 aa, Artificial Sequence
  Description of Artificial Sequence: Synthetic peptide
DASTLET

SEQ ID NO: 8851 - DNA, 21 bp, Artificial Sequence
  Description of Artificial Sequence: Synthetic oligonucleotide
gctgcatccagtgtgcagagt

SEQ ID NO: 8852 - protein, 7 aa, Artificial Sequence
  Description of Artificial Sequence: Synthetic peptide
AASSVQS

SEQ ID NO: 8853 - DNA, 21 bp, Artificial Sequence
  Description of Artificial Sequence: Synthetic oligonucleotide
actgcatccagtttgcaaagt

SEQ ID NO: 8854 - protein, 7 aa, Artificial Sequence
  Description of Artificial Sequence: Synthetic peptide
TASSLQS

SEQ ID NO: 8855 - DNA, 21 bp, Artificial Sequence
  Description of Artificial Sequence: Synthetic oligonucleotide
gctgcatccagtttgcaaagt

SEQ ID NO: 8856 - protein, 7 aa, Artificial Sequence
  Description of Artificial Sequence: Synthetic peptide
AASSLQS

SEQ ID NO: 8857 - DNA, 21 bp, Artificial Sequence
  Description of Artificial Sequence: Synthetic oligonucleotide
gctacatccagtttgcaaagt

SEQ ID NO: 8858 - protein, 7 aa, Artificial Sequence
  Description of Artificial Sequence: Synthetic peptide
ATSSLQS

SEQ ID NO: 8859 - DNA, 21 bp, Artificial Sequence
  Description of Artificial Sequence: Synthetic oligonucleotide
gctgcatccagtttacaaagt

SEQ ID NO: 8860 - protein, 7 aa, Artificial Sequence
  Description of Artificial Sequence: Synthetic peptide
AASSLQS

SEQ ID NO: 8861 - DNA, 21 bp, Artificial Sequence
  Description of Artificial Sequence: Synthetic oligonucleotide
gttacatccagtttgcacagt

SEQ ID NO: 8862 - protein, 7 aa, Artificial Sequence
  Description of Artificial Sequence: Synthetic peptide
VTSSLHS

SEQ ID NO: 8863 - DNA, 21 bp, Artificial Sequence
  Description of Artificial Sequence: Synthetic oligonucleotide
ggtgcatccaccagggccact

SEQ ID NO: 8864 - protein, 7 aa, Artificial Sequence
  Description of Artificial Sequence: Synthetic peptide
GASTRAT

SEQ ID NO: 8865 - DNA, 21 bp, Artificial Sequence
  Description of Artificial Sequence: Synthetic oligonucleotide
gctgcatccagtttgcaaagt

SEQ ID NO: 8866 - protein, 7 aa, Artificial Sequence
  Description of Artificial Sequence: Synthetic peptide
AASSLQS

SEQ ID NO: 8867 - DNA, 21 bp, Artificial Sequence
  Description of Artificial Sequence: Synthetic oligonucleotide
gatgcatccaatttggaaaca

SEQ ID NO: 8868 - protein, 7 aa, Artificial Sequence
  Description of Artificial Sequence: Synthetic peptide
DASNLET

SEQ ID NO: 8869 - DNA, 21 bp, Artificial Sequence
  Description of Artificial Sequence: Synthetic oligonucleotide
gatgcatccaatttggaaaca

SEQ ID NO: 8870 - protein, 7 aa, Artificial Sequence
  Description of Artificial Sequence: Synthetic peptide
DASNLET

SEQ ID NO: 8871 - DNA, 21 bp, Artificial Sequence
  Description of Artificial Sequence: Synthetic oligonucleotide
gctgcatccagtgtgcagagt

SEQ ID NO: 8872 - protein, 7 aa, Artificial Sequence
  Description of Artificial Sequence: Synthetic peptide
AASSVQS

SEQ ID NO: 8873 - DNA, 21 bp, Artificial Sequence
  Description of Artificial Sequence: Synthetic oligonucleotide
gctgcatccagtttgcacagt

SEQ ID NO: 8874 - protein, 7 aa, Artificial Sequence
  Description of Artificial Sequence: Synthetic peptide
AASSLHS

SEQ ID NO: 8875 - DNA, 21 bp, Artificial Sequence
  Description of Artificial Sequence: Synthetic oligonucleotide
actgcatccagtttacaaagt

SEQ ID NO: 8876 - protein, 7 aa, Artificial Sequence
  Description of Artificial Sequence: Synthetic peptide
TASSLQS

SEQ ID NO: 8877 - DNA, 21 bp, Artificial Sequence
  Description of Artificial Sequence: Synthetic oligonucleotide
gctgcatccagtttacaaagt

SEQ ID NO: 8878 - protein, 7 aa, Artificial Sequence
  Description of Artificial Sequence: Synthetic peptide
AASSLQS

SEQ ID NO: 8879 - DNA, 21 bp, Artificial Sequence
  Description of Artificial Sequence: Synthetic oligonucleotide
actgcatccagtttgcaaagt

SEQ ID NO: 8880 - protein, 7 aa, Artificial Sequence
  Description of Artificial Sequence: Synthetic peptide
TASSLQS

SEQ ID NO: 8881 - DNA, 21 bp, Artificial Sequence
  Description of Artificial Sequence: Synthetic oligonucleotide
gctgcatccagtttgcaaagt

SEQ ID NO: 8882 - protein, 7 aa, Artificial Sequence
  Description of Artificial Sequence: Synthetic peptide
AASSLQS

SEQ ID NO: 8883 - DNA, 21 bp, Artificial Sequence
  Description of Artificial Sequence: Synthetic oligonucleotide
actgcatccagtttgcaaagt

SEQ ID NO: 8884 - protein, 7 aa, Artificial Sequence
  Description of Artificial Sequence: Synthetic peptide
TASSLQS

SEQ ID NO: 8885 - DNA, 21 bp, Artificial Sequence
  Description of Artificial Sequence: Synthetic oligonucleotide
actgcatccagtttgcaaagt

SEQ ID NO: 8886 - protein, 7 aa, Artificial Sequence
  Description of Artificial Sequence: Synthetic peptide
TASSLQS

SEQ ID NO: 8887 - DNA, 21 bp, Artificial Sequence
  Description of Artificial Sequence: Synthetic oligonucleotide
gctgcatccagtttgcaaagt

SEQ ID NO: 8888 - protein, 7 aa, Artificial Sequence
  Description of Artificial Sequence: Synthetic peptide
AASSLQS

SEQ ID NO: 8889 - DNA, 21 bp, Artificial Sequence
  Description of Artificial Sequence: Synthetic oligonucleotide
gctgcatccagtttgcaaaat

SEQ ID NO: 8890 - protein, 7 aa, Artificial Sequence
  Description of Artificial Sequence: Synthetic peptide
AASSLQN

SEQ ID NO: 8891 - DNA, 21 bp, Artificial Sequence
  Description of Artificial Sequence: Synthetic oligonucleotide
gctgcatccagtttgcaaagt

SEQ ID NO: 8892 - protein, 7 aa, Artificial Sequence
  Description of Artificial Sequence: Synthetic peptide
AASSLQS

SEQ ID NO: 8893 - DNA, 21 bp, Artificial Sequence
  Description of Artificial Sequence: Synthetic oligonucleotide
tgggcatctacccgggaatcc

SEQ ID NO: 8894 - protein, 7 aa, Artificial Sequence
  Description of Artificial Sequence: Synthetic peptide
WASTRES

SEQ ID NO: 8895 - DNA, 21 bp, Artificial Sequence
  Description of Artificial Sequence: Synthetic oligonucleotide
gctgcatccagtttgcaaagt

SEQ ID NO: 8896 - protein, 7 aa, Artificial Sequence
  Description of Artificial Sequence: Synthetic peptide
AASSLQS

SEQ ID NO: 8897 - DNA, 21 bp, Artificial Sequence
  Description of Artificial Sequence: Synthetic oligonucleotide
gctgcatccagtttgcaaagt

SEQ ID NO: 8898 - protein, 7 aa, Artificial Sequence
  Description of Artificial Sequence: Synthetic peptide
AASSLQS

SEQ ID NO: 8899 - DNA, 21 bp, Artificial Sequence
  Description of Artificial Sequence: Synthetic oligonucleotide
gctgcatccagtttgcaaagt

SEQ ID NO: 8900 - protein, 7 aa, Artificial Sequence
  Description of Artificial Sequence: Synthetic peptide
AASSLQS

SEQ ID NO: 8901 - DNA, 21 bp, Artificial Sequence
  Description of Artificial Sequence: Synthetic oligonucleotide
caagataggaagcggccctca

SEQ ID NO: 8902 - protein, 7 aa, Artificial Sequence
  Description of Artificial Sequence: Synthetic peptide
QDRKRPS

SEQ ID NO: 8903 - DNA, 21 bp, Artificial Sequence
  Description of Artificial Sequence: Synthetic oligonucleotide
gttgcatccagtttgcaaact

SEQ ID NO: 8904 - protein, 7 aa, Artificial Sequence
  Description of Artificial Sequence: Synthetic peptide
VASSLQT

SEQ ID NO: 8905 - DNA, 21 bp, Artificial Sequence
  Description of Artificial Sequence: Synthetic oligonucleotide
ggtgcatccagtttgcaaagt

SEQ ID NO: 8906 - protein, 7 aa, Artificial Sequence
  Description of Artificial Sequence: Synthetic peptide
GASSLQS

SEQ ID NO: 8907 - DNA, 21 bp, Artificial Sequence
  Description of Artificial Sequence: Synthetic oligonucleotide
gatacaaccagtttgcaaagt

SEQ ID NO: 8908 - protein, 7 aa, Artificial Sequence
  Description of Artificial Sequence: Synthetic peptide
DTTSLQS

SEQ ID NO: 8909 - DNA, 21 bp, Artificial Sequence
  Description of Artificial Sequence: Synthetic oligonucleotide
gctgcatccagtttgcaaagt

SEQ ID NO: 8910 - protein, 7 aa, Artificial Sequence
  Description of Artificial Sequence: Synthetic peptide
AASSLQS

SEQ ID NO: 8911 - DNA, 21 bp, Artificial Sequence
  Description of Artificial Sequence: Synthetic oligonucleotide
actgcatccagtttgcaaagt

SEQ ID NO: 8912 - protein, 7 aa, Artificial Sequence
  Description of Artificial Sequence: Synthetic peptide
TASSLQS

SEQ ID NO: 8913 - DNA, 21 bp, Artificial Sequence
  Description of Artificial Sequence: Synthetic oligonucleotide
gctgcatccagtttgcaaagt

SEQ ID NO: 8914 - protein, 7 aa, Artificial Sequence
  Description of Artificial Sequence: Synthetic peptide
AASSLQS

SEQ ID NO: 8915 - DNA, 21 bp, Artificial Sequence
  Description of Artificial Sequence: Synthetic oligonucleotide
actgcatccaatttgcaaact

SEQ ID NO: 8916 - protein, 7 aa, Artificial Sequence
  Description of Artificial Sequence: Synthetic peptide
TASNLQT

SEQ ID NO: 8917 - DNA, 21 bp, Artificial Sequence
  Description of Artificial Sequence: Synthetic oligonucleotide
gctgcatccagtttgcaaagt

SEQ ID NO: 8918 - protein, 7 aa, Artificial Sequence
  Description of Artificial Sequence: Synthetic peptide
AASSLQS

SEQ ID NO: 8919 - DNA, 21 bp, Artificial Sequence
  Description of Artificial Sequence: Synthetic oligonucleotide
gctgcatccagtttgcaaagt

SEQ ID NO: 8920 - protein, 7 aa, Artificial Sequence
  Description of Artificial Sequence: Synthetic peptide
AASSLQS

SEQ ID NO: 8921 - DNA, 21 bp, Artificial Sequence
  Description of Artificial Sequence: Synthetic oligonucleotide
gctgcatccagtttgcaaagt

SEQ ID NO: 8922 - protein, 7 aa, Artificial Sequence
  Description of Artificial Sequence: Synthetic peptide
AASSLQS

SEQ ID NO: 8923 - DNA, 21 bp, Artificial Sequence
  Description of Artificial Sequence: Synthetic oligonucleotide
gctgcatccagtttgcaaagt

SEQ ID NO: 8924 - protein, 7 aa, Artificial Sequence
  Description of Artificial Sequence: Synthetic peptide
AASSLQS

SEQ ID NO: 8925 - DNA, 21 bp, Artificial Sequence
  Description of Artificial Sequence: Synthetic oligonucleotide
actgcatccagtttgcaaagt

SEQ ID NO: 8926 - protein, 7 aa, Artificial Sequence
  Description of Artificial Sequence: Synthetic peptide
TASSLQS

SEQ ID NO: 8927 - DNA, 21 bp, Artificial Sequence
  Description of Artificial Sequence: Synthetic oligonucleotide
gctgcatccagtttgcacagt

SEQ ID NO: 8928 - protein, 7 aa, Artificial Sequence
  Description of Artificial Sequence: Synthetic peptide
AASSLHS

SEQ ID NO: 8929 - DNA, 21 bp, Artificial Sequence
  Description of Artificial Sequence: Synthetic oligonucleotide
gctgcatccagtttgcaaagt

SEQ ID NO: 8930 - protein, 7 aa, Artificial Sequence
  Description of Artificial Sequence: Synthetic peptide
AASSLQS

SEQ ID NO: 8931 - DNA, 21 bp, Artificial Sequence
  Description of Artificial Sequence: Synthetic oligonucleotide
gctgcatccagtttggaaagt

SEQ ID NO: 8932 - protein, 7 aa, Artificial Sequence
  Description of Artificial Sequence: Synthetic peptide
AASSLES

SEQ ID NO: 8933 - DNA, 21 bp, Artificial Sequence
  Description of Artificial Sequence: Synthetic oligonucleotide
gctgcatccagtttgcaaagt

SEQ ID NO: 8934 - protein, 7 aa, Artificial Sequence
  Description of Artificial Sequence: Synthetic peptide
AASSLQS

SEQ ID NO: 8935 - DNA, 21 bp, Artificial Sequence
  Description of Artificial Sequence: Synthetic oligonucleotide
gctgcatccagtttgcaaagt

SEQ ID NO: 8936 - protein, 7 aa, Artificial Sequence
  Description of Artificial Sequence: Synthetic peptide
AASSLQS

SEQ ID NO: 8937 - DNA, 21 bp, Artificial Sequence
  Description of Artificial Sequence: Synthetic oligonucleotide
gttgcatccagtttgcaaagt

SEQ ID NO: 8938 - protein, 7 aa, Artificial Sequence
  Description of Artificial Sequence: Synthetic peptide
VASSLQS

SEQ ID NO: 8939 - DNA, 21 bp, Artificial Sequence
  Description of Artificial Sequence: Synthetic oligonucleotide
gctgcatccagtttgcaaagt

SEQ ID NO: 8940 - protein, 7 aa, Artificial Sequence
  Description of Artificial Sequence: Synthetic peptide
AASSLQS

SEQ ID NO: 8941 - DNA, 21 bp, Artificial Sequence
  Description of Artificial Sequence: Synthetic oligonucleotide
gttgcatccagtttgcaaagt

SEQ ID NO: 8942 - protein, 7 aa, Artificial Sequence
  Description of Artificial Sequence: Synthetic peptide
VASSLQS

SEQ ID NO: 8943 - DNA, 21 bp, Artificial Sequence
  Description of Artificial Sequence: Synthetic oligonucleotide
gctgcatccagtttgcaaagt

SEQ ID NO: 8944 - protein, 7 aa, Artificial Sequence
  Description of Artificial Sequence: Synthetic peptide
AASSLQS

SEQ ID NO: 8945 - DNA, 21 bp, Artificial Sequence
  Description of Artificial Sequence: Synthetic oligonucleotide
gctgcatccagtttgcaaagt

SEQ ID NO: 8946 - protein, 7 aa, Artificial Sequence
  Description of Artificial Sequence: Synthetic peptide
AASSLQS

SEQ ID NO: 8947 - DNA, 21 bp, Artificial Sequence
  Description of Artificial Sequence: Synthetic oligonucleotide
actgcatccagtttgcaaagt

SEQ ID NO: 8948 - protein, 7 aa, Artificial Sequence
  Description of Artificial Sequence: Synthetic peptide
TASSLQS

SEQ ID NO: 8949 - DNA, 21 bp, Artificial Sequence
  Description of Artificial Sequence: Synthetic oligonucleotide
gatgcatccaatttggaaaca

SEQ ID NO: 8950 - protein, 7 aa, Artificial Sequence
  Description of Artificial Sequence: Synthetic peptide
DASNLET

SEQ ID NO: 8951 - DNA, 21 bp, Artificial Sequence
  Description of Artificial Sequence: Synthetic oligonucleotide
gctgcatccagtttgcaaagt

SEQ ID NO: 8952 - protein, 7 aa, Artificial Sequence
  Description of Artificial Sequence: Synthetic peptide
AASSLQS

SEQ ID NO: 8953 - DNA, 21 bp, Artificial Sequence
  Description of Artificial Sequence: Synthetic oligonucleotide
gatggatccaatttggaaaca

SEQ ID NO: 8954 - protein, 7 aa, Artificial Sequence
  Description of Artificial Sequence: Synthetic peptide
DGSNLET

SEQ ID NO: 8955 - DNA, 21 bp, Artificial Sequence
  Description of Artificial Sequence: Synthetic oligonucleotide
gatgcatccaatttggaaaca

SEQ ID NO: 8956 - protein, 7 aa, Artificial Sequence
  Description of Artificial Sequence: Synthetic peptide
DASNLET

SEQ ID NO: 8957 - DNA, 21 bp, Artificial Sequence
  Description of Artificial Sequence: Synthetic oligonucleotide
gctgcatccagtttgcaaagt

SEQ ID NO: 8958 - protein, 7 aa, Artificial Sequence
  Description of Artificial Sequence: Synthetic peptide
AASSLQS

SEQ ID NO: 8959 - DNA, 21 bp, Artificial Sequence
  Description of Artificial Sequence: Synthetic oligonucleotide
gctgcatacattttgcaatca

SEQ ID NO: 8960 - protein, 7 aa, Artificial Sequence
  Description of Artificial Sequence: Synthetic peptide
AAYILQS

SEQ ID NO: 8961 - DNA, 21 bp, Artificial Sequence
  Description of Artificial Sequence: Synthetic oligonucleotide
actgcatccagtttgcaaagt

SEQ ID NO: 8962 - protein, 7 aa, Artificial Sequence
  Description of Artificial Sequence: Synthetic peptide
TASSLQS

SEQ ID NO: 8963 - DNA, 21 bp, Artificial Sequence
  Description of Artificial Sequence: Synthetic oligonucleotide
gctgcatccagtttgcaaagt

SEQ ID NO: 8964 - protein, 7 aa, Artificial Sequence
  Description of Artificial Sequence: Synthetic peptide
AASSLQS

SEQ ID NO: 8965 - DNA, 21 bp, Artificial Sequence
  Description of Artificial Sequence: Synthetic oligonucleotide
actgcatccagtttgcaaaat

SEQ ID NO: 8966 - protein, 7 aa, Artificial Sequence
  Description of Artificial Sequence: Synthetic peptide
TASSLQN

SEQ ID NO: 8967 - DNA, 21 bp, Artificial Sequence
  Description of Artificial Sequence: Synthetic oligonucleotide
gctgcatccagtttgcaaagt

SEQ ID NO: 8968 - protein, 7 aa, Artificial Sequence
  Description of Artificial Sequence: Synthetic peptide
AASSLQS

SEQ ID NO: 8969 - DNA, 21 bp, Artificial Sequence
  Description of Artificial Sequence: Synthetic oligonucleotide
gctgcatccagtttgcaaagt

SEQ ID NO: 8970 - protein, 7 aa, Artificial Sequence
  Description of Artificial Sequence: Synthetic peptide
AASSLQS

SEQ ID NO: 8971 - DNA, 21 bp, Artificial Sequence
  Description of Artificial Sequence: Synthetic oligonucleotide
gctgcatccagtttgcaaagt

SEQ ID NO: 8972 - protein, 7 aa, Artificial Sequence
  Description of Artificial Sequence: Synthetic peptide
AASSLQS

SEQ ID NO: 8973 - DNA, 21 bp, Artificial Sequence
  Description of Artificial Sequence: Synthetic oligonucleotide
gctgcatccagtttgcaaagt

SEQ ID NO: 8974 - protein, 7 aa, Artificial Sequence
  Description of Artificial Sequence: Synthetic peptide
AASSLQS

SEQ ID NO: 8975 - DNA, 21 bp, Artificial Sequence
  Description of Artificial Sequence: Synthetic oligonucleotide
gctgcatccagtttgcaaagt

SEQ ID NO: 8976 - protein, 7 aa, Artificial Sequence
  Description of Artificial Sequence: Synthetic peptide
AASSLQS

SEQ ID NO: 8977 - DNA, 21 bp, Artificial Sequence
  Description of Artificial Sequence: Synthetic oligonucleotide
gatgcatccaatttggaaaca

SEQ ID NO: 8978 - protein, 7 aa, Artificial Sequence
  Description of Artificial Sequence: Synthetic peptide
DASNLET

SEQ ID NO: 8979 - DNA, 21 bp, Artificial Sequence
  Description of Artificial Sequence: Synthetic oligonucleotide
gctgcctccagtttgcaaagt

SEQ ID NO: 8980 - protein, 7 aa, Artificial Sequence
  Description of Artificial Sequence: Synthetic peptide
AASSLQS

SEQ ID NO: 8981 - DNA, 21 bp, Artificial Sequence
  Description of Artificial Sequence: Synthetic oligonucleotide
gatgcatccaatttggaaaca

SEQ ID NO: 8982 - protein, 7 aa, Artificial Sequence
  Description of Artificial Sequence: Synthetic peptide
DASNLET

SEQ ID NO: 8983 - DNA, 21 bp, Artificial Sequence
  Description of Artificial Sequence: Synthetic oligonucleotide
gctgcgtccagtgtgcaaact

SEQ ID NO: 8984 - protein, 7 aa, Artificial Sequence
  Description of Artificial Sequence: Synthetic peptide
AASSVQT

SEQ ID NO: 8985 - DNA, 21 bp, Artificial Sequence
  Description of Artificial Sequence: Synthetic oligonucleotide
gctgcatccagtttgcaaagt

SEQ ID NO: 8986 - protein, 7 aa, Artificial Sequence
  Description of Artificial Sequence: Synthetic peptide
AASSLQS

SEQ ID NO: 8987 - DNA, 21 bp, Artificial Sequence
  Description of Artificial Sequence: Synthetic oligonucleotide
gctacatccagtttgcaaaat

SEQ ID NO: 8988 - protein, 7 aa, Artificial Sequence
  Description of Artificial Sequence: Synthetic peptide
ATSSLQN

SEQ ID NO: 8989 - DNA, 21 bp, Artificial Sequence
  Description of Artificial Sequence: Synthetic oligonucleotide
gctgcatccagtgtgcaaagt

SEQ ID NO: 8990 - protein, 7 aa, Artificial Sequence
  Description of Artificial Sequence: Synthetic peptide
AASSVQS

SEQ ID NO: 8991 - DNA, 21 bp, Artificial Sequence
  Description of Artificial Sequence: Synthetic oligonucleotide
gatgcatccaatttggaaaca

SEQ ID NO: 8992 - protein, 7 aa, Artificial Sequence
  Description of Artificial Sequence: Synthetic peptide
DASNLET

SEQ ID NO: 8993 - DNA, 21 bp, Artificial Sequence
  Description of Artificial Sequence: Synthetic oligonucleotide
gctgcatccagtttgcaaact

SEQ ID NO: 8994 - protein, 7 aa, Artificial Sequence
  Description of Artificial Sequence: Synthetic peptide
AASSLQT

SEQ ID NO: 8995 - DNA, 21 bp, Artificial Sequence
  Description of Artificial Sequence: Synthetic oligonucleotide
ggtgcatccagtttgcaaagt

SEQ ID NO: 8996 - protein, 7 aa, Artificial Sequence
  Description of Artificial Sequence: Synthetic peptide
GASSLQS

SEQ ID NO: 8997 - DNA, 21 bp, Artificial Sequence
  Description of Artificial Sequence: Synthetic oligonucleotide
gctgcatccagtttacaaagt

SEQ ID NO: 8998 - protein, 7 aa, Artificial Sequence
  Description of Artificial Sequence: Synthetic peptide
AASSLQS

SEQ ID NO: 8999 - DNA, 21 bp, Artificial Sequence
  Description of Artificial Sequence: Synthetic oligonucleotide
gttgcatccagtttgcaaagt

SEQ ID NO: 9000 - protein, 7 aa, Artificial Sequence
  Description of Artificial Sequence: Synthetic peptide
VASSLQS

SEQ ID NO: 9001 - DNA, 21 bp, Artificial Sequence
  Description of Artificial Sequence: Synthetic oligonucleotide
actgcatccagtttgcaaagt

SEQ ID NO: 9002 - protein, 7 aa, Artificial Sequence
  Description of Artificial Sequence: Synthetic peptide
TASSLQS

SEQ ID NO: 9003 - DNA, 21 bp, Artificial Sequence
  Description of Artificial Sequence: Synthetic oligonucleotide
gctgcatccagtttgcaaagt

SEQ ID NO: 9004 - protein, 7 aa, Artificial Sequence
  Description of Artificial Sequence: Synthetic peptide
AASSLQS

SEQ ID NO: 9005 - DNA, 21 bp, Artificial Sequence
  Description of Artificial Sequence: Synthetic oligonucleotide
ttgggttctaatcgggcctcc

SEQ ID NO: 9006 - protein, 7 aa, Artificial Sequence
  Description of Artificial Sequence: Synthetic peptide
LGSNRAS

SEQ ID NO: 9007 - DNA, 21 bp, Artificial Sequence
  Description of Artificial Sequence: Synthetic oligonucleotide
gctgcgtccagtttgcaaagt

SEQ ID NO: 9008 - protein, 7 aa, Artificial Sequence
  Description of Artificial Sequence: Synthetic peptide
AASSLQS

SEQ ID NO: 9009 - DNA, 21 bp, Artificial Sequence
  Description of Artificial Sequence: Synthetic oligonucleotide
tgggcatctacccgggaatcc

SEQ ID NO: 9010 - protein, 7 aa, Artificial Sequence
  Description of Artificial Sequence: Synthetic peptide
WASTRES

SEQ ID NO: 9011 - DNA, 21 bp, Artificial Sequence
  Description of Artificial Sequence: Synthetic oligonucleotide
gctgcatccagtttgcaaagt

SEQ ID NO: 9012 - protein, 7 aa, Artificial Sequence
  Description of Artificial Sequence: Synthetic peptide
AASSLQS

SEQ ID NO: 9013 - DNA, 21 bp, Artificial Sequence
  Description of Artificial Sequence: Synthetic oligonucleotide
gctgcatccagtttgcaaaat

SEQ ID NO: 9014 - protein, 7 aa, Artificial Sequence
  Description of Artificial Sequence: Synthetic peptide
AASSLQN

SEQ ID NO: 9015 - DNA, 21 bp, Artificial Sequence
  Description of Artificial Sequence: Synthetic oligonucleotide
ttgggttctaatcgggcctcc

SEQ ID NO: 9016 - protein, 7 aa, Artificial Sequence
  Description of Artificial Sequence: Synthetic peptide
LGSNRAS

SEQ ID NO: 9017 - DNA, 21 bp, Artificial Sequence
  Description of Artificial Sequence: Synthetic oligonucleotide
gctgcatccagtttgcaaagt

SEQ ID NO: 9018 - protein, 7 aa, Artificial Sequence
  Description of Artificial Sequence: Synthetic peptide
AASSLQS

SEQ ID NO: 9019 - DNA, 21 bp, Artificial Sequence
  Description of Artificial Sequence: Synthetic oligonucleotide
gctgcatccagtttgcaaagt

SEQ ID NO: 9020 - protein, 7 aa, Artificial Sequence
  Description of Artificial Sequence: Synthetic peptide
AASSLQS

SEQ ID NO: 9021 - DNA, 21 bp, Artificial Sequence
  Description of Artificial Sequence: Synthetic oligonucleotide
gctgcatccagtttacaaagt

SEQ ID NO: 9022 - protein, 7 aa, Artificial Sequence
  Description of Artificial Sequence: Synthetic peptide
AASSLQS

SEQ ID NO: 9023 - DNA, 21 bp, Artificial Sequence
  Description of Artificial Sequence: Synthetic oligonucleotide
gctgcatccagtgtgcaaagt

SEQ ID NO: 9024 - protein, 7 aa, Artificial Sequence
  Description of Artificial Sequence: Synthetic peptide
AASSVQS

SEQ ID NO: 9025 - DNA, 21 bp, Artificial Sequence
  Description of Artificial Sequence: Synthetic oligonucleotide
gatgcatccaatttggaaaca

SEQ ID NO: 9026 - protein, 7 aa, Artificial Sequence
  Description of Artificial Sequence: Synthetic peptide
DASNLET

SEQ ID NO: 9027 - DNA, 21 bp, Artificial Sequence
  Description of Artificial Sequence: Synthetic oligonucleotide
actacatccagtttgcaaagt

SEQ ID NO: 9028 - protein, 7 aa, Artificial Sequence
  Description of Artificial Sequence: Synthetic peptide
TTSSLQS

SEQ ID NO: 9029 - DNA, 21 bp, Artificial Sequence
  Description of Artificial Sequence: Synthetic oligonucleotide
tgggcatctacccggaaatcc

SEQ ID NO: 9030 - protein, 7 aa, Artificial Sequence
  Description of Artificial Sequence: Synthetic peptide
WASTRKS

SEQ ID NO: 9031 - DNA, 21 bp, Artificial Sequence
  Description of Artificial Sequence: Synthetic oligonucleotide
gctgcatccagtttgcaaagt

SEQ ID NO: 9032 - protein, 7 aa, Artificial Sequence
  Description of Artificial Sequence: Synthetic peptide
AASSLQS

SEQ ID NO: 9033 - DNA, 21 bp, Artificial Sequence
  Description of Artificial Sequence: Synthetic oligonucleotide
gctgcatccagtttgcaaagt

SEQ ID NO: 9034 - protein, 7 aa, Artificial Sequence
  Description of Artificial Sequence: Synthetic peptide
AASSLQS

SEQ ID NO: 9035 - DNA, 21 bp, Artificial Sequence
  Description of Artificial Sequence: Synthetic oligonucleotide
gctgcatccagtttacaaagt

SEQ ID NO: 9036 - protein, 7 aa, Artificial Sequence
  Description of Artificial Sequence: Synthetic peptide
AASSLQS

SEQ ID NO: 9037 - DNA, 21 bp, Artificial Sequence
  Description of Artificial Sequence: Synthetic oligonucleotide
gctgcatccagtttgcaaagt

SEQ ID NO: 9038 - protein, 7 aa, Artificial Sequence
  Description of Artificial Sequence: Synthetic peptide
AASSLQS

SEQ ID NO: 9039 - DNA, 21 bp, Artificial Sequence
  Description of Artificial Sequence: Synthetic oligonucleotide
actgcatccagtttgcaaagt

SEQ ID NO: 9040 - protein, 7 aa, Artificial Sequence
  Description of Artificial Sequence: Synthetic peptide
TASSLQS

SEQ ID NO: 9041 - DNA, 21 bp, Artificial Sequence
  Description of Artificial Sequence: Synthetic oligonucleotide
gctgcatccagtttgcaaagt

SEQ ID NO: 9042 - protein, 7 aa, Artificial Sequence
  Description of Artificial Sequence: Synthetic peptide
AASSLQS

SEQ ID NO: 9043 - DNA, 21 bp, Artificial Sequence
  Description of Artificial Sequence: Synthetic oligonucleotide
caagatagaaagcggccctca

SEQ ID NO: 9044 - protein, 7 aa, Artificial Sequence
  Description of Artificial Sequence: Synthetic peptide
QDRKRPS

SEQ ID NO: 9045 - DNA, 21 bp, Artificial Sequence
  Description of Artificial Sequence: Synthetic oligonucleotide
caagatagcaagcggccctca

SEQ ID NO: 9046 - protein, 7 aa, Artificial Sequence
  Description of Artificial Sequence: Synthetic peptide
QDSKRPS

SEQ ID NO: 9047 - DNA, 21 bp, Artificial Sequence
  Description of Artificial Sequence: Synthetic oligonucleotide
gctgcatccagtttgcacagt

SEQ ID NO: 9048 - protein, 7 aa, Artificial Sequence
  Description of Artificial Sequence: Synthetic peptide
AASSLHS

SEQ ID NO: 9049 - DNA, 21 bp, Artificial Sequence
  Description of Artificial Sequence: Synthetic oligonucleotide
gctgcatccaatttgcaaagt

SEQ ID NO: 9050 - protein, 7 aa, Artificial Sequence
  Description of Artificial Sequence: Synthetic peptide
AASNLQS

SEQ ID NO: 9051 - DNA, 21 bp, Artificial Sequence
  Description of Artificial Sequence: Synthetic oligonucleotide
gctgcatccactttgcaatca

SEQ ID NO: 9052 - protein, 7 aa, Artificial Sequence
  Description of Artificial Sequence: Synthetic peptide
AASTLQS

SEQ ID NO: 9053 - DNA, 21 bp, Artificial Sequence
  Description of Artificial Sequence: Synthetic oligonucleotide
gttgcgtccagtttcccaagt

SEQ ID NO: 9054 - protein, 7 aa, Artificial Sequence
  Description of Artificial Sequence: Synthetic peptide
VASSFPS

SEQ ID NO: 9055 - DNA, 21 bp, Artificial Sequence
  Description of Artificial Sequence: Synthetic oligonucleotide
actgcatccagtttgcaaagt

SEQ ID NO: 9056 - protein, 7 aa, Artificial Sequence
  Description of Artificial Sequence: Synthetic peptide
TASSLQS

SEQ ID NO: 9057 - DNA, 21 bp, Artificial Sequence
  Description of Artificial Sequence: Synthetic oligonucleotide
gctgcatccagtttggaaagt

SEQ ID NO: 9058 - protein, 7 aa, Artificial Sequence
  Description of Artificial Sequence: Synthetic peptide
AASSLES

SEQ ID NO: 9059 - DNA, 21 bp, Artificial Sequence
  Description of Artificial Sequence: Synthetic oligonucleotide
gctacatccaatctccaaagt

SEQ ID NO: 9060 - protein, 7 aa, Artificial Sequence
  Description of Artificial Sequence: Synthetic peptide
ATSNLQS

SEQ ID NO: 9061 - DNA, 21 bp, Artificial Sequence
  Description of Artificial Sequence: Synthetic oligonucleotide
caagatagcaagcggccctca

SEQ ID NO: 9062 - protein, 7 aa, Artificial Sequence
  Description of Artificial Sequence: Synthetic peptide
QDSKRPS

SEQ ID NO: 9063 - DNA, 21 bp, Artificial Sequence
  Description of Artificial Sequence: Synthetic oligonucleotide
caagatagaaagaggccctca

SEQ ID NO: 9064 - protein, 7 aa, Artificial Sequence
  Description of Artificial Sequence: Synthetic peptide
QDRKRPS

SEQ ID NO: 9065 - DNA, 21 bp, Artificial Sequence
  Description of Artificial Sequence: Synthetic oligonucleotide
gctgcatccagtttgcaaact

SEQ ID NO: 9066 - protein, 7 aa, Artificial Sequence
  Description of Artificial Sequence: Synthetic peptide
AASSLQT

SEQ ID NO: 9067 - DNA, 21 bp, Artificial Sequence
  Description of Artificial Sequence: Synthetic oligonucleotide
gaggtcagtaatcggccctca

SEQ ID NO: 9068 - protein, 7 aa, Artificial Sequence
  Description of Artificial Sequence: Synthetic peptide
EVSNRPS

SEQ ID NO: 9069 - DNA, 21 bp, Artificial Sequence
  Description of Artificial Sequence: Synthetic oligonucleotide
tgggcatctacccggaaatcc

SEQ ID NO: 9070 - protein, 7 aa, Artificial Sequence
  Description of Artificial Sequence: Synthetic peptide
WASTRKS

SEQ ID NO: 9071 - DNA, 21 bp, Artificial Sequence
  Description of Artificial Sequence: Synthetic oligonucleotide
caagatagaaagcggccctca

SEQ ID NO: 9072 - protein, 7 aa, Artificial Sequence
  Description of Artificial Sequence: Synthetic peptide
QDRKRPS

SEQ ID NO: 9073 - DNA, 21 bp, Artificial Sequence
  Description of Artificial Sequence: Synthetic oligonucleotide
gctgcatccactttgcaaagt

SEQ ID NO: 9074 - protein, 7 aa, Artificial Sequence
  Description of Artificial Sequence: Synthetic peptide
AASTLQS

SEQ ID NO: 9075 - DNA, 21 bp, Artificial Sequence
  Description of Artificial Sequence: Synthetic oligonucleotide
gctgcatccagtttgcaaagt

SEQ ID NO: 9076 - protein, 7 aa, Artificial Sequence
  Description of Artificial Sequence: Synthetic peptide
AASSLQS

SEQ ID NO: 9077 - DNA, 21 bp, Artificial Sequence
  Description of Artificial Sequence: Synthetic oligonucleotide
caagatagcaagcggccctca

SEQ ID NO: 9078 - protein, 7 aa, Artificial Sequence
  Description of Artificial Sequence: Synthetic peptide
QDSKRPS

SEQ ID NO: 9079 - DNA, 21 bp, Artificial Sequence
  Description of Artificial Sequence: Synthetic oligonucleotide
tgggcatctacccgggaatcc

SEQ ID NO: 9080 - protein, 7 aa, Artificial Sequence
  Description of Artificial Sequence: Synthetic peptide
WASTRES

SEQ ID NO: 9081 - DNA, 21 bp, Artificial Sequence
  Description of Artificial Sequence: Synthetic oligonucleotide
aaggtttctaactgggactct

SEQ ID NO: 9082 - protein, 7 aa, Artificial Sequence
  Description of Artificial Sequence: Synthetic peptide
KVSNWDS

SEQ ID NO: 9083 - DNA, 21 bp, Artificial Sequence
  Description of Artificial Sequence: Synthetic oligonucleotide
tgggcatctacccgggaatcc

SEQ ID NO: 9084 - protein, 7 aa, Artificial Sequence
  Description of Artificial Sequence: Synthetic peptide
WASTRES

SEQ ID NO: 9085 - DNA, 21 bp, Artificial Sequence
  Description of Artificial Sequence: Synthetic oligonucleotide
tgggcatctacccgggagtcc

SEQ ID NO: 9086 - protein, 7 aa, Artificial Sequence
  Description of Artificial Sequence: Synthetic peptide
WASTRES

SEQ ID NO: 9087 - DNA, 21 bp, Artificial Sequence
  Description of Artificial Sequence: Synthetic oligonucleotide
tgggcatctacccgggaatcc

SEQ ID NO: 9088 - protein, 7 aa, Artificial Sequence
  Description of Artificial Sequence: Synthetic peptide
WASTRES

SEQ ID NO: 9089 - DNA, 21 bp, Artificial Sequence
  Description of Artificial Sequence: Synthetic oligonucleotide
gctgcatccagtttgcagagt

SEQ ID NO: 9090 - protein, 7 aa, Artificial Sequence
  Description of Artificial Sequence: Synthetic peptide
AASSLQS

SEQ ID NO: 9091 - DNA, 21 bp, Artificial Sequence
  Description of Artificial Sequence: Synthetic oligonucleotide
tgggcatctacccggaaatcc

SEQ ID NO: 9092 - protein, 7 aa, Artificial Sequence
  Description of Artificial Sequence: Synthetic peptide
WASTRKS

SEQ ID NO: 9093 - DNA, 21 bp, Artificial Sequence
  Description of Artificial Sequence: Synthetic oligonucleotide
tgggcatctacccgggaatcc

SEQ ID NO: 9094 - protein, 7 aa, Artificial Sequence
  Description of Artificial Sequence: Synthetic peptide
WASTRES

SEQ ID NO: 9095 - DNA, 21 bp, Artificial Sequence
  Description of Artificial Sequence: Synthetic oligonucleotide
gctgcatccagtttacaaagt

SEQ ID NO: 9096 - protein, 7 aa, Artificial Sequence
  Description of Artificial Sequence: Synthetic peptide
AASSLQS

SEQ ID NO: 9097 - DNA, 21 bp, Artificial Sequence
  Description of Artificial Sequence: Synthetic oligonucleotide
gctgcatccagtttgcaaagt

SEQ ID NO: 9098 - protein, 7 aa, Artificial Sequence
  Description of Artificial Sequence: Synthetic peptide
AASSLQS

SEQ ID NO: 9099 - DNA, 21 bp, Artificial Sequence
  Description of Artificial Sequence: Synthetic oligonucleotide
aaggtttctaactgggactct

SEQ ID NO: 9100 - protein, 7 aa, Artificial Sequence
  Description of Artificial Sequence: Synthetic peptide
KVSNWDS

SEQ ID NO: 9101 - DNA, 21 bp, Artificial Sequence
  Description of Artificial Sequence: Synthetic oligonucleotide
gctgcatctagtttgcaaagt

SEQ ID NO: 9102 - protein, 7 aa, Artificial Sequence
  Description of Artificial Sequence: Synthetic peptide
AASSLQS

SEQ ID NO: 9103 - DNA, 21 bp, Artificial Sequence
  Description of Artificial Sequence: Synthetic oligonucleotide
gctgcatccagtttgcaaagt

SEQ ID NO: 9104 - protein, 7 aa, Artificial Sequence
  Description of Artificial Sequence: Synthetic peptide
AASSLQS

SEQ ID NO: 9105 - DNA, 21 bp, Artificial Sequence
  Description of Artificial Sequence: Synthetic oligonucleotide
agtgcatccagtttgcaaagt

SEQ ID NO: 9106 - protein, 7 aa, Artificial Sequence
  Description of Artificial Sequence: Synthetic peptide
SASSLQS

SEQ ID NO: 9107 - DNA, 21 bp, Artificial Sequence
  Description of Artificial Sequence: Synthetic oligonucleotide
tgggcatctacccggaaatcc

SEQ ID NO: 9108 - protein, 7 aa, Artificial Sequence
  Description of Artificial Sequence: Synthetic peptide
WASTRKS

SEQ ID NO: 9109 - DNA, 21 bp, Artificial Sequence
  Description of Artificial Sequence: Synthetic oligonucleotide
gctacatccagtttgcaaagt

SEQ ID NO: 9110 - protein, 7 aa, Artificial Sequence
  Description of Artificial Sequence: Synthetic peptide
ATSSLQS

SEQ ID NO: 9111 - DNA, 33 bp, Artificial Sequence; identical to SEQ ID NO: 8207
  Description of Artificial Sequence: Synthetic oligonucleotide

SEQ ID NO: 9112 - protein, 11 aa, Artificial Sequence
  Description of Artificial Sequence: Synthetic peptide
VKSDGSHSKGD

SEQ ID NO: 9113 - DNA, 21 bp, Artificial Sequence
  Description of Artificial Sequence: Synthetic oligonucleotide
caagatagcaagcggccctca

SEQ ID NO: 9114 - protein, 7 aa, Artificial Sequence
  Description of Artificial Sequence: Synthetic peptide
QDSKRPS

SEQ ID NO: 9115 - DNA, 21 bp, Artificial Sequence
  Description of Artificial Sequence: Synthetic oligonucleotide
gctgcatccagtttgcaaagt

SEQ ID NO: 9116 - protein, 7 aa, Artificial Sequence
  Description of Artificial Sequence: Synthetic peptide
AASSLQS

SEQ ID NO: 9117 - DNA, 21 bp, Artificial Sequence
  Description of Artificial Sequence: Synthetic oligonucleotide
gctgcaaccagtttgcaaagt

SEQ ID NO: 9118 - protein, 7 aa, Artificial Sequence
  Description of Artificial Sequence: Synthetic peptide
AATSLQS

SEQ ID NO: 9119 - DNA, 21 bp, Artificial Sequence
  Description of Artificial Sequence: Synthetic oligonucleotide
gctgcatcccgtttgcaaagt

SEQ ID NO: 9120 - protein, 7 aa, Artificial Sequence
  Description of Artificial Sequence: Synthetic peptide
AASRLQS

SEQ ID NO: 9121 - DNA, 21 bp, Artificial Sequence
  Description of Artificial Sequence: Synthetic oligonucleotide
caagatcgcaagcggccctca

SEQ ID NO: 9122 - protein, 7 aa, Artificial Sequence
  Description of Artificial Sequence: Synthetic peptide
QDRKRPS

SEQ ID NO: 9123 - DNA, 21 bp, Artificial Sequence
  Description of Artificial Sequence: Synthetic oligonucleotide
ggtgcatccagtttgcaaagt

SEQ ID NO: 9124 - protein, 7 aa, Artificial Sequence
  Description of Artificial Sequence: Synthetic peptide
GASSLQS

SEQ ID NO: 9125 - DNA, 21 bp, Artificial Sequence
  Description of Artificial Sequence: Synthetic oligonucleotide
caagataagaagcggccctca

SEQ ID NO: 9126 - protein, 7 aa, Artificial Sequence
  Description of Artificial Sequence: Synthetic peptide
QDKKRPS

SEQ ID NO: 9127 - DNA, 21 bp, Artificial Sequence
  Description of Artificial Sequence: Synthetic oligonucleotide
gctacacccagtttgcagagt

SEQ ID NO: 9128 - protein, 7 aa, Artificial Sequence
  Description of Artificial Sequence: Synthetic peptide
ATPSLQS

SEQ ID NO: 9129 - DNA, 21 bp, Artificial Sequence
  Description of Artificial Sequence: Synthetic oligonucleotide
gctgcatccagtttgcaaagt

SEQ ID NO: 9130 - protein, 7 aa, Artificial Sequence
  Description of Artificial Sequence: Synthetic peptide
AASSLQS

SEQ ID NO: 9131 - DNA, 21 bp, Artificial Sequence
  Description of Artificial Sequence: Synthetic oligonucleotide
gctgcatccagtttgcaaagt

SEQ ID NO: 9132 - protein, 7 aa, Artificial Sequence
  Description of Artificial Sequence: Synthetic peptide
AASSLQS

SEQ ID NO: 9133 - DNA, 21 bp, Artificial Sequence
  Description of Artificial Sequence: Synthetic oligonucleotide
gctacatccagtttgcaaagt

SEQ ID NO: 9134 - protein, 7 aa, Artificial Sequence
  Description of Artificial Sequence: Synthetic peptide
ATSSLQS

SEQ ID NO: 9135 - DNA, 21 bp, Artificial Sequence
  Description of Artificial Sequence: Synthetic oligonucleotide
gctgcatccagtttgcaaagt

SEQ ID NO: 9136 - protein, 7 aa, Artificial Sequence
  Description of Artificial Sequence: Synthetic peptide
AASSLQS

SEQ ID NO: 9137 - DNA, 21 bp, Artificial Sequence
  Description of Artificial Sequence: Synthetic oligonucleotide
gatgcatccagtgtgcaaagt

SEQ ID NO: 9138 - protein, 7 aa, Artificial Sequence
  Description of Artificial Sequence: Synthetic peptide
DASSVQS

SEQ ID NO: 9139 - DNA, 21 bp, Artificial Sequence
  Description of Artificial Sequence: Synthetic oligonucleotide
caagataggaagcggccctca

SEQ ID NO: 9140 - protein, 7 aa, Artificial Sequence
  Description of Artificial Sequence: Synthetic peptide
QDRKRPS

SEQ ID NO: 9141 - DNA, 21 bp, Artificial Sequence
  Description of Artificial Sequence: Synthetic oligonucleotide
tgggcatctacccgggaatcc

SEQ ID NO: 9142 - protein, 7 aa, Artificial Sequence
  Description of Artificial Sequence: Synthetic peptide
WASTRES

SEQ ID NO: 9143 - DNA, 21 bp, Artificial Sequence
  Description of Artificial Sequence: Synthetic oligonucleotide
tgggcatctacccgggaatcc

SEQ ID NO: 9144 - protein, 7 aa, Artificial Sequence
  Description of Artificial Sequence: Synthetic peptide
WASTRES

SEQ ID NO: 9145 - DNA, 21 bp, Artificial Sequence
  Description of Artificial Sequence: Synthetic oligonucleotide
caagataggaagcggccctca

SEQ ID NO: 9146 - protein, 7 aa, Artificial Sequence
  Description of Artificial Sequence: Synthetic peptide
QDRKRPS

SEQ ID NO: 9147 - DNA, 21 bp, Artificial Sequence
  Description of Artificial Sequence: Synthetic oligonucleotide
aaggtttctaattgggactct

SEQ ID NO: 9148 - protein, 7 aa, Artificial Sequence
  Description of Artificial Sequence: Synthetic peptide
KVSNWDS

SEQ ID NO: 9149 - DNA, 21 bp, Artificial Sequence
  Description of Artificial Sequence: Synthetic oligonucleotide
tgggcatctacccgggaatcc

SEQ ID NO: 9150 - protein, 7 aa, Artificial Sequence
  Description of Artificial Sequence: Synthetic peptide
WASTRES

SEQ ID NO: 9151 - DNA, 21 bp, Artificial Sequence
  Description of Artificial Sequence: Synthetic oligonucleotide
tgggcatctacccgggaatcc

SEQ ID NO: 9152 - protein, 7 aa, Artificial Sequence
  Description of Artificial Sequence: Synthetic peptide
WASTRES

SEQ ID NO: 9153 - DNA, 21 bp, Artificial Sequence
  Description of Artificial Sequence: Synthetic oligonucleotide
actgcatccagtttgcaaagt

SEQ ID NO: 9154 - protein, 7 aa, Artificial Sequence
  Description of Artificial Sequence: Synthetic peptide
TASSLQS

SEQ ID NO: 9155 - DNA, 21 bp, Artificial Sequence
  Description of Artificial Sequence: Synthetic oligonucleotide
gctgcatatagtttacaaagt

SEQ ID NO: 9156 - protein, 7 aa, Artificial Sequence
  Description of Artificial Sequence: Synthetic peptide
AAYSLQS

SEQ ID NO: 9157 - DNA, 21 bp, Artificial Sequence
  Description of Artificial Sequence: Synthetic oligonucleotide
gctgcatccaggttgcaaagt

SEQ ID NO: 9158 - protein, 7 aa, Artificial Sequence
  Description of Artificial Sequence: Synthetic peptide
AASRLQS

SEQ ID NO: 9159 - DNA, 21 bp, Artificial Sequence
  Description of Artificial Sequence: Synthetic oligonucleotide
tgggcatctacccgggcatcc

SEQ ID NO: 9160 - protein, 7 aa, Artificial Sequence
  Description of Artificial Sequence: Synthetic peptide
WASTRAS

SEQ ID NO: 9161 - DNA, 21 bp, Artificial Sequence
  Description of Artificial Sequence: Synthetic oligonucleotide
gctgcatccagtttgcaaagt

SEQ ID NO: 9162 - protein, 7 aa, Artificial Sequence
  Description of Artificial Sequence: Synthetic peptide
AASSLQS

SEQ ID NO: 9163 - DNA, 21 bp, Artificial Sequence
  Description of Artificial Sequence: Synthetic oligonucleotide
gctgcatccagtttgcaaagt

SEQ ID NO: 9164 - protein, 7 aa, Artificial Sequence
  Description of Artificial Sequence: Synthetic peptide
AASSLQS

SEQ ID NO: 9165 - DNA, 21 bp, Artificial Sequence
  Description of Artificial Sequence: Synthetic oligonucleotide
tctacatccagtttgcaaagt

SEQ ID NO: 9166 - protein, 7 aa, Artificial Sequence
  Description of Artificial Sequence: Synthetic peptide
STSSLQS

SEQ ID NO: 9167 - DNA, 21 bp, Artificial Sequence
  Description of Artificial Sequence: Synthetic oligonucleotide
gttgcatcccgtttgcaaagt

SEQ ID NO: 9168 - protein, 7 aa, Artificial Sequence
  Description of Artificial Sequence: Synthetic peptide
VASRLQS

SEQ ID NO: 9169 - DNA, 21 bp, Artificial Sequence
  Description of Artificial Sequence: Synthetic oligonucleotide
tgggcatctacccgggaatcc

SEQ ID NO: 9170 - protein, 7 aa, Artificial Sequence
  Description of Artificial Sequence: Synthetic peptide
WASTRES

SEQ ID NO: 9171 - DNA, 21 bp, Artificial Sequence
  Description of Artificial Sequence: Synthetic oligonucleotide
gctgcatccagtttgcaaagt

SEQ ID NO: 9172 - protein, 7 aa, Artificial Sequence
  Description of Artificial Sequence: Synthetic peptide
AASSLQS

SEQ ID NO: 9173 - DNA, 21 bp, Artificial Sequence
  Description of Artificial Sequence: Synthetic oligonucleotide
gctgcatccagtttgcaaagt

SEQ ID NO: 9174 - protein, 7 aa, Artificial Sequence
  Description of Artificial Sequence: Synthetic peptide
AASSLQS

SEQ ID NO: 9175 - DNA, 21 bp, Artificial Sequence
  Description of Artificial Sequence: Synthetic oligonucleotide
gctgcatccagtttgcaaagt

SEQ ID NO: 9176 - protein, 7 aa, Artificial Sequence
  Description of Artificial Sequence: Synthetic peptide
AASSLQS

SEQ ID NO: 9177 - DNA, 21 bp, Artificial Sequence
  Description of Artificial Sequence: Synthetic oligonucleotide
gctgcatccagtttgcaaagt

SEQ ID NO: 9178 - protein, 7 aa, Artificial Sequence
  Description of Artificial Sequence: Synthetic peptide
AASSLQS

SEQ ID NO: 9179 - DNA, 21 bp, Artificial Sequence
  Description of Artificial Sequence: Synthetic oligonucleotide
gctgcatccagtttgcaaagt

SEQ ID NO: 9180 - protein, 7 aa, Artificial Sequence
  Description of Artificial Sequence: Synthetic peptide
AASSLQS

SEQ ID NO: 9181 - DNA, 21 bp, Artificial Sequence
  Description of Artificial Sequence: Synthetic oligonucleotide
ggtgcatccaatttgcaaagt

SEQ ID NO: 9182 - protein, 7 aa, Artificial Sequence
  Description of Artificial Sequence: Synthetic peptide
GASNLQS

SEQ ID NO: 9183 - DNA, 21 bp, Artificial Sequence
  Description of Artificial Sequence: Synthetic oligonucleotide
tgggcttctacccgggaatcc

SEQ ID NO: 9184 - protein, 7 aa, Artificial Sequence
  Description of Artificial Sequence: Synthetic peptide
WASTRES

SEQ ID NO: 9185 - DNA, 21 bp, Artificial Sequence
  Description of Artificial Sequence: Synthetic oligonucleotide
gctgcatccagtttgcaaagt

SEQ ID NO: 9186 - protein, 7 aa, Artificial Sequence
  Description of Artificial Sequence: Synthetic peptide
AASSLQS

SEQ ID NO: 9187 - DNA, 21 bp, Artificial Sequence
  Description of Artificial Sequence: Synthetic oligonucleotide
gctgcatccagtttgcaaagt

SEQ ID NO: 9188 - protein, 7 aa, Artificial Sequence
  Description of Artificial Sequence: Synthetic peptide
AASSLQS

SEQ ID NO: 9189 - DNA, 21 bp, Artificial Sequence
  Description of Artificial Sequence: Synthetic oligonucleotide
gatgcatccagtttgcaaagt

SEQ ID NO: 9190 - protein, 7 aa, Artificial Sequence
  Description of Artificial Sequence: Synthetic peptide
DASSLQS

SEQ ID NO: 9191 - DNA, 21 bp, Artificial Sequence
  Description of Artificial Sequence: Synthetic oligonucleotide
gaagtttccaaccggttctct

SEQ ID NO: 9192 - protein, 7 aa, Artificial Sequence
  Description of Artificial Sequence: Synthetic peptide
EVSNRFS

SEQ ID NO: 9193 - DNA, 21 bp, Artificial Sequence
  Description of Artificial Sequence: Synthetic oligonucleotide
gctgcatccagtttgcaaagt

SEQ ID NO: 9194 - protein, 7 aa, Artificial Sequence
  Description of Artificial Sequence: Synthetic peptide
AASSLQS

SEQ ID NO: 9195 - DNA, 21 bp, Artificial Sequence
  Description of Artificial Sequence: Synthetic oligonucleotide
gctgcatccagtttgcaaagt

SEQ ID NO: 9196 - protein, 7 aa, Artificial Sequence
  Description of Artificial Sequence: Synthetic peptide
AASSLQS

SEQ ID NO: 9197 - DNA, 21 bp, Artificial Sequence
  Description of Artificial Sequence: Synthetic oligonucleotide
gctgcatccagtttgcaaagt

SEQ ID NO: 9198 - protein, 7 aa, Artificial Sequence
  Description of Artificial Sequence: Synthetic peptide
AASSLQS

SEQ ID NO: 9199 - DNA, 21 bp, Artificial Sequence
  Description of Artificial Sequence: Synthetic oligonucleotide
gctgcatccagtttacaaagt

SEQ ID NO: 9200 - protein, 7 aa, Artificial Sequence
  Description of Artificial Sequence: Synthetic peptide
AASSLQS

SEQ ID NO: 9201 - DNA, 21 bp, Artificial Sequence
  Description of Artificial Sequence: Synthetic oligonucleotide
gctgcatccactttggaaagt

SEQ ID NO: 9202 - protein, 7 aa, Artificial Sequence
  Description of Artificial Sequence: Synthetic peptide
AASTLES

SEQ ID NO: 9203 - DNA, 21 bp, Artificial Sequence
  Description of Artificial Sequence: Synthetic oligonucleotide
ggtgcatccagcagggccact

SEQ ID NO: 9204 - protein, 7 aa, Artificial Sequence
  Description of Artificial Sequence: Synthetic peptide
GASSRAT

SEQ ID NO: 9205 - DNA, 21 bp, Artificial Sequence
  Description of Artificial Sequence: Synthetic oligonucleotide
gctgcatccaatttgcaaagt

SEQ ID NO: 9206 - protein, 7 aa, Artificial Sequence
  Description of Artificial Sequence: Synthetic peptide
AASNLQS

SEQ ID NO: 9207 - DNA, 21 bp, Artificial Sequence
  Description of Artificial Sequence: Synthetic oligonucleotide
gctgcatccagtttgcaaagt

SEQ ID NO: 9208 - protein, 7 aa, Artificial Sequence
  Description of Artificial Sequence: Synthetic peptide
AASSLQS

SEQ ID NO: 9209 - DNA, 21 bp, Artificial Sequence
  Description of Artificial Sequence: Synthetic oligonucleotide
gaaatttcccaccggttctct

SEQ ID NO: 9210 - protein, 7 aa, Artificial Sequence
  Description of Artificial Sequence: Synthetic peptide
EISHRFS

SEQ ID NO: 9211 - DNA, 21 bp, Artificial Sequence
  Description of Artificial Sequence: Synthetic oligonucleotide
gctacatccagtttgcaaagt

SEQ ID NO: 9212 - protein, 7 aa, Artificial Sequence
  Description of Artificial Sequence: Synthetic peptide
ATSSLQS

SEQ ID NO: 9213 - DNA, 21 bp, Artificial Sequence
  Description of Artificial Sequence: Synthetic oligonucleotide
gctgcatccagtttgcaaagt

SEQ ID NO: 9214 - protein, 7 aa, Artificial Sequence
  Description of Artificial Sequence: Synthetic peptide
AASSLQS

SEQ ID NO: 9215 - DNA, 21 bp, Artificial Sequence
  Description of Artificial Sequence: Synthetic oligonucleotide
ttgggttctaatcgggcctcc

SEQ ID NO: 9216 - protein, 7 aa, Artificial Sequence
  Description of Artificial Sequence: Synthetic peptide
LGSNRAS

SEQ ID NO: 9217 - DNA, 21 bp, Artificial Sequence
  Description of Artificial Sequence: Synthetic oligonucleotide
gctgcattcagtttgcaaagt

SEQ ID NO: 9218 - protein, 7 aa, Artificial Sequence
  Description of Artificial Sequence: Synthetic peptide
AAFSLQS

SEQ ID NO: 9219 - DNA, 21 bp, Artificial Sequence
  Description of Artificial Sequence: Synthetic oligonucleotide
gctgcatccagtttgcaaagt

SEQ ID NO: 9220 - protein, 7 aa, Artificial Sequence
  Description of Artificial Sequence: Synthetic peptide
AASSLQS

SEQ ID NO: 9221 - DNA, 21 bp, Artificial Sequence
  Description of Artificial Sequence: Synthetic oligonucleotide
ggtgcatccaatttgcaaagt

SEQ ID NO: 9222 - protein, 7 aa, Artificial Sequence
  Description of Artificial Sequence: Synthetic peptide
GASNLQS

SEQ ID NO: 9223 - DNA, 21 bp, Artificial Sequence
  Description of Artificial Sequence: Synthetic oligonucleotide
gctgcatccagtttgcaaagt

SEQ ID NO: 9224 - protein, 7 aa, Artificial Sequence
  Description of Artificial Sequence: Synthetic peptide
AASSLQS

SEQ ID NO: 9225 - DNA, 21 bp, Artificial Sequence
  Description of Artificial Sequence: Synthetic oligonucleotide
gatgcatccagtttgcaaagt

SEQ ID NO: 9226 - protein, 7 aa, Artificial Sequence
  Description of Artificial Sequence: Synthetic peptide
DASSLQS

SEQ ID NO: 9227 - DNA, 21 bp, Artificial Sequence
  Description of Artificial Sequence: Synthetic oligonucleotide
gctgcatccagtttgcaaagt

SEQ ID NO: 9228 - protein, 7 aa, Artificial Sequence
  Description of Artificial Sequence: Synthetic peptide
AASSLQS

SEQ ID NO: 9229 - DNA, 21 bp, Artificial Sequence
  Description of Artificial Sequence: Synthetic oligonucleotide
ggtgcatccagtttgcaaagt

SEQ ID NO: 9230 - protein, 7 aa, Artificial Sequence
  Description of Artificial Sequence: Synthetic peptide
GASSLQS

SEQ ID NO: 9231 - DNA, 21 bp, Artificial Sequence
  Description of Artificial Sequence: Synthetic oligonucleotide
gctgcatccagtttggaaagt

SEQ ID NO: 9232 - protein, 7 aa, Artificial Sequence
  Description of Artificial Sequence: Synthetic peptide
AASSLES

SEQ ID NO: 9233 - DNA, 21 bp, Artificial Sequence
  Description of Artificial Sequence: Synthetic oligonucleotide
gctgcatccagtttgcaaagt

SEQ ID NO: 9234 - protein, 7 aa, Artificial Sequence
  Description of Artificial Sequence: Synthetic peptide
AASSLQS

SEQ ID NO: 9235 - DNA, 21 bp, Artificial Sequence
  Description of Artificial Sequence: Synthetic oligonucleotide
gctgcatccagtttgcaaggt

SEQ ID NO: 9236 - protein, 7 aa, Artificial Sequence
  Description of Artificial Sequence: Synthetic peptide
AASSLQG

SEQ ID NO: 9237 - DNA, 21 bp, Artificial Sequence
  Description of Artificial Sequence: Synthetic oligonucleotide
gaagtttccaatcggttctct

SEQ ID NO: 9238 - protein, 7 aa, Artificial Sequence
  Description of Artificial Sequence: Synthetic peptide
EVSNRFS

SEQ ID NO: 9239 - DNA, 21 bp, Artificial Sequence
  Description of Artificial Sequence: Synthetic oligonucleotide
gctgcatccagtttgcaaagt

SEQ ID NO: 9240 - protein, 7 aa, Artificial Sequence
  Description of Artificial Sequence: Synthetic peptide
AASSLQS

SEQ ID NO: 9241 - DNA, 21 bp, Artificial Sequence
  Description of Artificial Sequence: Synthetic oligonucleotide
gctgcatccagtttgcaaagt

SEQ ID NO: 9242 - protein, 7 aa, Artificial Sequence
  Description of Artificial Sequence: Synthetic peptide
AASSLQS

SEQ ID NO: 9243 - DNA, 21 bp, Artificial Sequence
  Description of Artificial Sequence: Synthetic oligonucleotide
gctgcatccagtttggaaagt

SEQ ID NO: 9244 - protein, 7 aa, Artificial Sequence
  Description of Artificial Sequence: Synthetic peptide
AASSLES

SEQ ID NO: 9245 - DNA, 21 bp, Artificial Sequence
  Description of Artificial Sequence: Synthetic oligonucleotide
gctgcatccagtttgcaaagt

SEQ ID NO: 9246 - protein, 7 aa, Artificial Sequence
  Description of Artificial Sequence: Synthetic peptide
AASSLQS

SEQ ID NO: 9247 - DNA, 21 bp, Artificial Sequence
  Description of Artificial Sequence: Synthetic oligonucleotide
gctgcatccagtttgcaaagt

SEQ ID NO: 9248 - protein, 7 aa, Artificial Sequence
  Description of Artificial Sequence: Synthetic peptide
AASSLQS

SEQ ID NO: 9249 - DNA, 21 bp, Artificial Sequence
  Description of Artificial Sequence: Synthetic oligonucleotide
gctgcatccagtttgcaaagt

SEQ ID NO: 9250 - protein, 7 aa, Artificial Sequence
  Description of Artificial Sequence: Synthetic peptide
AASSLQS

SEQ ID NO: 9251 - DNA, 21 bp, Artificial Sequence
  Description of Artificial Sequence: Synthetic oligonucleotide
gaagtttcttaccggttctct

SEQ ID NO: 9252 - protein, 7 aa, Artificial Sequence
  Description of Artificial Sequence: Synthetic peptide
EVSYRFS

SEQ ID NO: 9253 - DNA, 21 bp, Artificial Sequence
  Description of Artificial Sequence: Synthetic oligonucleotide
gctgcatccagtttgcaaagt

SEQ ID NO: 9254 - protein, 7 aa, Artificial Sequence
  Description of Artificial Sequence: Synthetic peptide
AASSLQS

SEQ ID NO: 9255 - DNA, 21 bp, Artificial Sequence
  Description of Artificial Sequence: Synthetic oligonucleotide
gctgcattcagtttgcaaagt

SEQ ID NO: 9256 - protein, 7 aa, Artificial Sequence
  Description of Artificial Sequence: Synthetic peptide
AAFSLQS

SEQ ID NO: 9257 - DNA, 21 bp, Artificial Sequence
  Description of Artificial Sequence: Synthetic oligonucleotide
gaagtttccaaccggttctct

SEQ ID NO: 9258 - protein, 7 aa, Artificial Sequence
  Description of Artificial Sequence: Synthetic peptide
EVSNRFS

SEQ ID NO: 9259 - DNA, 21 bp, Artificial Sequence
  Description of Artificial Sequence: Synthetic oligonucleotide
gctgcatccagtttgcaaagt

SEQ ID NO: 9260 - protein, 7 aa, Artificial Sequence
  Description of Artificial Sequence: Synthetic peptide
AASSLQS

SEQ ID NO: 9261 - DNA, 21 bp, Artificial Sequence
  Description of Artificial Sequence: Synthetic oligonucleotide
ttgggttttaatcgggcctcc

SEQ ID NO: 9262 - protein, 7 aa, Artificial Sequence
  Description of Artificial Sequence: Synthetic peptide
LGFNRAS

SEQ ID NO: 9263 - DNA, 21 bp, Artificial Sequence
  Description of Artificial Sequence: Synthetic oligonucleotide
gaagtttccagccggttctct

SEQ ID NO: 9264 - protein, 7 aa, Artificial Sequence
  Description of Artificial Sequence: Synthetic peptide
EVSSRFS

SEQ ID NO: 9265 - DNA, 21 bp, Artificial Sequence
  Description of Artificial Sequence: Synthetic oligonucleotide
gctgcctccaatttgcaaagt

SEQ ID NO: 9266 - protein, 7 aa, Artificial Sequence
  Description of Artificial Sequence: Synthetic peptide
AASNLQS

SEQ ID NO: 9267 - DNA, 21 bp, Artificial Sequence
  Description of Artificial Sequence: Synthetic oligonucleotide
gctgcatccagtttgcaaagt

SEQ ID NO: 9268 - protein, 7 aa, Artificial Sequence
  Description of Artificial Sequence: Synthetic peptide
AASSLQS

SEQ ID NO: 9269 - DNA, 21 bp, Artificial Sequence
  Description of Artificial Sequence: Synthetic oligonucleotide
agagcatccagtttgcaaagt

SEQ ID NO: 9270 - protein, 7 aa, Artificial Sequence
  Description of Artificial Sequence: Synthetic peptide
RASSLQS

SEQ ID NO: 9271 - DNA, 21 bp, Artificial Sequence
  Description of Artificial Sequence: Synthetic oligonucleotide
gctgcatccagtttgcaaagt

SEQ ID NO: 9272 - protein, 7 aa, Artificial Sequence
  Description of Artificial Sequence: Synthetic peptide
AASSLQS

SEQ ID NO: 9273 - DNA, 21 bp, Artificial Sequence
  Description of Artificial Sequence: Synthetic oligonucleotide
gctgcatccagtttgcaaagt

SEQ ID NO: 9274 - protein, 7 aa, Artificial Sequence
  Description of Artificial Sequence: Synthetic peptide
AASSLQS

SEQ ID NO: 9275 - DNA, 21 bp, Artificial Sequence
  Description of Artificial Sequence: Synthetic oligonucleotide
gctgcatccagtttgcaaagt

SEQ ID NO: 9276 - protein, 7 aa, Artificial Sequence
  Description of Artificial Sequence: Synthetic peptide
AASSLQS

SEQ ID NO: 9277 - DNA, 21 bp, Artificial Sequence
  Description of Artificial Sequence: Synthetic oligonucleotide
agtgcatccagtttgcaaaat

SEQ ID NO: 9278 - protein, 7 aa, Artificial Sequence
  Description of Artificial Sequence: Synthetic peptide
SASSLQN

SEQ ID NO: 9279 - DNA, 21 bp, Artificial Sequence
  Description of Artificial Sequence: Synthetic oligonucleotide
attgcatccagtttgcaaagt

SEQ ID NO: 9280 - protein, 7 aa, Artificial Sequence
  Description of Artificial Sequence: Synthetic peptide
IASSLQS

SEQ ID NO: 9281 - DNA, 21 bp, Artificial Sequence
  Description of Artificial Sequence: Synthetic oligonucleotide
gctgcttccagtttgcaaagt

SEQ ID NO: 9282 - protein, 7 aa, Artificial Sequence
  Description of Artificial Sequence: Synthetic peptide
AASSLQS

SEQ ID NO: 9283 - DNA, 21 bp, Artificial Sequence
  Description of Artificial Sequence: Synthetic oligonucleotide
gctgcatccactttgcaaagt

SEQ ID NO: 9284 - protein, 7 aa, Artificial Sequence
  Description of Artificial Sequence: Synthetic peptide
AASTLQS

SEQ ID NO: 9285 - DNA, 21 bp, Artificial Sequence
  Description of Artificial Sequence: Synthetic oligonucleotide
gctgcttccagtttgcaaagt

SEQ ID NO: 9286 - protein, 7 aa, Artificial Sequence
  Description of Artificial Sequence: Synthetic peptide
AASSLQS

SEQ ID NO: 9287 - DNA, 21 bp, Artificial Sequence
  Description of Artificial Sequence: Synthetic oligonucleotide
gctgcttccagtttgcaaagt

SEQ ID NO: 9288 - protein, 7 aa, Artificial Sequence
  Description of Artificial Sequence: Synthetic peptide
AASSLQS

SEQ ID NO: 9289 - DNA, 21 bp, Artificial Sequence
  Description of Artificial Sequence: Synthetic oligonucleotide
gctgcatccagtttgcaaagt

SEQ ID NO: 9290 - protein, 7 aa, Artificial Sequence
  Description of Artificial Sequence: Synthetic peptide
AASSLQS

SEQ ID NO: 9291 - DNA, 21 bp, Artificial Sequence
  Description of Artificial Sequence: Synthetic oligonucleotide
gaagtttcccaccggttctct

SEQ ID NO: 9292 - protein, 7 aa, Artificial Sequence
  Description of Artificial Sequence: Synthetic peptide
EVSHRFS

SEQ ID NO: 9293 - DNA, 21 bp, Artificial Sequence
  Description of Artificial Sequence: Synthetic oligonucleotide
actgtctccagtttgcaaagt

SEQ ID NO: 9294 - protein, 7 aa, Artificial Sequence
  Description of Artificial Sequence: Synthetic peptide
TVSSLQS

SEQ ID NO: 9295 - DNA, 21 bp, Artificial Sequence
  Description of Artificial Sequence: Synthetic oligonucleotide
gaagtttccaaccggctctct

SEQ ID NO: 9296 - protein, 7 aa, Artificial Sequence
  Description of Artificial Sequence: Synthetic peptide
EVSNRLS

SEQ ID NO: 9297 - DNA, 21 bp, Artificial Sequence
  Description of Artificial Sequence: Synthetic oligonucleotide
gctgcatccagtttgcaagat

SEQ ID NO: 9298 - protein, 7 aa, Artificial Sequence
  Description of Artificial Sequence: Synthetic peptide
AASSLQD

SEQ ID NO: 9299 - DNA, 21 bp, Artificial Sequence
  Description of Artificial Sequence: Synthetic oligonucleotide
gctgcatccagtttgcaaagt

SEQ ID NO: 9300 - protein, 7 aa, Artificial Sequence
  Description of Artificial Sequence: Synthetic peptide
AASSLQS

SEQ ID NO: 9301 - DNA, 21 bp, Artificial Sequence
  Description of Artificial Sequence: Synthetic oligonucleotide
gaagtttccaagcggctctct

SEQ ID NO: 9302 - protein, 7 aa, Artificial Sequence
  Description of Artificial Sequence: Synthetic peptide
EVSKRLS

SEQ ID NO: 9303 - DNA, 21 bp, Artificial Sequence
  Description of Artificial Sequence: Synthetic oligonucleotide
gaagtttccaaccggttctct

SEQ ID NO: 9304 - protein, 7 aa, Artificial Sequence
  Description of Artificial Sequence: Synthetic peptide
EVSNRFS

SEQ ID NO: 9305 - DNA, 21 bp, Artificial Sequence
  Description of Artificial Sequence: Synthetic oligonucleotide
gctgcatccactttgcaaagt

SEQ ID NO: 9306 - protein, 7 aa, Artificial Sequence
  Description of Artificial Sequence: Synthetic peptide
AASTLQS

SEQ ID NO: 9307 - DNA, 21 bp, Artificial Sequence
  Description of Artificial Sequence: Synthetic oligonucleotide
gctgcatccagtttgcaaatt

SEQ ID NO: 9308 - protein, 7 aa, Artificial Sequence
  Description of Artificial Sequence: Synthetic peptide
AASSLQI

SEQ ID NO: 9309 - DNA, 21 bp, Artificial Sequence
  Description of Artificial Sequence: Synthetic oligonucleotide
gctgcatccagtttgcaaagt

SEQ ID NO: 9310 - protein, 7 aa, Artificial Sequence
  Description of Artificial Sequence: Synthetic peptide
AASSLQS

SEQ ID NO: 9311 - DNA, 21 bp, Artificial Sequence
  Description of Artificial Sequence: Synthetic oligonucleotide
gctgcatccagtctgcaaagt

SEQ ID NO: 9312 - protein, 7 aa, Artificial Sequence
  Description of Artificial Sequence: Synthetic peptide
AASSLQS

SEQ ID NO: 9313 - DNA, 21 bp, Artificial Sequence
  Description of Artificial Sequence: Synthetic oligonucleotide
gctgcatccagtttgcaaagt

SEQ ID NO: 9314 - protein, 7 aa, Artificial Sequence
  Description of Artificial Sequence: Synthetic peptide
AASSLQS

SEQ ID NO: 9315 - DNA, 21 bp, Artificial Sequence
  Description of Artificial Sequence: Synthetic oligonucleotide
gctgcatccagtttgcaaagt

SEQ ID NO: 9316 - protein, 7 aa, Artificial Sequence
  Description of Artificial Sequence: Synthetic peptide
AASSLQS

SEQ ID NO: 9317 - DNA, 21 bp, Artificial Sequence
  Description of Artificial Sequence: Synthetic oligonucleotide
actgcatccaatttacaaagt

SEQ ID NO: 9318 - protein, 7 aa, Artificial Sequence
  Description of Artificial Sequence: Synthetic peptide
TASNLQS

SEQ ID NO: 9319 - DNA, 21 bp, Artificial Sequence
  Description of Artificial Sequence: Synthetic oligonucleotide
gctgcatccagtttgcaaagt

SEQ ID NO: 9320 - protein, 7 aa, Artificial Sequence
  Description of Artificial Sequence: Synthetic peptide
AASSLQS

SEQ ID NO: 9321 - DNA, 21 bp, Artificial Sequence
  Description of Artificial Sequence: Synthetic oligonucleotide
gaagtttccaaccggttctct

SEQ ID NO: 9322 - protein, 7 aa, Artificial Sequence
  Description of Artificial Sequence: Synthetic peptide
EVSNRFS

SEQ ID NO: 9323 - DNA, 21 bp, Artificial Sequence
  Description of Artificial Sequence: Synthetic oligonucleotide
gatgcatccaatttggaaaca

SEQ ID NO: 9324 - protein, 7 aa, Artificial Sequence
  Description of Artificial Sequence: Synthetic peptide
DASNLET

SEQ ID NO: 9325 - DNA, 21 bp, Artificial Sequence
  Description of Artificial Sequence: Synthetic oligonucleotide
gctgcatccagtttgcaaagt

SEQ ID NO: 9326 - protein, 7 aa, Artificial Sequence
  Description of Artificial Sequence: Synthetic peptide
AASSLQS

SEQ ID NO: 9327 - DNA, 21 bp, Artificial Sequence
  Description of Artificial Sequence: Synthetic oligonucleotide
gctgcatccagtttgcgaagt

SEQ ID NO: 9328 - protein, 7 aa, Artificial Sequence
  Description of Artificial Sequence: Synthetic peptide
AASSLRS

SEQ ID NO: 9329 - DNA, 21 bp, Artificial Sequence
  Description of Artificial Sequence: Synthetic oligonucleotide
gctgcatccagtttgcaaaat

SEQ ID NO: 9330 - protein, 7 aa, Artificial Sequence
  Description of Artificial Sequence: Synthetic peptide
AASSLQN

SEQ ID NO: 9331 - DNA, 21 bp, Artificial Sequence
  Description of Artificial Sequence: Synthetic oligonucleotide
gctccatccaatttgcaaagt

SEQ ID NO: 9332 - protein, 7 aa, Artificial Sequence
  Description of Artificial Sequence: Synthetic peptide
APSNLQS

SEQ ID NO: 9333 - DNA, 21 bp, Artificial Sequence
  Description of Artificial Sequence: Synthetic oligonucleotide
gctgcatccactttgcaaagt

SEQ ID NO: 9334 - protein, 7 aa, Artificial Sequence
  Description of Artificial Sequence: Synthetic peptide
AASTLQS

SEQ ID NO: 9335 - DNA, 21 bp, Artificial Sequence
  Description of Artificial Sequence: Synthetic oligonucleotide
gctgcttccagtttgcaaagt

SEQ ID NO: 9336 - protein, 7 aa, Artificial Sequence
  Description of Artificial Sequence: Synthetic peptide
AASSLQS

SEQ ID NO: 9337 - DNA, 21 bp, Artificial Sequence
  Description of Artificial Sequence: Synthetic oligonucleotide
gttgcatccagtttgcaaagt

SEQ ID NO: 9338 - protein, 7 aa, Artificial Sequence
  Description of Artificial Sequence: Synthetic peptide
VASSLQS

SEQ ID NO: 9339 - DNA, 21 bp, Artificial Sequence
  Description of Artificial Sequence: Synthetic oligonucleotide
gctgcatccagtttgcaacgt

SEQ ID NO: 9340 - protein, 7 aa, Artificial Sequence
  Description of Artificial Sequence: Synthetic peptide
AASSLQR

SEQ ID NO: 9341 - DNA, 21 bp, Artificial Sequence
  Description of Artificial Sequence: Synthetic oligonucleotide
gctgcatccagtttgcaaagt

SEQ ID NO: 9342 - protein, 7 aa, Artificial Sequence
  Description of Artificial Sequence: Synthetic peptide
AASSLQS

SEQ ID NO: 9343 - DNA, 21 bp, Artificial Sequence
  Description of Artificial Sequence: Synthetic oligonucleotide
gctgcatccagtttgcaaagt

SEQ ID NO: 9344 - protein, 7 aa, Artificial Sequence
  Description of Artificial Sequence: Synthetic peptide
AASSLQS

SEQ ID NO: 9345 - DNA, 21 bp, Artificial Sequence
  Description of Artificial Sequence: Synthetic oligonucleotide
gctgcatccagtttgcaaagt

SEQ ID NO: 9346 - protein, 7 aa, Artificial Sequence
  Description of Artificial Sequence: Synthetic peptide
AASSLQS

SEQ ID NO: 9347 - DNA, 21 bp, Artificial Sequence
  Description of Artificial Sequence: Synthetic oligonucleotide
gctgcatccagtttgcaaaat

SEQ ID NO: 9348 - protein, 7 aa, Artificial Sequence
  Description of Artificial Sequence: Synthetic peptide
AASSLQN

SEQ ID NO: 9349 - DNA, 21 bp, Artificial Sequence
  Description of Artificial Sequence: Synthetic oligonucleotide
gctgcatcctttttgcaaagt

SEQ ID NO: 9350 - protein, 7 aa, Artificial Sequence
  Description of Artificial Sequence: Synthetic peptide
AASFLQS

SEQ ID NO: 9351 - DNA, 21 bp, Artificial Sequence
  Description of Artificial Sequence: Synthetic oligonucleotide
actacatccagtttgcaaagt

SEQ ID NO: 9352 - protein, 7 aa, Artificial Sequence
  Description of Artificial Sequence: Synthetic peptide
TTSSLQS

SEQ ID NO: 9353 - DNA, 21 bp, Artificial Sequence
  Description of Artificial Sequence: Synthetic oligonucleotide
gctgcatccagtttacaaagt

SEQ ID NO: 9354 - protein, 7 aa, Artificial Sequence
  Description of Artificial Sequence: Synthetic peptide
AASSLQS

SEQ ID NO: 9355 - DNA, 21 bp, Artificial Sequence
  Description of Artificial Sequence: Synthetic oligonucleotide
gatgcatccactttgggaaca

SEQ ID NO: 9356 - protein, 7 aa, Artificial Sequence
  Description of Artificial Sequence: Synthetic peptide
DASTLGT

SEQ ID NO: 9357 - DNA, 21 bp, Artificial Sequence
  Description of Artificial Sequence: Synthetic oligonucleotide
gctgcatccagtttgcaaagt

SEQ ID NO: 9358 - protein, 7 aa, Artificial Sequence
  Description of Artificial Sequence: Synthetic peptide
AASSLQS

SEQ ID NO: 9359 - DNA, 21 bp, Artificial Sequence
  Description of Artificial Sequence: Synthetic oligonucleotide
gaagtttccaaccgggtctct

SEQ ID NO: 9360 - protein, 7 aa, Artificial Sequence
  Description of Artificial Sequence: Synthetic peptide
EVSNRVS

SEQ ID NO: 9361 - DNA, 21 bp, Artificial Sequence
  Description of Artificial Sequence: Synthetic oligonucleotide
gctgcatctagtttgcaaagt

SEQ ID NO: 9362 - protein, 7 aa, Artificial Sequence
  Description of Artificial Sequence: Synthetic peptide
AASSLQS

SEQ ID NO: 9363 - DNA, 21 bp, Artificial Sequence
  Description of Artificial Sequence: Synthetic oligonucleotide
gttgcatccagtttgcaaagt

SEQ ID NO: 9364 - protein, 7 aa, Artificial Sequence
  Description of Artificial Sequence: Synthetic peptide
VASSLQS

SEQ ID NO: 9365 - DNA, 21 bp, Artificial Sequence
  Description of Artificial Sequence: Synthetic oligonucleotide
ggtgcatccagtttgcaaagt

SEQ ID NO: 9366 - protein, 7 aa, Artificial Sequence
  Description of Artificial Sequence: Synthetic peptide
GASSLQS

SEQ ID NO: 9367 - DNA, 21 bp, Artificial Sequence
  Description of Artificial Sequence: Synthetic oligonucleotide
cctgcatccagtttacaaagt

SEQ ID NO: 9368 - protein, 7 aa, Artificial Sequence
  Description of Artificial Sequence: Synthetic peptide
PASSLQS

SEQ ID NO: 9369 - DNA, 21 bp, Artificial Sequence
  Description of Artificial Sequence: Synthetic oligonucleotide
gctgcatccagtttgcaaagt

SEQ ID NO: 9370 - protein, 7 aa, Artificial Sequence
  Description of Artificial Sequence: Synthetic peptide
AASSLQS

SEQ ID NO: 9371 - DNA, 21 bp, Artificial Sequence
  Description of Artificial Sequence: Synthetic oligonucleotide
gctgtatccagtttgcaaagt

SEQ ID NO: 9372 - protein, 7 aa, Artificial Sequence
  Description of Artificial Sequence: Synthetic peptide
AVSSLQS

SEQ ID NO: 9373 - DNA, 21 bp, Artificial Sequence
  Description of Artificial Sequence: Synthetic oligonucleotide
gatgcatccaatttggaaaca

SEQ ID NO: 9374 - protein, 7 aa, Artificial Sequence
  Description of Artificial Sequence: Synthetic peptide
DASNLET

SEQ ID NO: 9375 - DNA, 21 bp, Artificial Sequence
  Description of Artificial Sequence: Synthetic oligonucleotide
gctgcatccagtttgcaaagt

SEQ ID NO: 9376 - protein, 7 aa, Artificial Sequence
  Description of Artificial Sequence: Synthetic peptide
AASSLQS

SEQ ID NO: 9377 - DNA, 21 bp, Artificial Sequence
  Description of Artificial Sequence: Synthetic oligonucleotide
gctgcatccagtttgaaaagt

SEQ ID NO: 9378 - protein, 7 aa, Artificial Sequence
  Description of Artificial Sequence: Synthetic peptide
AASSLKS

SEQ ID NO: 9379 - DNA, 21 bp, Artificial Sequence
  Description of Artificial Sequence: Synthetic oligonucleotide
gctgcatccaatttgcaaagt

SEQ ID NO: 9380 - protein, 7 aa, Artificial Sequence
  Description of Artificial Sequence: Synthetic peptide
AASNLQS

SEQ ID NO: 9381 - DNA, 21 bp, Artificial Sequence
  Description of Artificial Sequence: Synthetic oligonucleotide
gatgcatccaatttgggaaca

SEQ ID NO: 9382 - protein, 7 aa, Artificial Sequence
  Description of Artificial Sequence: Synthetic peptide
DASNLGT

SEQ ID NO: 9383 - DNA, 21 bp, Artificial Sequence
  Description of Artificial Sequence: Synthetic oligonucleotide
gctgcatccagtttgcaaagt

SEQ ID NO: 9384 - protein, 7 aa, Artificial Sequence
  Description of Artificial Sequence: Synthetic peptide
AASSLQS

SEQ ID NO: 9385 - DNA, 21 bp, Artificial Sequence
  Description of Artificial Sequence: Synthetic oligonucleotide
ggtgcgtccggcagggccact

SEQ ID NO: 9386 - protein, 7 aa, Artificial Sequence
  Description of Artificial Sequence: Synthetic peptide
GASGRAT

SEQ ID NO: 9387 - DNA, 21 bp, Artificial Sequence
  Description of Artificial Sequence: Synthetic oligonucleotide
gctgcatccagtttgcaaagt

SEQ ID NO: 9388 - protein, 7 aa, Artificial Sequence
  Description of Artificial Sequence: Synthetic peptide
AASSLQS

SEQ ID NO: 9389 - DNA, 21 bp, Artificial Sequence
  Description of Artificial Sequence: Synthetic oligonucleotide
gctgcatccagtttgcaaagt

SEQ ID NO: 9390 - protein, 7 aa, Artificial Sequence
  Description of Artificial Sequence: Synthetic peptide
AASSLQS

SEQ ID NO: 9391 - DNA, 21 bp, Artificial Sequence
  Description of Artificial Sequence: Synthetic oligonucleotide
gatgcatccagtttgcaaagt

SEQ ID NO: 9392 - protein, 7 aa, Artificial Sequence
  Description of Artificial Sequence: Synthetic peptide
DASSLQS

SEQ ID NO: 9393 - DNA, 21 bp, Artificial Sequence
  Description of Artificial Sequence: Synthetic oligonucleotide
gctgcatccaatttgcaaagt

SEQ ID NO: 9394 - protein, 7 aa, Artificial Sequence
  Description of Artificial Sequence: Synthetic peptide
AASNLQS

SEQ ID NO: 9395 - DNA, 21 bp, Artificial Sequence
  Description of Artificial Sequence: Synthetic oligonucleotide
gaagtttccaaccggttctct

SEQ ID NO: 9396 - protein, 7 aa, Artificial Sequence
  Description of Artificial Sequence: Synthetic peptide
EVSNRFS

SEQ ID NO: 9397 - DNA, 21 bp, Artificial Sequence
  Description of Artificial Sequence: Synthetic oligonucleotide
gctgcatccaatttgcaaagt

SEQ ID NO: 9398 - protein, 7 aa, Artificial Sequence
  Description of Artificial Sequence: Synthetic peptide
AASNLQS

SEQ ID NO: 9399 - DNA, 21 bp, Artificial Sequence
  Description of Artificial Sequence: Synthetic oligonucleotide
gctgcatccagtttgcaaagt

SEQ ID NO: 9400 - protein, 7 aa, Artificial Sequence
  Description of Artificial Sequence: Synthetic peptide
AASSLQS

SEQ ID NO: 9401 - DNA, 21 bp, Artificial Sequence
  Description of Artificial Sequence: Synthetic oligonucleotide
gctgcatccagtttgcaaagt

SEQ ID NO: 9402 - protein, 7 aa, Artificial Sequence
  Description of Artificial Sequence: Synthetic peptide
AASSLQS

SEQ ID NO: 9403 - DNA, 21 bp, Artificial Sequence
  Description of Artificial Sequence: Synthetic oligonucleotide
gatgcatccgccagggccact

SEQ ID NO: 9404 - protein, 7 aa, Artificial Sequence
  Description of Artificial Sequence: Synthetic peptide
DASARAT

SEQ ID NO: 9405 - DNA, 21 bp, Artificial Sequence
  Description of Artificial Sequence: Synthetic oligonucleotide
gaagtttcccaccggttctct

SEQ ID NO: 9406 - protein, 7 aa, Artificial Sequence
  Description of Artificial Sequence: Synthetic peptide
EVSHRFS

SEQ ID NO: 9407 - DNA, 21 bp, Artificial Sequence
  Description of Artificial Sequence: Synthetic oligonucleotide
gaagtttccaaccgggtctct

SEQ ID NO: 9408 - protein, 7 aa, Artificial Sequence
  Description of Artificial Sequence: Synthetic peptide
EVSNRVS

SEQ ID NO: 9409 - DNA, 21 bp, Artificial Sequence
  Description of Artificial Sequence: Synthetic oligonucleotide
gctgcatccagtttgcaaagt

SEQ ID NO: 9410 - protein, 7 aa, Artificial Sequence
  Description of Artificial Sequence: Synthetic peptide
AASSLQS

SEQ ID NO: 9411 - DNA, 21 bp, Artificial Sequence
  Description of Artificial Sequence: Synthetic oligonucleotide
actgcatccagtttgcaaagt

SEQ ID NO: 9412 - protein, 7 aa, Artificial Sequence
  Description of Artificial Sequence: Synthetic peptide
TASSLQS

SEQ ID NO: 9413 - DNA, 21 bp, Artificial Sequence
  Description of Artificial Sequence: Synthetic oligonucleotide
gctgcattcaggttgcaaagt

SEQ ID NO: 9414 - protein, 7 aa, Artificial Sequence
  Description of Artificial Sequence: Synthetic peptide
AAFRLQS

SEQ ID NO: 9415 - DNA, 21 bp, Artificial Sequence
  Description of Artificial Sequence: Synthetic oligonucleotide
gaagtttccaaccggttctct

SEQ ID NO: 9416 - protein, 7 aa, Artificial Sequence
  Description of Artificial Sequence: Synthetic peptide
EVSNRFS

SEQ ID NO: 9417 - DNA, 21 bp, Artificial Sequence
  Description of Artificial Sequence: Synthetic oligonucleotide
gatgcatccaatttggaaaca

SEQ ID NO: 9418 - protein, 7 aa, Artificial Sequence
  Description of Artificial Sequence: Synthetic peptide
DASNLET

SEQ ID NO: 9419 - DNA, 21 bp, Artificial Sequence
  Description of Artificial Sequence: Synthetic oligonucleotide
gttgcatccagtttccaaagt

SEQ ID NO: 9420 - protein, 7 aa, Artificial Sequence
  Description of Artificial Sequence: Synthetic peptide
VASSFQS

SEQ ID NO: 9421 - DNA, 21 bp, Artificial Sequence
  Description of Artificial Sequence: Synthetic oligonucleotide
gctgcatccagtttgcaaaat

SEQ ID NO: 9422 - protein, 7 aa, Artificial Sequence
  Description of Artificial Sequence: Synthetic peptide
AASSLQN

SEQ ID NO: 9423 - DNA, 21 bp, Artificial Sequence
  Description of Artificial Sequence: Synthetic oligonucleotide
gctgcatccagtttgcaaagt

SEQ ID NO: 9424 - protein, 7 aa, Artificial Sequence
  Description of Artificial Sequence: Synthetic peptide
AASSLQS

SEQ ID NO: 9425 - DNA, 21 bp, Artificial Sequence
  Description of Artificial Sequence: Synthetic oligonucleotide
gatgcctccaatttggaaaca

SEQ ID NO: 9426 - protein, 7 aa, Artificial Sequence
  Description of Artificial Sequence: Synthetic peptide
DASNLET

SEQ ID NO: 9427 - DNA, 21 bp, Artificial Sequence
  Description of Artificial Sequence: Synthetic oligonucleotide
gctgcatccagtttgcaaagt

SEQ ID NO: 9428 - protein, 7 aa, Artificial Sequence
  Description of Artificial Sequence: Synthetic peptide
AASSLQS

SEQ ID NO: 9429 - DNA, 21 bp, Artificial Sequence
  Description of Artificial Sequence: Synthetic oligonucleotide
tgggcatctacccgggaatcc

SEQ ID NO: 9430 - protein, 7 aa, Artificial Sequence
  Description of Artificial Sequence: Synthetic peptide
WASTRES

SEQ ID NO: 9431 - DNA, 21 bp, Artificial Sequence
  Description of Artificial Sequence: Synthetic oligonucleotide
gctgcatccagtttacaaagt

SEQ ID NO: 9432 - protein, 7 aa, Artificial Sequence
  Description of Artificial Sequence: Synthetic peptide
AASSLQS

SEQ ID NO: 9433 - DNA, 21 bp, Artificial Sequence
  Description of Artificial Sequence: Synthetic oligonucleotide
gctgtatccagtttgcaaagt

SEQ ID NO: 9434 - protein, 7 aa, Artificial Sequence
  Description of Artificial Sequence: Synthetic peptide
AVSSLQS

SEQ ID NO: 9435 - DNA, 21 bp, Artificial Sequence
  Description of Artificial Sequence: Synthetic oligonucleotide
gctgcatccagtttgcaaagt

SEQ ID NO: 9436 - protein, 7 aa, Artificial Sequence
  Description of Artificial Sequence: Synthetic peptide
AASSLQS

SEQ ID NO: 9437 - DNA, 21 bp, Artificial Sequence
  Description of Artificial Sequence: Synthetic oligonucleotide
gctgcatccagtttgcaaagt

SEQ ID NO: 9438 - protein, 7 aa, Artificial Sequence
  Description of Artificial Sequence: Synthetic peptide
AASSLQS

SEQ ID NO: 9439 - DNA, 21 bp, Artificial Sequence
  Description of Artificial Sequence: Synthetic oligonucleotide
gctgcatccagtttccaaagt

SEQ ID NO: 9440 - protein, 7 aa, Artificial Sequence
  Description of Artificial Sequence: Synthetic peptide
AASSFQS

SEQ ID NO: 9441 - DNA, 21 bp, Artificial Sequence
  Description of Artificial Sequence: Synthetic oligonucleotide
gctgcatccagattgcaaagt

SEQ ID NO: 9442 - protein, 7 aa, Artificial Sequence
  Description of Artificial Sequence: Synthetic peptide
AASRLQS

SEQ ID NO: 9443 - DNA, 21 bp, Artificial Sequence
  Description of Artificial Sequence: Synthetic oligonucleotide
gttgcatccggtttgcaaagt

SEQ ID NO: 9444 - protein, 7 aa, Artificial Sequence
  Description of Artificial Sequence: Synthetic peptide
VASGLQS

SEQ ID NO: 9445 - DNA, 21 bp, Artificial Sequence
  Description of Artificial Sequence: Synthetic oligonucleotide
actgcatccaatttacaaagt

SEQ ID NO: 9446 - protein, 7 aa, Artificial Sequence
  Description of Artificial Sequence: Synthetic peptide
TASNLQS

SEQ ID NO: 9447 - DNA, 21 bp, Artificial Sequence
  Description of Artificial Sequence: Synthetic oligonucleotide
gctgcatccagtttgcaaagt

SEQ ID NO: 9448 - protein, 7 aa, Artificial Sequence
  Description of Artificial Sequence: Synthetic peptide
AASSLQS

SEQ ID NO: 9449 - DNA, 21 bp, Artificial Sequence
  Description of Artificial Sequence: Synthetic oligonucleotide
gaagtttcctatcggttttct

SEQ ID NO: 9450 - protein, 7 aa, Artificial Sequence
  Description of Artificial Sequence: Synthetic peptide
EVSYRFS

SEQ ID NO: 9451 - DNA, 21 bp, Artificial Sequence
  Description of Artificial Sequence: Synthetic oligonucleotide
gctgcatccagtttgcaaagt

SEQ ID NO: 9452 - protein, 7 aa, Artificial Sequence
  Description of Artificial Sequence: Synthetic peptide
AASSLQS

SEQ ID NO: 9453 - DNA, 21 bp, Artificial Sequence
  Description of Artificial Sequence: Synthetic oligonucleotide
gaagtttccaaccggatctct

SEQ ID NO: 9454 - protein, 7 aa, Artificial Sequence
  Description of Artificial Sequence: Synthetic peptide
EVSNRIS

SEQ ID NO: 9455 - DNA, 21 bp, Artificial Sequence
  Description of Artificial Sequence: Synthetic oligonucleotide
gctgcatttagtttgcaaagt

SEQ ID NO: 9456 - protein, 7 aa, Artificial Sequence
  Description of Artificial Sequence: Synthetic peptide
AAFSLQS

SEQ ID NO: 9457 - DNA, 21 bp, Artificial Sequence
  Description of Artificial Sequence: Synthetic oligonucleotide
tctgcatccagtttacaaagt

SEQ ID NO: 9458 - protein, 7 aa, Artificial Sequence
  Description of Artificial Sequence: Synthetic peptide
SASSLQS

SEQ ID NO: 9459 - DNA, 21 bp, Artificial Sequence
  Description of Artificial Sequence: Synthetic oligonucleotide
tgggcatctacccgggaatcc

SEQ ID NO: 9460 - protein, 7 aa, Artificial Sequence
  Description of Artificial Sequence: Synthetic peptide
WASTRES

SEQ ID NO: 9461 - DNA, 21 bp, Artificial Sequence
  Description of Artificial Sequence: Synthetic oligonucleotide
gctgcatccagtttgcaaagt

SEQ ID NO: 9462 - protein, 7 aa, Artificial Sequence
  Description of Artificial Sequence: Synthetic peptide
AASSLQS

SEQ ID NO: 9463 - DNA, 21 bp, Artificial Sequence
  Description of Artificial Sequence: Synthetic oligonucleotide
gctgcgtccagtttgcaaagt

SEQ ID NO: 9464 - protein, 7 aa, Artificial Sequence
  Description of Artificial Sequence: Synthetic peptide
AASSLQS

SEQ ID NO: 9465 - DNA, 21 bp, Artificial Sequence
  Description of Artificial Sequence: Synthetic oligonucleotide
gctgcatccagtttgcaaagt

SEQ ID NO: 9466 - protein, 7 aa, Artificial Sequence
  Description of Artificial Sequence: Synthetic peptide
AASSLQS

SEQ ID NO: 9467 - DNA, 21 bp, Artificial Sequence
  Description of Artificial Sequence: Synthetic oligonucleotide
ggtgcatccaccagggccact

SEQ ID NO: 9468 - protein, 7 aa, Artificial Sequence
  Description of Artificial Sequence: Synthetic peptide
GASTRAT

SEQ ID NO: 9469 - DNA, 21 bp, Artificial Sequence
  Description of Artificial Sequence: Synthetic oligonucleotide
actgcatccagtttgcaaagt

SEQ ID NO: 9470 - protein, 7 aa, Artificial Sequence
  Description of Artificial Sequence: Synthetic peptide
TASSLQS

SEQ ID NO: 9471 - DNA, 21 bp, Artificial Sequence
  Description of Artificial Sequence: Synthetic oligonucleotide
gaagtttccaaccggttctct

SEQ ID NO: 9472 - protein, 7 aa, Artificial Sequence
  Description of Artificial Sequence: Synthetic peptide
EVSNRFS

SEQ ID NO: 9473 - DNA, 21 bp, Artificial Sequence
  Description of Artificial Sequence: Synthetic oligonucleotide
gctgcatccagtttgcaaagt

SEQ ID NO: 9474 - protein, 7 aa, Artificial Sequence
  Description of Artificial Sequence: Synthetic peptide
AASSLQS

SEQ ID NO: 9475 - DNA, 21 bp, Artificial Sequence
  Description of Artificial Sequence: Synthetic oligonucleotide
gctgcatccagtttgcaaagt

SEQ ID NO: 9476 - protein, 7 aa, Artificial Sequence
  Description of Artificial Sequence: Synthetic peptide
AASSLQS

SEQ ID NO: 9477 - DNA, 21 bp, Artificial Sequence
  Description of Artificial Sequence: Synthetic oligonucleotide
gctgcatccagtttgcaaagt

SEQ ID NO: 9478 - protein, 7 aa, Artificial Sequence
  Description of Artificial Sequence: Synthetic peptide
AASSLQS

SEQ ID NO: 9479 - DNA, 21 bp, Artificial Sequence
  Description of Artificial Sequence: Synthetic oligonucleotide
gctgcatccagtttgcaaagt

SEQ ID NO: 9480 - protein, 7 aa, Artificial Sequence
  Description of Artificial Sequence: Synthetic peptide
AASSLQS

SEQ ID NO: 9481 - DNA, 21 bp, Artificial Sequence
  Description of Artificial Sequence: Synthetic oligonucleotide
gaagtttccaaccggatctct

SEQ ID NO: 9482 - protein, 7 aa, Artificial Sequence
  Description of Artificial Sequence: Synthetic peptide
EVSNRIS

SEQ ID NO: 9483 - DNA, 21 bp, Artificial Sequence
  Description of Artificial Sequence: Synthetic oligonucleotide
tgggcatctatccgggaatcc

SEQ ID NO: 9484 - protein, 7 aa, Artificial Sequence
  Description of Artificial Sequence: Synthetic peptide
WASIRES

SEQ ID NO: 9485 - DNA, 21 bp, Artificial Sequence
  Description of Artificial Sequence: Synthetic oligonucleotide
tgggcatctacccgggaatcc

SEQ ID NO: 9486 - protein, 7 aa, Artificial Sequence
  Description of Artificial Sequence: Synthetic peptide
WASTRES

SEQ ID NO: 9487 - DNA, 21 bp, Artificial Sequence
  Description of Artificial Sequence: Synthetic oligonucleotide
gctgcatccagtttgcaaagt

SEQ ID NO: 9488 - protein, 7 aa, Artificial Sequence
  Description of Artificial Sequence: Synthetic peptide
AASSLQS

SEQ ID NO: 9489 - DNA, 21 bp, Artificial Sequence
  Description of Artificial Sequence: Synthetic oligonucleotide
gctgcatccagtttgcaaagt

SEQ ID NO: 9490 - protein, 7 aa, Artificial Sequence
  Description of Artificial Sequence: Synthetic peptide
AASSLQS

SEQ ID NO: 9491 - DNA, 21 bp, Artificial Sequence
  Description of Artificial Sequence: Synthetic oligonucleotide
ttggtttctaatcgggcctcc

SEQ ID NO: 9492 - protein, 7 aa, Artificial Sequence
  Description of Artificial Sequence: Synthetic peptide
LVSNRAS

SEQ ID NO: 9493 - DNA, 21 bp, Artificial Sequence
  Description of Artificial Sequence: Synthetic oligonucleotide
gctgtatttagtttgcaaagt

SEQ ID NO: 9494 - protein, 7 aa, Artificial Sequence
  Description of Artificial Sequence: Synthetic peptide
AVFSLQS

SEQ ID NO: 9495 - DNA, 21 bp, Artificial Sequence
  Description of Artificial Sequence: Synthetic oligonucleotide
gctacatccagtttgcaaagt

SEQ ID NO: 9496 - protein, 7 aa, Artificial Sequence
  Description of Artificial Sequence: Synthetic peptide
ATSSLQS

SEQ ID NO: 9497 - DNA, 21 bp, Artificial Sequence
  Description of Artificial Sequence: Synthetic oligonucleotide
gctgcatcccgtttgcaaagt

SEQ ID NO: 9498 - protein, 7 aa, Artificial Sequence
  Description of Artificial Sequence: Synthetic peptide
AASRLQS

SEQ ID NO: 9499 - DNA, 21 bp, Artificial Sequence
  Description of Artificial Sequence: Synthetic oligonucleotide
actgcatccagtttgcaaagt

SEQ ID NO: 9500 - protein, 7 aa, Artificial Sequence
  Description of Artificial Sequence: Synthetic peptide
TASSLQS

SEQ ID NO: 9501 - DNA, 21 bp, Artificial Sequence
  Description of Artificial Sequence: Synthetic oligonucleotide
gctgcattcagtttgcaaagt

SEQ ID NO: 9502 - protein, 7 aa, Artificial Sequence
  Description of Artificial Sequence: Synthetic peptide
AAFSLQS

SEQ ID NO: 9503 - DNA, 21 bp, Artificial Sequence
  Description of Artificial Sequence: Synthetic oligonucleotide
gttgcatccaccagggccact

SEQ ID NO: 9504 - protein, 7 aa, Artificial Sequence
  Description of Artificial Sequence: Synthetic peptide
VASTRAT

SEQ ID NO: 9505 - DNA, 21 bp, Artificial Sequence
  Description of Artificial Sequence: Synthetic oligonucleotide
cctgcatcccgtttgcaaagt

SEQ ID NO: 9506 - protein, 7 aa, Artificial Sequence
  Description of Artificial Sequence: Synthetic peptide
PASRLQS

SEQ ID NO: 9507 - DNA, 21 bp, Artificial Sequence
  Description of Artificial Sequence: Synthetic oligonucleotide
gctgcatccagtttgcaaagt

SEQ ID NO: 9508 - protein, 7 aa, Artificial Sequence
  Description of Artificial Sequence: Synthetic peptide
AASSLQS

SEQ ID NO: 9509 - DNA, 21 bp, Artificial Sequence
  Description of Artificial Sequence: Synthetic oligonucleotide
gctgcatccagtttgcaaggt

SEQ ID NO: 9510 - protein, 7 aa, Artificial Sequence
  Description of Artificial Sequence: Synthetic peptide
AASSLQG

SEQ ID NO: 9511 - DNA, 21 bp, Artificial Sequence
  Description of Artificial Sequence: Synthetic oligonucleotide
cctgcatccagtttgctaagt

SEQ ID NO: 9512 - protein, 7 aa, Artificial Sequence
  Description of Artificial Sequence: Synthetic peptide
PASSLLS

SEQ ID NO: 9513 - DNA, 21 bp, Artificial Sequence
  Description of Artificial Sequence: Synthetic oligonucleotide
gctgcatccagtttgcaaagt

SEQ ID NO: 9514 - protein, 7 aa, Artificial Sequence
  Description of Artificial Sequence: Synthetic peptide
AASSLQS

SEQ ID NO: 9515 - DNA, 21 bp, Artificial Sequence
  Description of Artificial Sequence: Synthetic oligonucleotide
gctgcatccagtttgcaaagt

SEQ ID NO: 9516 - protein, 7 aa, Artificial Sequence
  Description of Artificial Sequence: Synthetic peptide
AASSLQS

SEQ ID NO: 9517 - DNA, 21 bp, Artificial Sequence
  Description of Artificial Sequence: Synthetic oligonucleotide
ggtgcatccaccagggccact

SEQ ID NO: 9518 - protein, 7 aa, Artificial Sequence
  Description of Artificial Sequence: Synthetic peptide
GASTRAT

SEQ ID NO: 9519 - DNA, 21 bp, Artificial Sequence
  Description of Artificial Sequence: Synthetic oligonucleotide
gctgcatccagtttgctaagt

SEQ ID NO: 9520 - protein, 7 aa, Artificial Sequence
  Description of Artificial Sequence: Synthetic peptide
AASSLLS

SEQ ID NO: 9521 - DNA, 21 bp, Artificial Sequence
  Description of Artificial Sequence: Synthetic oligonucleotide
gctgcatccagtttgcaaagt

SEQ ID NO: 9522 - protein, 7 aa, Artificial Sequence
  Description of Artificial Sequence: Synthetic peptide
AASSLQS

SEQ ID NO: 9523 - DNA, 21 bp, Artificial Sequence
  Description of Artificial Sequence: Synthetic oligonucleotide
gctgcatccagtttgcaaagt

SEQ ID NO: 9524 - protein, 7 aa, Artificial Sequence
  Description of Artificial Sequence: Synthetic peptide
AASSLQS

SEQ ID NO: 9525 - DNA, 21 bp, Artificial Sequence
  Description of Artificial Sequence: Synthetic oligonucleotide
gctgcatccaatttgcaaagt

SEQ ID NO: 9526 - protein, 7 aa, Artificial Sequence
  Description of Artificial Sequence: Synthetic peptide
AASNLQS

SEQ ID NO: 9527 - DNA, 21 bp, Artificial Sequence
  Description of Artificial Sequence: Synthetic oligonucleotide
ggtgcatccaccagggccact

SEQ ID NO: 9528 - protein, 7 aa, Artificial Sequence
  Description of Artificial Sequence: Synthetic peptide
GASTRAT

SEQ ID NO: 9529 - DNA, 21 bp, Artificial Sequence
  Description of Artificial Sequence: Synthetic oligonucleotide
gctgcatccagtttgcaaagt

SEQ ID NO: 9530 - protein, 7 aa, Artificial Sequence
  Description of Artificial Sequence: Synthetic peptide
AASSLQS

SEQ ID NO: 9531 - DNA, 21 bp, Artificial Sequence
  Description of Artificial Sequence: Synthetic oligonucleotide
actgcatccagtttgcaaagt

SEQ ID NO: 9532 - protein, 7 aa, Artificial Sequence
  Description of Artificial Sequence: Synthetic peptide
TASSLQS

SEQ ID NO: 9533 - DNA, 21 bp, Artificial Sequence
  Description of Artificial Sequence: Synthetic oligonucleotide
tgggcatctacccgggcatcc

SEQ ID NO: 9534 - protein, 7 aa, Artificial Sequence
  Description of Artificial Sequence: Synthetic peptide
WASTRAS

SEQ ID NO: 9535 - DNA, 21 bp, Artificial Sequence
  Description of Artificial Sequence: Synthetic oligonucleotide
tgggcatctacccgggaatcc

SEQ ID NO: 9536 - protein, 7 aa, Artificial Sequence
  Description of Artificial Sequence: Synthetic peptide
WASTRES

SEQ ID NO: 9537 - DNA, 21 bp, Artificial Sequence
  Description of Artificial Sequence: Synthetic oligonucleotide
gctgcatctaccagggccact

SEQ ID NO: 9538 - protein, 7 aa, Artificial Sequence
  Description of Artificial Sequence: Synthetic peptide
AASTRAT

SEQ ID NO: 9539 - DNA, 21 bp, Artificial Sequence
  Description of Artificial Sequence: Synthetic oligonucleotide
gctgcatctaccagggccact

SEQ ID NO: 9540 - protein, 7 aa, Artificial Sequence
  Description of Artificial Sequence: Synthetic peptide
AASTRAT

SEQ ID NO: 9541 - DNA, 21 bp, Artificial Sequence
  Description of Artificial Sequence: Synthetic oligonucleotide
gctgcatccagtttgctaagt

SEQ ID NO: 9542 - protein, 7 aa, Artificial Sequence
  Description of Artificial Sequence: Synthetic peptide
AASSLLS

SEQ ID NO: 9543 - DNA, 21 bp, Artificial Sequence
  Description of Artificial Sequence: Synthetic oligonucleotide
tgggcatctacccgggattcc

SEQ ID NO: 9544 - protein, 7 aa, Artificial Sequence
  Description of Artificial Sequence: Synthetic peptide
WASTRDS

SEQ ID NO: 9545 - DNA, 21 bp, Artificial Sequence
  Description of Artificial Sequence: Synthetic oligonucleotide
ggtgcatccaccagggccact

SEQ ID NO: 9546 - protein, 7 aa, Artificial Sequence
  Description of Artificial Sequence: Synthetic peptide
GASTRAT

SEQ ID NO: 9547 - DNA, 21 bp, Artificial Sequence
  Description of Artificial Sequence: Synthetic oligonucleotide
gctgcatccagtttgcaaagt

SEQ ID NO: 9548 - protein, 7 aa, Artificial Sequence
  Description of Artificial Sequence: Synthetic peptide
AASSLQS

SEQ ID NO: 9549 - DNA, 21 bp, Artificial Sequence
  Description of Artificial Sequence: Synthetic oligonucleotide
ggtgtatccaccagggccact

SEQ ID NO: 9550 - protein, 7 aa, Artificial Sequence
  Description of Artificial Sequence: Synthetic peptide
GVSTRAT

SEQ ID NO: 9551 - DNA, 21 bp, Artificial Sequence
  Description of Artificial Sequence: Synthetic oligonucleotide
gaagtttcctatcggttttct

SEQ ID NO: 9552 - protein, 7 aa, Artificial Sequence
  Description of Artificial Sequence: Synthetic peptide
EVSYRFS

SEQ ID NO: 9553 - DNA, 21 bp, Artificial Sequence
  Description of Artificial Sequence: Synthetic oligonucleotide
tggtcatctacccgggaatcc

SEQ ID NO: 9554 - protein, 7 aa, Artificial Sequence
  Description of Artificial Sequence: Synthetic peptide
WSSTRES

SEQ ID NO: 9555 - DNA, 21 bp, Artificial Sequence
  Description of Artificial Sequence: Synthetic oligonucleotide
ggtgcatccagcagggccact

SEQ ID NO: 9556 - protein, 7 aa, Artificial Sequence
  Description of Artificial Sequence: Synthetic peptide
GASSRAT

SEQ ID NO: 9557 - DNA, 21 bp, Artificial Sequence
  Description of Artificial Sequence: Synthetic oligonucleotide
ggtgcatccagtttgcagagt

SEQ ID NO: 9558 - protein, 7 aa, Artificial Sequence
  Description of Artificial Sequence: Synthetic peptide
GASSLQS

SEQ ID NO: 9559 - DNA, 21 bp, Artificial Sequence
  Description of Artificial Sequence: Synthetic oligonucleotide
ggtgcatccagcagggccact

SEQ ID NO: 9560 - protein, 7 aa, Artificial Sequence
  Description of Artificial Sequence: Synthetic peptide
GASSRAT

SEQ ID NO: 9561 - DNA, 21 bp, Artificial Sequence
  Description of Artificial Sequence: Synthetic oligonucleotide
gctgcatccagtttgcaaagt

SEQ ID NO: 9562 - protein, 7 aa, Artificial Sequence
  Description of Artificial Sequence: Synthetic peptide
AASSLQS

SEQ ID NO: 9563 - DNA, 21 bp, Artificial Sequence
  Description of Artificial Sequence: Synthetic oligonucleotide
tctgcatccagtttacaaagt

SEQ ID NO: 9564 - protein, 7 aa, Artificial Sequence
  Description of Artificial Sequence: Synthetic peptide
SASSLQS

SEQ ID NO: 9565 - DNA, 21 bp, Artificial Sequence
  Description of Artificial Sequence: Synthetic oligonucleotide
gctgcatccagtttgcaaagt

SEQ ID NO: 9566 - protein, 7 aa, Artificial Sequence
  Description of Artificial Sequence: Synthetic peptide
AASSLQS

SEQ ID NO: 9567 - DNA, 21 bp, Artificial Sequence
  Description of Artificial Sequence: Synthetic oligonucleotide
gctgcatccagtttacaaagt

SEQ ID NO: 9568 - protein, 7 aa, Artificial Sequence
  Description of Artificial Sequence: Synthetic peptide
AASSLQS

SEQ ID NO: 9569 - DNA, 21 bp, Artificial Sequence
  Description of Artificial Sequence: Synthetic oligonucleotide
tgggcatctacccgggaatcc

SEQ ID NO: 9570 - protein, 7 aa, Artificial Sequence
  Description of Artificial Sequence: Synthetic peptide
WASTRES

SEQ ID NO: 9571 - DNA, 21 bp, Artificial Sequence
  Description of Artificial Sequence: Synthetic oligonucleotide
gcgtcatccagtttgcaaagt

SEQ ID NO: 9572 - protein, 7 aa, Artificial Sequence
  Description of Artificial Sequence: Synthetic peptide
ASSSLQS

SEQ ID NO: 9573 - DNA, 21 bp, Artificial Sequence
  Description of Artificial Sequence: Synthetic oligonucleotide
gatacatccactttgcaaact

SEQ ID NO: 9574 - protein, 7 aa, Artificial Sequence
  Description of Artificial Sequence: Synthetic peptide
DTSTLQT

SEQ ID NO: 9575 - DNA, 21 bp, Artificial Sequence
  Description of Artificial Sequence: Synthetic oligonucleotide
gctgcatccagtttgcaaagt

SEQ ID NO: 9576 - protein, 7 aa, Artificial Sequence
  Description of Artificial Sequence: Synthetic peptide
AASSLQS

SEQ ID NO: 9577 - DNA, 21 bp, Artificial Sequence
  Description of Artificial Sequence: Synthetic oligonucleotide
gctgcatccagtttgcaaagt

SEQ ID NO: 9578 - protein, 7 aa, Artificial Sequence
  Description of Artificial Sequence: Synthetic peptide
AASSLQS

SEQ ID NO: 9579 - DNA, 21 bp, Artificial Sequence
  Description of Artificial Sequence: Synthetic oligonucleotide
gctgcatccagtttacaaagt

SEQ ID NO: 9580 - protein, 7 aa, Artificial Sequence
  Description of Artificial Sequence: Synthetic peptide
AASSLQS

SEQ ID NO: 9581 - DNA, 21 bp, Artificial Sequence
  Description of Artificial Sequence: Synthetic oligonucleotide
gctgcatccagtttgcaaagt

SEQ ID NO: 9582 - protein, 7 aa, Artificial Sequence
  Description of Artificial Sequence: Synthetic peptide
AASSLQS

SEQ ID NO: 9583 - DNA, 21 bp, Artificial Sequence
  Description of Artificial Sequence: Synthetic oligonucleotide
gctgcatccagtttgcaaagt

SEQ ID NO: 9584 - protein, 7 aa, Artificial Sequence
  Description of Artificial Sequence: Synthetic peptide
AASSLQS

SEQ ID NO: 9585 - DNA, 21 bp, Artificial Sequence
  Description of Artificial Sequence: Synthetic oligonucleotide
ggtgcatccagtttgcaaagt

SEQ ID NO: 9586 - protein, 7 aa, Artificial Sequence
  Description of Artificial Sequence: Synthetic peptide
GASSLQS

SEQ ID NO: 9587 - DNA, 21 bp, Artificial Sequence
  Description of Artificial Sequence: Synthetic oligonucleotide
gctgcatccagtttgcaaagt

SEQ ID NO: 9588 - protein, 7 aa, Artificial Sequence
  Description of Artificial Sequence: Synthetic peptide
AASSLQS

SEQ ID NO: 9589 - DNA, 21 bp, Artificial Sequence
  Description of Artificial Sequence: Synthetic oligonucleotide
gaagtttccaaccggttgtgt

SEQ ID NO: 9590 - protein, 7 aa, Artificial Sequence
  Description of Artificial Sequence: Synthetic peptide
EVSNRLC

SEQ ID NO: 9591 - DNA, 21 bp, Artificial Sequence
  Description of Artificial Sequence: Synthetic oligonucleotide
gctgcatccagtttgcaaagt

SEQ ID NO: 9592 - protein, 7 aa, Artificial Sequence
  Description of Artificial Sequence: Synthetic peptide
AASSLQS

SEQ ID NO: 9593 - DNA, 21 bp, Artificial Sequence
  Description of Artificial Sequence: Synthetic oligonucleotide
actgcatccactttgcaaagt

SEQ ID NO: 9594 - protein, 7 aa, Artificial Sequence
  Description of Artificial Sequence: Synthetic peptide
TASTLQS

SEQ ID NO: 9595 - DNA, 21 bp, Artificial Sequence
  Description of Artificial Sequence: Synthetic oligonucleotide
gatgcatccattttggaaaca

SEQ ID NO: 9596 - protein, 7 aa, Artificial Sequence
  Description of Artificial Sequence: Synthetic peptide
DASILET

SEQ ID NO: 9597 - DNA, 21 bp, Artificial Sequence
  Description of Artificial Sequence: Synthetic oligonucleotide
gctgcatccagtttgcaaagt

SEQ ID NO: 9598 - protein, 7 aa, Artificial Sequence
  Description of Artificial Sequence: Synthetic peptide
AASSLQS

SEQ ID NO: 9599 - DNA, 21 bp, Artificial Sequence
  Description of Artificial Sequence: Synthetic oligonucleotide
agtgcatccaatttgcaatgt

SEQ ID NO: 9600 - protein, 7 aa, Artificial Sequence
  Description of Artificial Sequence: Synthetic peptide
SASNLQC

SEQ ID NO: 9601 - DNA, 21 bp, Artificial Sequence
  Description of Artificial Sequence: Synthetic oligonucleotide
gctgcatccagtttgcaaagt

SEQ ID NO: 9602 - protein, 7 aa, Artificial Sequence
  Description of Artificial Sequence: Synthetic peptide
AASSLQS

SEQ ID NO: 9603 - DNA, 21 bp, Artificial Sequence
  Description of Artificial Sequence: Synthetic oligonucleotide
gctgcatccagtttgcacagt

SEQ ID NO: 9604 - protein, 7 aa, Artificial Sequence
  Description of Artificial Sequence: Synthetic peptide
AASSLHS

SEQ ID NO: 9605 - DNA, 21 bp, Artificial Sequence
  Description of Artificial Sequence: Synthetic oligonucleotide
ggtgcatccaccagggccact

SEQ ID NO: 9606 - protein, 7 aa, Artificial Sequence
  Description of Artificial Sequence: Synthetic peptide
GASTRAT

SEQ ID NO: 9607 - DNA, 21 bp, Artificial Sequence
  Description of Artificial Sequence: Synthetic oligonucleotide
gctgcatccagtttgcaaagt

SEQ ID NO: 9608 - protein, 7 aa, Artificial Sequence
  Description of Artificial Sequence: Synthetic peptide
AASSLQS

SEQ ID NO: 9609 - DNA, 21 bp, Artificial Sequence
  Description of Artificial Sequence: Synthetic oligonucleotide
gctgcatccagtttgcaaagt

SEQ ID NO: 9610 - protein, 7 aa, Artificial Sequence
  Description of Artificial Sequence: Synthetic peptide
AASSLQS

SEQ ID NO: 9611 - DNA, 21 bp, Artificial Sequence
  Description of Artificial Sequence: Synthetic oligonucleotide
gctgcatccagtttgcaaagt

SEQ ID NO: 9612 - protein, 7 aa, Artificial Sequence
  Description of Artificial Sequence: Synthetic peptide
AASSLQS

SEQ ID NO: 9613 - DNA, 21 bp, Artificial Sequence
  Description of Artificial Sequence: Synthetic oligonucleotide
tgtgcatccaatttacaatgt

SEQ ID NO: 9614 - protein, 7 aa, Artificial Sequence
  Description of Artificial Sequence: Synthetic peptide
CASNLQC

SEQ ID NO: 9615 - DNA, 21 bp, Artificial Sequence
  Description of Artificial Sequence: Synthetic oligonucleotide
gctgcatccagtttacaaagt

SEQ ID NO: 9616 - protein, 7 aa, Artificial Sequence
  Description of Artificial Sequence: Synthetic peptide
AASSLQS

SEQ ID NO: 9617 - DNA, 21 bp, Artificial Sequence
  Description of Artificial Sequence: Synthetic oligonucleotide
actgcatccagtttacaaagt

SEQ ID NO: 9618 - protein, 7 aa, Artificial Sequence
  Description of Artificial Sequence: Synthetic peptide
TASSLQS

SEQ ID NO: 9619 - DNA, 21 bp, Artificial Sequence
  Description of Artificial Sequence: Synthetic oligonucleotide
cctgcatccagtttgcaaagt

SEQ ID NO: 9620 - protein, 7 aa, Artificial Sequence
  Description of Artificial Sequence: Synthetic peptide
PASSLQS

SEQ ID NO: 9621 - DNA, 21 bp, Artificial Sequence
  Description of Artificial Sequence: Synthetic oligonucleotide
gctgcatccagttgtcaaagt

SEQ ID NO: 9622 - protein, 7 aa, Artificial Sequence
  Description of Artificial Sequence: Synthetic peptide
AASSCQS

SEQ ID NO: 9623 - DNA, 21 bp, Artificial Sequence
  Description of Artificial Sequence: Synthetic oligonucleotide
gctgcatccagtttgcaaagt

SEQ ID NO: 9624 - protein, 7 aa, Artificial Sequence
  Description of Artificial Sequence: Synthetic peptide
AASSLQS

SEQ ID NO: 9625 - DNA, 21 bp, Artificial Sequence
  Description of Artificial Sequence: Synthetic oligonucleotide
attgcatccaccagggccact

SEQ ID NO: 9626 - protein, 7 aa, Artificial Sequence
  Description of Artificial Sequence: Synthetic peptide
IASTRAT

SEQ ID NO: 9627 - DNA, 21 bp, Artificial Sequence
  Description of Artificial Sequence: Synthetic oligonucleotide
gctgcatccagtttgcaaagt

SEQ ID NO: 9628 - protein, 7 aa, Artificial Sequence
  Description of Artificial Sequence: Synthetic peptide
AASSLQS

SEQ ID NO: 9629 - DNA, 21 bp, Artificial Sequence
  Description of Artificial Sequence: Synthetic oligonucleotide
gctgcatccagtttgcaaagt

SEQ ID NO: 9630 - protein, 7 aa, Artificial Sequence
  Description of Artificial Sequence: Synthetic peptide
AASSLQS

SEQ ID NO: 9631 - DNA, 21 bp, Artificial Sequence
  Description of Artificial Sequence: Synthetic oligonucleotide
gttgcatccagtttgcaaagt

SEQ ID NO: 9632 - protein, 7 aa, Artificial Sequence
  Description of Artificial Sequence: Synthetic peptide
VASSLQS

SEQ ID NO: 9633 - DNA, 21 bp, Artificial Sequence
  Description of Artificial Sequence: Synthetic oligonucleotide
gctgcatccagtgtgcaaagt

SEQ ID NO: 9634 - protein, 7 aa, Artificial Sequence
  Description of Artificial Sequence: Synthetic peptide
AASSVQS

SEQ ID NO: 9635 - DNA, 21 bp, Artificial Sequence
  Description of Artificial Sequence: Synthetic oligonucleotide
gctgcatccagtttgcaaagt

SEQ ID NO: 9636 - protein, 7 aa, Artificial Sequence
  Description of Artificial Sequence: Synthetic peptide
AASSLQS

SEQ ID NO: 9637 - DNA, 21 bp, Artificial Sequence
  Description of Artificial Sequence: Synthetic oligonucleotide
gctgcatccagtttgcaaagt

SEQ ID NO: 9638 - protein, 7 aa, Artificial Sequence
  Description of Artificial Sequence: Synthetic peptide
AASSLQS

SEQ ID NO: 9639 - DNA, 21 bp, Artificial Sequence
  Description of Artificial Sequence: Synthetic oligonucleotide
gttgcgtccagtttgcaaagt

SEQ ID NO: 9640 - protein, 7 aa, Artificial Sequence
  Description of Artificial Sequence: Synthetic peptide
VASSLQS

SEQ ID NO: 9641 - DNA, 21 bp, Artificial Sequence
  Description of Artificial Sequence: Synthetic oligonucleotide
gctgcatccagtttgcaaagt

SEQ ID NO: 9642 - protein, 7 aa, Artificial Sequence
  Description of Artificial Sequence: Synthetic peptide
AASSLQS

SEQ ID NO: 9643 - DNA, 21 bp, Artificial Sequence
  Description of Artificial Sequence: Synthetic oligonucleotide
attgcatccaccagggccact

SEQ ID NO: 9644 - protein, 7 aa, Artificial Sequence
  Description of Artificial Sequence: Synthetic peptide
IASTRAT

SEQ ID NO: 9645 - DNA, 21 bp, Artificial Sequence
  Description of Artificial Sequence: Synthetic oligonucleotide
gctgcatccagtttgcaaagt

SEQ ID NO: 9646 - protein, 7 aa, Artificial Sequence
  Description of Artificial Sequence: Synthetic peptide
AASSLQS

SEQ ID NO: 9647 - DNA, 21 bp, Artificial Sequence
  Description of Artificial Sequence: Synthetic oligonucleotide
actgcatccagtttgcaaagt

SEQ ID NO: 9648 - protein, 7 aa, Artificial Sequence
  Description of Artificial Sequence: Synthetic peptide
TASSLQS

SEQ ID NO: 9649 - DNA, 21 bp, Artificial Sequence
  Description of Artificial Sequence: Synthetic oligonucleotide
tgggcatctacccgggaatcc

SEQ ID NO: 9650 - protein, 7 aa, Artificial Sequence
  Description of Artificial Sequence: Synthetic peptide
WASTRES

SEQ ID NO: 9651 - DNA, 21 bp, Artificial Sequence
  Description of Artificial Sequence: Synthetic oligonucleotide
gctgcatccagtttgcaaagt

SEQ ID NO: 9652 - protein, 7 aa, Artificial Sequence
  Description of Artificial Sequence: Synthetic peptide
AASSLQS

SEQ ID NO: 9653 - DNA, 21 bp, Artificial Sequence
  Description of Artificial Sequence: Synthetic oligonucleotide
gctgcatccagtttgcaaagt

SEQ ID NO: 9654 - protein, 7 aa, Artificial Sequence
  Description of Artificial Sequence: Synthetic peptide
AASSLQS

SEQ ID NO: 9655 - DNA, 21 bp, Artificial Sequence
  Description of Artificial Sequence: Synthetic oligonucleotide
gctgcatccagtttgcaaagt

SEQ ID NO: 9656 - protein, 7 aa, Artificial Sequence
  Description of Artificial Sequence: Synthetic peptide
AASSLQS

SEQ ID NO: 9657 - DNA, 21 bp, Artificial Sequence
  Description of Artificial Sequence: Synthetic oligonucleotide
gctgcatccagtttgcaaagt

SEQ ID NO: 9658 - protein, 7 aa, Artificial Sequence
  Description of Artificial Sequence: Synthetic peptide
AASSLQS

SEQ ID NO: 9659 - DNA, 21 bp, Artificial Sequence
  Description of Artificial Sequence: Synthetic oligonucleotide
attgcattcagattgcaaatt

SEQ ID NO: 9660 - protein, 7 aa, Artificial Sequence
  Description of Artificial Sequence: Synthetic peptide
IAFRLQI

SEQ ID NO: 9661 - DNA, 21 bp, Artificial Sequence
  Description of Artificial Sequence: Synthetic oligonucleotide
tgggcatctacccgggaattc

SEQ ID NO: 9662 - protein, 7 aa, Artificial Sequence
  Description of Artificial Sequence: Synthetic peptide
WASTREF

SEQ ID NO: 9663 - DNA, 21 bp, Artificial Sequence
  Description of Artificial Sequence: Synthetic oligonucleotide
gctgcatccagtttgcaaagt

SEQ ID NO: 9664 - protein, 7 aa, Artificial Sequence
  Description of Artificial Sequence: Synthetic peptide
AASSLQS

SEQ ID NO: 9665 - DNA, 21 bp, Artificial Sequence
  Description of Artificial Sequence: Synthetic oligonucleotide
gctgcatccagtttacaaagt

SEQ ID NO: 9666 - protein, 7 aa, Artificial Sequence
  Description of Artificial Sequence: Synthetic peptide
AASSLQS

SEQ ID NO: 9667 - DNA, 21 bp, Artificial Sequence
  Description of Artificial Sequence: Synthetic oligonucleotide
gctgcatccagtttgcaaggt

SEQ ID NO: 9668 - protein, 7 aa, Artificial Sequence
  Description of Artificial Sequence: Synthetic peptide
AASSLQG

SEQ ID NO: 9669 - DNA, 21 bp, Artificial Sequence
  Description of Artificial Sequence: Synthetic oligonucleotide
gctgcatccagtttgcaaagt

SEQ ID NO: 9670 - protein, 7 aa, Artificial Sequence
  Description of Artificial Sequence: Synthetic peptide
AASSLQS

SEQ ID NO: 9671 - DNA, 21 bp, Artificial Sequence
  Description of Artificial Sequence: Synthetic oligonucleotide
gctgcatccagtttgcaaagt

SEQ ID NO: 9672 - protein, 7 aa, Artificial Sequence
  Description of Artificial Sequence: Synthetic peptide
AASSLQS

SEQ ID NO: 9673 - DNA, 21 bp, Artificial Sequence
  Description of Artificial Sequence: Synthetic oligonucleotide
ggtgcttccaatttgcaatct

SEQ ID NO: 9674 - protein, 7 aa, Artificial Sequence
  Description of Artificial Sequence: Synthetic peptide
GASNLQS

SEQ ID NO: 9675 - DNA, 21 bp, Artificial Sequence
  Description of Artificial Sequence: Synthetic oligonucleotide
gctgcatccagtttgcaaagt

SEQ ID NO: 9676 - protein, 7 aa, Artificial Sequence
  Description of Artificial Sequence: Synthetic peptide
AASSLQS

SEQ ID NO: 9677 - DNA, 21 bp, Artificial Sequence
  Description of Artificial Sequence: Synthetic oligonucleotide
gctgcatccagtttgcaaagt

SEQ ID NO: 9678 - protein, 7 aa, Artificial Sequence
  Description of Artificial Sequence: Synthetic peptide
AASSLQS

SEQ ID NO: 9679 - DNA, 21 bp, Artificial Sequence
  Description of Artificial Sequence: Synthetic oligonucleotide
gctgcatccaatttgcaaagt

SEQ ID NO: 9680 - protein, 7 aa, Artificial Sequence
  Description of Artificial Sequence: Synthetic peptide
AASNLQS

SEQ ID NO: 9681 - DNA, 21 bp, Artificial Sequence
  Description of Artificial Sequence: Synthetic oligonucleotide
gctgcatccagtttgcaaagt

SEQ ID NO: 9682 - protein, 7 aa, Artificial Sequence
  Description of Artificial Sequence: Synthetic peptide
AASSLQS

SEQ ID NO: 9683 - DNA, 21 bp, Artificial Sequence
  Description of Artificial Sequence: Synthetic oligonucleotide
gctgcatccagtttgcaaagt

SEQ ID NO: 9684 - protein, 7 aa, Artificial Sequence
  Description of Artificial Sequence: Synthetic peptide
AASSLQS

SEQ ID NO: 9685 - DNA, 21 bp, Artificial Sequence
  Description of Artificial Sequence: Synthetic oligonucleotide
ggtgcatccagcagggccact

SEQ ID NO: 9686 - protein, 7 aa, Artificial Sequence
  Description of Artificial Sequence: Synthetic peptide
GASSRAT

SEQ ID NO: 9687 - DNA, 21 bp, Artificial Sequence
  Description of Artificial Sequence: Synthetic oligonucleotide
ggtgcatccagcagggccact

SEQ ID NO: 9688 - protein, 7 aa, Artificial Sequence
  Description of Artificial Sequence: Synthetic peptide
GASSRAT

SEQ ID NO: 9689 - DNA, 21 bp, Artificial Sequence
  Description of Artificial Sequence: Synthetic oligonucleotide
tgggcatctacccgggaatcc

SEQ ID NO: 9690 - protein, 7 aa, Artificial Sequence
  Description of Artificial Sequence: Synthetic peptide
WASTRES

SEQ ID NO: 9691 - DNA, 21 bp, Artificial Sequence
  Description of Artificial Sequence: Synthetic oligonucleotide
tgggcatcaacccgggaatcc

SEQ ID NO: 9692 - protein, 7 aa, Artificial Sequence
  Description of Artificial Sequence: Synthetic peptide
WASTRES

SEQ ID NO: 9693 - DNA, 21 bp, Artificial Sequence
  Description of Artificial Sequence: Synthetic oligonucleotide
ggtgcatccaccagggccact

SEQ ID NO: 9694 - protein, 7 aa, Artificial Sequence
  Description of Artificial Sequence: Synthetic peptide
GASTRAT

SEQ ID NO: 9695 - DNA, 21 bp, Artificial Sequence
  Description of Artificial Sequence: Synthetic oligonucleotide
tgggcatctactcgggaatcc

SEQ ID NO: 9696 - protein, 7 aa, Artificial Sequence
  Description of Artificial Sequence: Synthetic peptide
WASTRES

SEQ ID NO: 9697 - DNA, 21 bp, Artificial Sequence
  Description of Artificial Sequence: Synthetic oligonucleotide
tgggcatctacccgggaatcc

SEQ ID NO: 9698 - protein, 7 aa, Artificial Sequence
  Description of Artificial Sequence: Synthetic peptide
WASTRES

SEQ ID NO: 9699 - DNA, 21 bp, Artificial Sequence
  Description of Artificial Sequence: Synthetic oligonucleotide
ggtgcatccaccagggccact

SEQ ID NO: 9700 - protein, 7 aa, Artificial Sequence
  Description of Artificial Sequence: Synthetic peptide
GASTRAT

SEQ ID NO: 9701 - DNA, 21 bp, Artificial Sequence
  Description of Artificial Sequence: Synthetic oligonucleotide
tgggcatctacccgggaatcc

SEQ ID NO: 9702 - protein, 7 aa, Artificial Sequence
  Description of Artificial Sequence: Synthetic peptide
WASTRES

SEQ ID NO: 9703 - DNA, 21 bp, Artificial Sequence
  Description of Artificial Sequence: Synthetic oligonucleotide
gctgcatccactttgcaaagt

SEQ ID NO: 9704 - protein, 7 aa, Artificial Sequence
  Description of Artificial Sequence: Synthetic peptide
AASTLQS

SEQ ID NO: 9705 - DNA, 21 bp, Artificial Sequence
  Description of Artificial Sequence: Synthetic oligonucleotide
tgggcatctacccgggaatcc

SEQ ID NO: 9706 - protein, 7 aa, Artificial Sequence
  Description of Artificial Sequence: Synthetic peptide
WASTRES

SEQ ID NO: 9707 - DNA, 21 bp, Artificial Sequence
  Description of Artificial Sequence: Synthetic oligonucleotide
ggtgcatccagcagggccact

SEQ ID NO: 9708 - protein, 7 aa, Artificial Sequence
  Description of Artificial Sequence: Synthetic peptide
GASSRAT

SEQ ID NO: 9709 - DNA, 21 bp, Artificial Sequence
  Description of Artificial Sequence: Synthetic oligonucleotide
ggtgcatccagccgggccact

SEQ ID NO: 9710 - protein, 7 aa, Artificial Sequence
  Description of Artificial Sequence: Synthetic peptide
GASSRAT

SEQ ID NO: 9711 - DNA, 21 bp, Artificial Sequence
  Description of Artificial Sequence: Synthetic oligonucleotide
ggtgcatccagccgggccact

SEQ ID NO: 9712 - protein, 7 aa, Artificial Sequence
  Description of Artificial Sequence: Synthetic peptide
GASSRAT

SEQ ID NO: 9713 - DNA, 21 bp, Artificial Sequence
  Description of Artificial Sequence: Synthetic oligonucleotide
gctgcatccagtttgcaaagt

SEQ ID NO: 9714 - protein, 7 aa, Artificial Sequence
  Description of Artificial Sequence: Synthetic peptide
AASSLQS

SEQ ID NO: 9715 - DNA, 21 bp, Artificial Sequence
  Description of Artificial Sequence: Synthetic oligonucleotide
ggtgcattcagcagggccact

SEQ ID NO: 9716 - protein, 7 aa, Artificial Sequence
  Description of Artificial Sequence: Synthetic peptide
GAFSRAT

SEQ ID NO: 9717 - DNA, 21 bp, Artificial Sequence
  Description of Artificial Sequence: Synthetic oligonucleotide
tggacatctacccgggaatcc

SEQ ID NO: 9718 - protein, 7 aa, Artificial Sequence
  Description of Artificial Sequence: Synthetic peptide
WTSTRES

SEQ ID NO: 9719 - DNA, 21 bp, Artificial Sequence
  Description of Artificial Sequence: Synthetic oligonucleotide
tgggcatctacccgggaatcc

SEQ ID NO: 9720 - protein, 7 aa, Artificial Sequence
  Description of Artificial Sequence: Synthetic peptide
WASTRES

SEQ ID NO: 9721 - DNA, 21 bp, Artificial Sequence
  Description of Artificial Sequence: Synthetic oligonucleotide
ggtgcatccaccagggccact

SEQ ID NO: 9722 - protein, 7 aa, Artificial Sequence
  Description of Artificial Sequence: Synthetic peptide
GASTRAT

SEQ ID NO: 9723 - DNA, 21 bp, Artificial Sequence
  Description of Artificial Sequence: Synthetic oligonucleotide
ggtgcatccaccagggccact

SEQ ID NO: 9724 - protein, 7 aa, Artificial Sequence
  Description of Artificial Sequence: Synthetic peptide
GASTRAT

SEQ ID NO: 9725 - DNA, 21 bp, Artificial Sequence
  Description of Artificial Sequence: Synthetic oligonucleotide
ggtgcatccagcagggcccct

SEQ ID NO: 9726 - protein, 7 aa, Artificial Sequence
  Description of Artificial Sequence: Synthetic peptide
GASSRAP

SEQ ID NO: 9727 - DNA, 21 bp, Artificial Sequence
  Description of Artificial Sequence: Synthetic oligonucleotide
ggtgcatccagcagggccact

SEQ ID NO: 9728 - protein, 7 aa, Artificial Sequence
  Description of Artificial Sequence: Synthetic peptide
GASSRAT

SEQ ID NO: 9729 - DNA, 21 bp, Artificial Sequence
  Description of Artificial Sequence: Synthetic oligonucleotide
ggtgcatccagcagggccact

SEQ ID NO: 9730 - protein, 7 aa, Artificial Sequence
  Description of Artificial Sequence: Synthetic peptide
GASSRAT

SEQ ID NO: 9731 - DNA, 21 bp, Artificial Sequence
  Description of Artificial Sequence: Synthetic oligonucleotide
tggacatctacccgggaatcc

SEQ ID NO: 9732 - protein, 7 aa, Artificial Sequence
  Description of Artificial Sequence: Synthetic peptide
WTSTRES

SEQ ID NO: 9733 - DNA, 21 bp, Artificial Sequence
  Description of Artificial Sequence: Synthetic oligonucleotide
ggtgcatccaccagggccact

SEQ ID NO: 9734 - protein, 7 aa, Artificial Sequence
  Description of Artificial Sequence: Synthetic peptide
GASTRAT

SEQ ID NO: 9735 - DNA, 21 bp, Artificial Sequence
  Description of Artificial Sequence: Synthetic oligonucleotide
ggtgcatccagcagggccact

SEQ ID NO: 9736 - protein, 7 aa, Artificial Sequence
  Description of Artificial Sequence: Synthetic peptide
GASSRAT

SEQ ID NO: 9737 - DNA, 21 bp, Artificial Sequence
  Description of Artificial Sequence: Synthetic oligonucleotide
ggtgcatccagcagggccact

SEQ ID NO: 9738 - protein, 7 aa, Artificial Sequence
  Description of Artificial Sequence: Synthetic peptide
GASSRAT

SEQ ID NO: 9739 - DNA, 21 bp, Artificial Sequence
  Description of Artificial Sequence: Synthetic oligonucleotide
actacatccaatttacaaagt

SEQ ID NO: 9740 - protein, 7 aa, Artificial Sequence
  Description of Artificial Sequence: Synthetic peptide
TTSNLQS

SEQ ID NO: 9741 - DNA, 21 bp, Artificial Sequence
  Description of Artificial Sequence: Synthetic oligonucleotide
ggtgcatccaccagggccact

SEQ ID NO: 9742 - protein, 7 aa, Artificial Sequence
  Description of Artificial Sequence: Synthetic peptide
GASTRAT

SEQ ID NO: 9743 - DNA, 21 bp, Artificial Sequence
  Description of Artificial Sequence: Synthetic oligonucleotide
ttgggttctaatcgggcctcc

SEQ ID NO: 9744 - protein, 7 aa, Artificial Sequence
  Description of Artificial Sequence: Synthetic peptide
LGSNRAS

SEQ ID NO: 9745 - DNA, 21 bp, Artificial Sequence
  Description of Artificial Sequence: Synthetic oligonucleotide
ggtgcatccagcagggccact

SEQ ID NO: 9746 - protein, 7 aa, Artificial Sequence
  Description of Artificial Sequence: Synthetic peptide
GASSRAT

SEQ ID NO: 9747 - DNA, 21 bp, Artificial Sequence
  Description of Artificial Sequence: Synthetic oligonucleotide
tgggcttctacccgggaatcc

SEQ ID NO: 9748 - protein, 7 aa, Artificial Sequence
  Description of Artificial Sequence: Synthetic peptide
WASTRES

SEQ ID NO: 9749 - DNA, 21 bp, Artificial Sequence
  Description of Artificial Sequence: Synthetic oligonucleotide
tgggcatctacccgggaatcc

SEQ ID NO: 9750 - protein, 7 aa, Artificial Sequence
  Description of Artificial Sequence: Synthetic peptide
WASTRES

SEQ ID NO: 9751 - DNA, 21 bp, Artificial Sequence
  Description of Artificial Sequence: Synthetic oligonucleotide
ggtgcatccagccgggccact

SEQ ID NO: 9752 - protein, 7 aa, Artificial Sequence
  Description of Artificial Sequence: Synthetic peptide
GASSRAT

SEQ ID NO: 9753 - DNA, 21 bp, Artificial Sequence
  Description of Artificial Sequence: Synthetic oligonucleotide
ggtgcatccagccgggccact

SEQ ID NO: 9754 - protein, 7 aa, Artificial Sequence
  Description of Artificial Sequence: Synthetic peptide
GASSRAT

SEQ ID NO: 9755 - DNA, 21 bp, Artificial Sequence
  Description of Artificial Sequence: Synthetic oligonucleotide
ttgggttctaatcgggcctcc

SEQ ID NO: 9756 - protein, 7 aa, Artificial Sequence
  Description of Artificial Sequence: Synthetic peptide
LGSNRAS

SEQ ID NO: 9757 - DNA, 21 bp, Artificial Sequence
  Description of Artificial Sequence: Synthetic oligonucleotide
ggtgcaaccagcagggccact

SEQ ID NO: 9758 - protein, 7 aa, Artificial Sequence
  Description of Artificial Sequence: Synthetic peptide
GATSRAT

SEQ ID NO: 9759 - DNA, 21 bp, Artificial Sequence
  Description of Artificial Sequence: Synthetic oligonucleotide
ggtgcatccaccagggccact

SEQ ID NO: 9760 - protein, 7 aa, Artificial Sequence
  Description of Artificial Sequence: Synthetic peptide
GASTRAT

SEQ ID NO: 9761 - DNA, 21 bp, Artificial Sequence
  Description of Artificial Sequence: Synthetic oligonucleotide
ggtgcatccagcagggcccct

SEQ ID NO: 9762 - protein, 7 aa, Artificial Sequence
  Description of Artificial Sequence: Synthetic peptide
GASSRAP

SEQ ID NO: 9763 - DNA, 21 bp, Artificial Sequence
  Description of Artificial Sequence: Synthetic oligonucleotide
gctgcatccagtttgcaaggt

SEQ ID NO: 9764 - protein, 7 aa, Artificial Sequence
  Description of Artificial Sequence: Synthetic peptide
AASSLQG

SEQ ID NO: 9765 - DNA, 21 bp, Artificial Sequence
  Description of Artificial Sequence: Synthetic oligonucleotide
tggacatctacccgggaatcc

SEQ ID NO: 9766 - protein, 7 aa, Artificial Sequence
  Description of Artificial Sequence: Synthetic peptide
WTSTRES

SEQ ID NO: 9767 - DNA, 21 bp, Artificial Sequence
  Description of Artificial Sequence: Synthetic oligonucleotide
ggtgcatccagccgggccact

SEQ ID NO: 9768 - protein, 7 aa, Artificial Sequence
  Description of Artificial Sequence: Synthetic peptide
GASSRAT

SEQ ID NO: 9769 - DNA, 21 bp, Artificial Sequence
  Description of Artificial Sequence: Synthetic oligonucleotide
ggtgcatccagccggtccact

SEQ ID NO: 9770 - protein, 7 aa, Artificial Sequence
  Description of Artificial Sequence: Synthetic peptide
GASSRST

SEQ ID NO: 9771 - DNA, 21 bp, Artificial Sequence
  Description of Artificial Sequence: Synthetic oligonucleotide
ggtgcatccaccagggccact

SEQ ID NO: 9772 - protein, 7 aa, Artificial Sequence
  Description of Artificial Sequence: Synthetic peptide
GASTRAT

SEQ ID NO: 9773 - DNA, 21 bp, Artificial Sequence
  Description of Artificial Sequence: Synthetic oligonucleotide
ggtgcatccagcagggccact

SEQ ID NO: 9774 - protein, 7 aa, Artificial Sequence
  Description of Artificial Sequence: Synthetic peptide
GASSRAT

SEQ ID NO: 9775 - DNA, 21 bp, Artificial Sequence
  Description of Artificial Sequence: Synthetic oligonucleotide
ggtgcatccaccagggccact

SEQ ID NO: 9776 - protein, 7 aa, Artificial Sequence
  Description of Artificial Sequence: Synthetic peptide
GASTRAT

SEQ ID NO: 9777 - DNA, 21 bp, Artificial Sequence
  Description of Artificial Sequence: Synthetic oligonucleotide
ggtgcatccagcagggccact

SEQ ID NO: 9778 - protein, 7 aa, Artificial Sequence
  Description of Artificial Sequence: Synthetic peptide
GASSRAT

SEQ ID NO: 9779 - DNA, 21 bp, Artificial Sequence
  Description of Artificial Sequence: Synthetic oligonucleotide
tgggcatctacccgggaatcc

SEQ ID NO: 9780 - protein, 7 aa, Artificial Sequence
  Description of Artificial Sequence: Synthetic peptide
WASTRES

SEQ ID NO: 9781 - DNA, 21 bp, Artificial Sequence
  Description of Artificial Sequence: Synthetic oligonucleotide
ggtgcatccaccagggccact

SEQ ID NO: 9782 - protein, 7 aa, Artificial Sequence
  Description of Artificial Sequence: Synthetic peptide
GASTRAT

SEQ ID NO: 9783 - DNA, 21 bp, Artificial Sequence
  Description of Artificial Sequence: Synthetic oligonucleotide
ggtgcatccagcagggccact

SEQ ID NO: 9784 - protein, 7 aa, Artificial Sequence
  Description of Artificial Sequence: Synthetic peptide
GASSRAT

SEQ ID NO: 9785 - DNA, 21 bp, Artificial Sequence
  Description of Artificial Sequence: Synthetic oligonucleotide
tgggcatctacccgggattcc

SEQ ID NO: 9786 - protein, 7 aa, Artificial Sequence
  Description of Artificial Sequence: Synthetic peptide
WASTRDS

SEQ ID NO: 9787 - DNA, 21 bp, Artificial Sequence
  Description of Artificial Sequence: Synthetic oligonucleotide
gctgcatccagtttgcaaagt

SEQ ID NO: 9788 - protein, 7 aa, Artificial Sequence
  Description of Artificial Sequence: Synthetic peptide
AASSLQS

SEQ ID NO: 9789 - DNA, 21 bp, Artificial Sequence
  Description of Artificial Sequence: Synthetic oligonucleotide
tgggcatctacccgggaatcc

SEQ ID NO: 9790 - protein, 7 aa, Artificial Sequence
  Description of Artificial Sequence: Synthetic peptide
WASTRES

SEQ ID NO: 9791 - DNA, 21 bp, Artificial Sequence
  Description of Artificial Sequence: Synthetic oligonucleotide
tgggcatctacccgggaatcc

SEQ ID NO: 9792 - protein, 7 aa, Artificial Sequence
  Description of Artificial Sequence: Synthetic peptide
WASTRES

SEQ ID NO: 9793 - DNA, 21 bp, Artificial Sequence
  Description of Artificial Sequence: Synthetic oligonucleotide
ggtgcatccatcagggccact

SEQ ID NO: 9794 - protein, 7 aa, Artificial Sequence
  Description of Artificial Sequence: Synthetic peptide
GASIRAT

SEQ ID NO: 9795 - DNA, 21 bp, Artificial Sequence
  Description of Artificial Sequence: Synthetic oligonucleotide
ggtacatccaccagggccact

SEQ ID NO: 9796 - protein, 7 aa, Artificial Sequence
  Description of Artificial Sequence: Synthetic peptide
GTSTRAT

SEQ ID NO: 9797 - DNA, 21 bp, Artificial Sequence
  Description of Artificial Sequence: Synthetic oligonucleotide
ggtacttccagcagggccact

SEQ ID NO: 9798 - protein, 7 aa, Artificial Sequence
  Description of Artificial Sequence: Synthetic peptide
GTSSRAT

SEQ ID NO: 9799 - DNA, 21 bp, Artificial Sequence
  Description of Artificial Sequence: Synthetic oligonucleotide
tgggcatctatccgggaatcc

SEQ ID NO: 9800 - protein, 7 aa, Artificial Sequence
  Description of Artificial Sequence: Synthetic peptide
WASIRES

SEQ ID NO: 9801 - DNA, 21 bp, Artificial Sequence
  Description of Artificial Sequence: Synthetic oligonucleotide
ggtgcatccagcagggccact

SEQ ID NO: 9802 - protein, 7 aa, Artificial Sequence
  Description of Artificial Sequence: Synthetic peptide
GASSRAT

SEQ ID NO: 9803 - DNA, 21 bp, Artificial Sequence
  Description of Artificial Sequence: Synthetic oligonucleotide
tggacatctacccgggaatcc

SEQ ID NO: 9804 - protein, 7 aa, Artificial Sequence
  Description of Artificial Sequence: Synthetic peptide
WTSTRES

SEQ ID NO: 9805 - DNA, 21 bp, Artificial Sequence
  Description of Artificial Sequence: Synthetic oligonucleotide
tgggcatctacccgggaatcc

SEQ ID NO: 9806 - protein, 7 aa, Artificial Sequence
  Description of Artificial Sequence: Synthetic peptide
WASTRES

SEQ ID NO: 9807 - DNA, 21 bp, Artificial Sequence
  Description of Artificial Sequence: Synthetic oligonucleotide
tgggcatctacccgggaatcc

SEQ ID NO: 9808 - protein, 7 aa, Artificial Sequence
  Description of Artificial Sequence: Synthetic peptide
WASTRES

SEQ ID NO: 9809 - DNA, 21 bp, Artificial Sequence
  Description of Artificial Sequence: Synthetic oligonucleotide
tggacatctacccgggaatcc

SEQ ID NO: 9810 - protein, 7 aa, Artificial Sequence
  Description of Artificial Sequence: Synthetic peptide
WTSTRES

SEQ ID NO: 9811 - DNA, 21 bp, Artificial Sequence
  Description of Artificial Sequence: Synthetic oligonucleotide
ggtgcatccagccggtccact

SEQ ID NO: 9812 - protein, 7 aa, Artificial Sequence
  Description of Artificial Sequence: Synthetic peptide
GASSRST

SEQ ID NO: 9813 - DNA, 21 bp, Artificial Sequence
  Description of Artificial Sequence: Synthetic oligonucleotide
ggtgcatccagccggtccact

SEQ ID NO: 9814 - protein, 7 aa, Artificial Sequence
  Description of Artificial Sequence: Synthetic peptide
GASSRST

SEQ ID NO: 9815 - DNA, 21 bp, Artificial Sequence
  Description of Artificial Sequence: Synthetic oligonucleotide
tgggcatctacccgggaatcc

SEQ ID NO: 9816 - protein, 7 aa, Artificial Sequence
  Description of Artificial Sequence: Synthetic peptide
WASTRES

SEQ ID NO: 9817 - DNA, 21 bp, Artificial Sequence
  Description of Artificial Sequence: Synthetic oligonucleotide
gctgcatccagtttgcaaggt

SEQ ID NO: 9818 - protein, 7 aa, Artificial Sequence
  Description of Artificial Sequence: Synthetic peptide
AASSLQG

SEQ ID NO: 9819 - DNA, 21 bp, Artificial Sequence
  Description of Artificial Sequence: Synthetic oligonucleotide
ggtgcatccagcagggccact

SEQ ID NO: 9820 - protein, 7 aa, Artificial Sequence
  Description of Artificial Sequence: Synthetic peptide
GASSRAT

SEQ ID NO: 9821 - DNA, 21 bp, Artificial Sequence
  Description of Artificial Sequence: Synthetic oligonucleotide
ggtgcatccaccagggccact

SEQ ID NO: 9822 - protein, 7 aa, Artificial Sequence
  Description of Artificial Sequence: Synthetic peptide
GASTRAT

SEQ ID NO: 9823 - DNA, 21 bp, Artificial Sequence
  Description of Artificial Sequence: Synthetic oligonucleotide
tgggcatctacttgggaatcc

SEQ ID NO: 9824 - protein, 7 aa, Artificial Sequence
  Description of Artificial Sequence: Synthetic peptide
WASTWES

SEQ ID NO: 9825 - DNA, 21 bp, Artificial Sequence
  Description of Artificial Sequence: Synthetic oligonucleotide
tgggcatctatccgggaatcc

SEQ ID NO: 9826 - protein, 7 aa, Artificial Sequence
  Description of Artificial Sequence: Synthetic peptide
WASIRES

SEQ ID NO: 9827 - DNA, 21 bp, Artificial Sequence
  Description of Artificial Sequence: Synthetic oligonucleotide
tgggcatctacccgggaatcc

SEQ ID NO: 9828 - protein, 7 aa, Artificial Sequence
  Description of Artificial Sequence: Synthetic peptide
WASTRES

SEQ ID NO: 9829 - DNA, 21 bp, Artificial Sequence
  Description of Artificial Sequence: Synthetic oligonucleotide
ggtgcatccagccgggccact

SEQ ID NO: 9830 - protein, 7 aa, Artificial Sequence
  Description of Artificial Sequence: Synthetic peptide
GASSRAT

SEQ ID NO: 9831 - DNA, 21 bp, Artificial Sequence
  Description of Artificial Sequence: Synthetic oligonucleotide
tgggcatctacccgggaatcc

SEQ ID NO: 9832 - protein, 7 aa, Artificial Sequence
  Description of Artificial Sequence: Synthetic peptide
WASTRES

SEQ ID NO: 9833 - DNA, 21 bp, Artificial Sequence
  Description of Artificial Sequence: Synthetic oligonucleotide
ggtgcatccagcagggccact

SEQ ID NO: 9834 - protein, 7 aa, Artificial Sequence
  Description of Artificial Sequence: Synthetic peptide
GASSRAT

SEQ ID NO: 9835 - DNA, 21 bp, Artificial Sequence
  Description of Artificial Sequence: Synthetic oligonucleotide
ggtgcatccagccgggccact

SEQ ID NO: 9836 - protein, 7 aa, Artificial Sequence
  Description of Artificial Sequence: Synthetic peptide
GASSRAT

SEQ ID NO: 9837 - DNA, 21 bp, Artificial Sequence
  Description of Artificial Sequence: Synthetic oligonucleotide
tgggcatctacccgggaatcc

SEQ ID NO: 9838 - protein, 7 aa, Artificial Sequence
  Description of Artificial Sequence: Synthetic peptide
WASTRES

SEQ ID NO: 9839 - DNA, 21 bp, Artificial Sequence
  Description of Artificial Sequence: Synthetic oligonucleotide
ggtgcatccagccggtccact

SEQ ID NO: 9840 - protein, 7 aa, Artificial Sequence
  Description of Artificial Sequence: Synthetic peptide
GASSRST

SEQ ID NO: 9841 - DNA, 21 bp, Artificial Sequence
  Description of Artificial Sequence: Synthetic oligonucleotide
ggtgcatccagccggtccact

SEQ ID NO: 9842 - protein, 7 aa, Artificial Sequence
  Description of Artificial Sequence: Synthetic peptide
GASSRST

SEQ ID NO: 9843 - DNA, 21 bp, Artificial Sequence
  Description of Artificial Sequence: Synthetic oligonucleotide
ggtgcatccagccggtccact

SEQ ID NO: 9844 - protein, 7 aa, Artificial Sequence
  Description of Artificial Sequence: Synthetic peptide
GASSRST

SEQ ID NO: 9845 - DNA, 21 bp, Artificial Sequence
  Description of Artificial Sequence: Synthetic oligonucleotide
ggtgcatccaccagggccact

SEQ ID NO: 9846 - protein, 7 aa, Artificial Sequence
  Description of Artificial Sequence: Synthetic peptide
GASTRAT

SEQ ID NO: 9847 - DNA, 21 bp, Artificial Sequence
  Description of Artificial Sequence: Synthetic oligonucleotide
tgggcatctacccgggaatcc

SEQ ID NO: 9848 - protein, 7 aa, Artificial Sequence
  Description of Artificial Sequence: Synthetic peptide
WASTRES

SEQ ID NO: 9849 - DNA, 21 bp, Artificial Sequence
  Description of Artificial Sequence: Synthetic oligonucleotide
ggtgcatccagccggtccact

SEQ ID NO: 9850 - protein, 7 aa, Artificial Sequence
  Description of Artificial Sequence: Synthetic peptide
GASSRST

SEQ ID NO: 9851 - DNA, 21 bp, Artificial Sequence
  Description of Artificial Sequence: Synthetic oligonucleotide
tgggcatctacccgggaatcc

SEQ ID NO: 9852 - protein, 7 aa, Artificial Sequence
  Description of Artificial Sequence: Synthetic peptide
WASTRES

SEQ ID NO: 9853 - DNA, 21 bp, Artificial Sequence
  Description of Artificial Sequence: Synthetic oligonucleotide
ggtgcatccagcagggccact

SEQ ID NO: 9854 - protein, 7 aa, Artificial Sequence
  Description of Artificial Sequence: Synthetic peptide
GASSRAT

SEQ ID NO: 9855 - DNA, 21 bp, Artificial Sequence
  Description of Artificial Sequence: Synthetic oligonucleotide
ggtgcatccagcagggcccct

SEQ ID NO: 9856 - protein, 7 aa, Artificial Sequence
  Description of Artificial Sequence: Synthetic peptide
GASSRAP

SEQ ID NO: 9857 - DNA, 21 bp, Artificial Sequence
  Description of Artificial Sequence: Synthetic oligonucleotide
ggtgcatccagcagggccact

SEQ ID NO: 9858 - protein, 7 aa, Artificial Sequence
  Description of Artificial Sequence: Synthetic peptide
GASSRAT

SEQ ID NO: 9859 - DNA, 21 bp, Artificial Sequence
  Description of Artificial Sequence: Synthetic oligonucleotide
tgggcatctacccgggaatcc

SEQ ID NO: 9860 - protein, 7 aa, Artificial Sequence
  Description of Artificial Sequence: Synthetic peptide
WASTRES

SEQ ID NO: 9861 - DNA, 21 bp, Artificial Sequence
  Description of Artificial Sequence: Synthetic oligonucleotide
tgggcatctacccgggaatcc

SEQ ID NO: 9862 - protein, 7 aa, Artificial Sequence
  Description of Artificial Sequence: Synthetic peptide
WASTRES

SEQ ID NO: 9863 - DNA, 21 bp, Artificial Sequence
  Description of Artificial Sequence: Synthetic oligonucleotide
ggtgcatccagcagggcccct

SEQ ID NO: 9864 - protein, 7 aa, Artificial Sequence
  Description of Artificial Sequence: Synthetic peptide
GASSRAP

SEQ ID NO: 9865 - DNA, 21 bp, Artificial Sequence
  Description of Artificial Sequence: Synthetic oligonucleotide
actacatccagtttgcaaagt

SEQ ID NO: 9866 - protein, 7 aa, Artificial Sequence
  Description of Artificial Sequence: Synthetic peptide
TTSSLQS

SEQ ID NO: 9867 - DNA, 21 bp, Artificial Sequence
  Description of Artificial Sequence: Synthetic oligonucleotide
actgcatccagtttgcaaagt

SEQ ID NO: 9868 - protein, 7 aa, Artificial Sequence
  Description of Artificial Sequence: Synthetic peptide
TASSLQS

SEQ ID NO: 9869 - DNA, 21 bp, Artificial Sequence
  Description of Artificial Sequence: Synthetic oligonucleotide
ggtgcatccagccggtccact

SEQ ID NO: 9870 - protein, 7 aa, Artificial Sequence
  Description of Artificial Sequence: Synthetic peptide
GASSRST

SEQ ID NO: 9871 - DNA, 21 bp, Artificial Sequence
  Description of Artificial Sequence: Synthetic oligonucleotide
ggtgcatccaccagggccact

SEQ ID NO: 9872 - protein, 7 aa, Artificial Sequence
  Description of Artificial Sequence: Synthetic peptide
GASTRAT

SEQ ID NO: 9873 - DNA, 21 bp, Artificial Sequence
  Description of Artificial Sequence: Synthetic oligonucleotide
ggtgcatccagccggtccact

SEQ ID NO: 9874 - protein, 7 aa, Artificial Sequence
  Description of Artificial Sequence: Synthetic peptide
GASSRST

SEQ ID NO: 9875 - DNA, 21 bp, Artificial Sequence
  Description of Artificial Sequence: Synthetic oligonucleotide
ggtgcatccagccggtccact

SEQ ID NO: 9876 - protein, 7 aa, Artificial Sequence
  Description of Artificial Sequence: Synthetic peptide
GASSRST

SEQ ID NO: 9877 - DNA, 21 bp, Artificial Sequence
  Description of Artificial Sequence: Synthetic oligonucleotide
tgggcatctacccgggaatcc

SEQ ID NO: 9878 - protein, 7 aa, Artificial Sequence
  Description of Artificial Sequence: Synthetic peptide
WASTRES

SEQ ID NO: 9879 - DNA, 21 bp, Artificial Sequence
  Description of Artificial Sequence: Synthetic oligonucleotide
tgggcatctacccgggaatcc

SEQ ID NO: 9880 - protein, 7 aa, Artificial Sequence
  Description of Artificial Sequence: Synthetic peptide
WASTRES

SEQ ID NO: 9881 - DNA, 21 bp, Artificial Sequence
  Description of Artificial Sequence: Synthetic oligonucleotide
ggtgcatccagcagggccact

SEQ ID NO: 9882 - protein, 7 aa, Artificial Sequence
  Description of Artificial Sequence: Synthetic peptide
GASSRAT

SEQ ID NO: 9883 - DNA, 21 bp, Artificial Sequence
  Description of Artificial Sequence: Synthetic oligonucleotide
ggtgcatccagccggtccact

SEQ ID NO: 9884 - protein, 7 aa, Artificial Sequence
  Description of Artificial Sequence: Synthetic peptide
GASSRST

SEQ ID NO: 9885 - DNA, 21 bp, Artificial Sequence
  Description of Artificial Sequence: Synthetic oligonucleotide
ggtgcatccaccagggccact

SEQ ID NO: 9886 - protein, 7 aa, Artificial Sequence
  Description of Artificial Sequence: Synthetic peptide
GASTRAT

SEQ ID NO: 9887 - DNA, 21 bp, Artificial Sequence
  Description of Artificial Sequence: Synthetic oligonucleotide
ggtgcatccaccagggccact

SEQ ID NO: 9888 - protein, 7 aa, Artificial Sequence
  Description of Artificial Sequence: Synthetic peptide
GASTRAT

SEQ ID NO: 9889 - DNA, 21 bp, Artificial Sequence
  Description of Artificial Sequence: Synthetic oligonucleotide
ggtgcatccaccagggccact

SEQ ID NO: 9890 - protein, 7 aa, Artificial Sequence
  Description of Artificial Sequence: Synthetic peptide
GASTRAT

SEQ ID NO: 9891 - DNA, 21 bp, Artificial Sequence
  Description of Artificial Sequence: Synthetic oligonucleotide
ggtgcatccagccggtccact

SEQ ID NO: 9892 - protein, 7 aa, Artificial Sequence
  Description of Artificial Sequence: Synthetic peptide
GASSRST

SEQ ID NO: 9893 - DNA, 21 bp, Artificial Sequence
  Description of Artificial Sequence: Synthetic oligonucleotide
ggtgcatccaccagggcctct

SEQ ID NO: 9894 - protein, 7 aa, Artificial Sequence
  Description of Artificial Sequence: Synthetic peptide
GASTRAS

SEQ ID NO: 9895 - DNA, 21 bp, Artificial Sequence
  Description of Artificial Sequence: Synthetic oligonucleotide
gctgcatccagtttgcaaagt

SEQ ID NO: 9896 - protein, 7 aa, Artificial Sequence
  Description of Artificial Sequence: Synthetic peptide
AASSLQS

SEQ ID NO: 9897 - DNA, 21 bp, Artificial Sequence
  Description of Artificial Sequence: Synthetic oligonucleotide
ggtgcatccagccggtccacg

SEQ ID NO: 9898 - protein, 7 aa, Artificial Sequence
  Description of Artificial Sequence: Synthetic peptide
GASSRST

SEQ ID NO: 9899 - DNA, 21 bp, Artificial Sequence
  Description of Artificial Sequence: Synthetic oligonucleotide
ggtgcatccaccagggccact

SEQ ID NO: 9900 - protein, 7 aa, Artificial Sequence
  Description of Artificial Sequence: Synthetic peptide
GASTRAT

SEQ ID NO: 9901 - DNA, 21 bp, Artificial Sequence
  Description of Artificial Sequence: Synthetic oligonucleotide
tgggcatctacccgggaatcc

SEQ ID NO: 9902 - protein, 7 aa, Artificial Sequence
  Description of Artificial Sequence: Synthetic peptide
WASTRES

SEQ ID NO: 9903 - DNA, 21 bp, Artificial Sequence
  Description of Artificial Sequence: Synthetic oligonucleotide
tgggcatctacccgggaatcc

SEQ ID NO: 9904 - protein, 7 aa, Artificial Sequence
  Description of Artificial Sequence: Synthetic peptide
WASTRES

SEQ ID NO: 9905 - DNA, 21 bp, Artificial Sequence
  Description of Artificial Sequence: Synthetic oligonucleotide
ggtgcatccaccagggccact

SEQ ID NO: 9906 - protein, 7 aa, Artificial Sequence
  Description of Artificial Sequence: Synthetic peptide
GASTRAT

SEQ ID NO: 9907 - DNA, 21 bp, Artificial Sequence
  Description of Artificial Sequence: Synthetic oligonucleotide
ggtgcatccagcaggacccct

SEQ ID NO: 9908 - protein, 7 aa, Artificial Sequence
  Description of Artificial Sequence: Synthetic peptide
GASSRTP

SEQ ID NO: 9909 - DNA, 21 bp, Artificial Sequence
  Description of Artificial Sequence: Synthetic oligonucleotide
ggtgcatccagccggtccact

SEQ ID NO: 9910 - protein, 7 aa, Artificial Sequence
  Description of Artificial Sequence: Synthetic peptide
GASSRST

SEQ ID NO: 9911 - DNA, 21 bp, Artificial Sequence
  Description of Artificial Sequence: Synthetic oligonucleotide
tggacatctacccgggaatcc

SEQ ID NO: 9912 - protein, 7 aa, Artificial Sequence
  Description of Artificial Sequence: Synthetic peptide
WTSTRES

SEQ ID NO: 9913 - DNA, 21 bp, Artificial Sequence
  Description of Artificial Sequence: Synthetic oligonucleotide
ggtgcatccagcagggccact

SEQ ID NO: 9914 - protein, 7 aa, Artificial Sequence
  Description of Artificial Sequence: Synthetic peptide
GASSRAT

SEQ ID NO: 9915 - DNA, 21 bp, Artificial Sequence
  Description of Artificial Sequence: Synthetic oligonucleotide
tgggcatctacccgggaatcc

SEQ ID NO: 9916 - protein, 7 aa, Artificial Sequence
  Description of Artificial Sequence: Synthetic peptide
WASTRES

SEQ ID NO: 9917 - DNA, 21 bp, Artificial Sequence
  Description of Artificial Sequence: Synthetic oligonucleotide
tggacatctacccgggaatcc

SEQ ID NO: 9918 - protein, 7 aa, Artificial Sequence
  Description of Artificial Sequence: Synthetic peptide
WTSTRES

SEQ ID NO: 9919 - DNA, 21 bp, Artificial Sequence
  Description of Artificial Sequence: Synthetic oligonucleotide
gctgcatccagtttgcaaagt

SEQ ID NO: 9920 - protein, 7 aa, Artificial Sequence
  Description of Artificial Sequence: Synthetic peptide
AASSLQS

SEQ ID NO: 9921 - DNA, 21 bp, Artificial Sequence
  Description of Artificial Sequence: Synthetic oligonucleotide
ggtgcatccagcagggccact

SEQ ID NO: 9922 - protein, 7 aa, Artificial Sequence
  Description of Artificial Sequence: Synthetic peptide
GASSRAT

SEQ ID NO: 9923 - DNA, 21 bp, Artificial Sequence
  Description of Artificial Sequence: Synthetic oligonucleotide
ggtgcatccaccagggccact

SEQ ID NO: 9924 - protein, 7 aa, Artificial Sequence
  Description of Artificial Sequence: Synthetic peptide
GASTRAT

SEQ ID NO: 9925 - DNA, 21 bp, Artificial Sequence
  Description of Artificial Sequence: Synthetic oligonucleotide
tgggcatctacccgggaatcc

SEQ ID NO: 9926 - protein, 7 aa, Artificial Sequence
  Description of Artificial Sequence: Synthetic peptide
WASTRES

SEQ ID NO: 9927 - DNA, 21 bp, Artificial Sequence
  Description of Artificial Sequence: Synthetic oligonucleotide
ggtgcatccagccgggccagt

SEQ ID NO: 9928 - protein, 7 aa, Artificial Sequence
  Description of Artificial Sequence: Synthetic peptide
GASSRAS

SEQ ID NO: 9929 - DNA, 21 bp, Artificial Sequence
  Description of Artificial Sequence: Synthetic oligonucleotide
ggtgcatccagccgggccact

SEQ ID NO: 9930 - protein, 7 aa, Artificial Sequence
  Description of Artificial Sequence: Synthetic peptide
GASSRAT

SEQ ID NO: 9931 - DNA, 21 bp, Artificial Sequence
  Description of Artificial Sequence: Synthetic oligonucleotide
ggtgcatccaccagggccact

SEQ ID NO: 9932 - protein, 7 aa, Artificial Sequence
  Description of Artificial Sequence: Synthetic peptide
GASTRAT

SEQ ID NO: 9933 - DNA, 21 bp, Artificial Sequence
  Description of Artificial Sequence: Synthetic oligonucleotide
ggtgcatccagcagggccact

SEQ ID NO: 9934 - protein, 7 aa, Artificial Sequence
  Description of Artificial Sequence: Synthetic peptide
GASSRAT

SEQ ID NO: 9935 - DNA, 21 bp, Artificial Sequence
  Description of Artificial Sequence: Synthetic oligonucleotide
ggtgcagccagcagggcccct

SEQ ID NO: 9936 - protein, 7 aa, Artificial Sequence
  Description of Artificial Sequence: Synthetic peptide
GAASRAP

SEQ ID NO: 9937 - DNA, 21 bp, Artificial Sequence
  Description of Artificial Sequence: Synthetic oligonucleotide
ggtgcatccagcagggccact

SEQ ID NO: 9938 - protein, 7 aa, Artificial Sequence
  Description of Artificial Sequence: Synthetic peptide
GASSRAT

SEQ ID NO: 9939 - DNA, 21 bp, Artificial Sequence
  Description of Artificial Sequence: Synthetic oligonucleotide
ggtgcatccagcagggccact

SEQ ID NO: 9940 - protein, 7 aa, Artificial Sequence
  Description of Artificial Sequence: Synthetic peptide
GASSRAT

SEQ ID NO: 9941 - DNA, 21 bp, Artificial Sequence
  Description of Artificial Sequence: Synthetic oligonucleotide
tgggcatctacccgggaatcc

SEQ ID NO: 9942 - protein, 7 aa, Artificial Sequence
  Description of Artificial Sequence: Synthetic peptide
WASTRES

SEQ ID NO: 9943 - DNA, 21 bp, Artificial Sequence
  Description of Artificial Sequence: Synthetic oligonucleotide
ggtgcatctagcagggccact

SEQ ID NO: 9944 - protein, 7 aa, Artificial Sequence
  Description of Artificial Sequence: Synthetic peptide
GASSRAT

SEQ ID NO: 9945 - DNA, 21 bp, Artificial Sequence
  Description of Artificial Sequence: Synthetic oligonucleotide
tgggcatttatccgggaatcc

SEQ ID NO: 9946 - protein, 7 aa, Artificial Sequence
  Description of Artificial Sequence: Synthetic peptide
WAFIRES

SEQ ID NO: 9947 - DNA, 21 bp, Artificial Sequence
  Description of Artificial Sequence: Synthetic oligonucleotide
ggtgcatccaccagggccact

SEQ ID NO: 9948 - protein, 7 aa, Artificial Sequence
  Description of Artificial Sequence: Synthetic peptide
GASTRAT

SEQ ID NO: 9949 - DNA, 21 bp, Artificial Sequence
  Description of Artificial Sequence: Synthetic oligonucleotide
ggtgcatccagccgggccact

SEQ ID NO: 9950 - protein, 7 aa, Artificial Sequence
  Description of Artificial Sequence: Synthetic peptide
GASSRAT

SEQ ID NO: 9951 - DNA, 21 bp, Artificial Sequence
  Description of Artificial Sequence: Synthetic oligonucleotide
ggtgcatccagccggtccact

SEQ ID NO: 9952 - protein, 7 aa, Artificial Sequence
  Description of Artificial Sequence: Synthetic peptide
GASSRST

SEQ ID NO: 9953 - DNA, 21 bp, Artificial Sequence
  Description of Artificial Sequence: Synthetic oligonucleotide
tgggcatctacccgggaatcc

SEQ ID NO: 9954 - protein, 7 aa, Artificial Sequence
  Description of Artificial Sequence: Synthetic peptide
WASTRES

SEQ ID NO: 9955 - DNA, 21 bp, Artificial Sequence
  Description of Artificial Sequence: Synthetic oligonucleotide
ggtgcatccagccggtccact

SEQ ID NO: 9956 - protein, 7 aa, Artificial Sequence
  Description of Artificial Sequence: Synthetic peptide
GASSRST

SEQ ID NO: 9957 - DNA, 21 bp, Artificial Sequence
  Description of Artificial Sequence: Synthetic oligonucleotide
ggtgcatctgccaggaccact

SEQ ID NO: 9958 - protein, 7 aa, Artificial Sequence
  Description of Artificial Sequence: Synthetic peptide
GASARTT

SEQ ID NO: 9959 - DNA, 21 bp, Artificial Sequence
  Description of Artificial Sequence: Synthetic oligonucleotide
ggtgcatccagccggtccact

SEQ ID NO: 9960 - protein, 7 aa, Artificial Sequence
  Description of Artificial Sequence: Synthetic peptide
GASSRST

SEQ ID NO: 9961 - DNA, 21 bp, Artificial Sequence
  Description of Artificial Sequence: Synthetic oligonucleotide
gctgcatccagtttgcacagt

SEQ ID NO: 9962 - protein, 7 aa, Artificial Sequence
  Description of Artificial Sequence: Synthetic peptide
AASSLHS

SEQ ID NO: 9963 - DNA, 21 bp, Artificial Sequence
  Description of Artificial Sequence: Synthetic oligonucleotide
ggtgcatccagccggtccact

SEQ ID NO: 9964 - protein, 7 aa, Artificial Sequence
  Description of Artificial Sequence: Synthetic peptide
GASSRST

SEQ ID NO: 9965 - DNA, 21 bp, Artificial Sequence
  Description of Artificial Sequence: Synthetic oligonucleotide
ggtgcatccaccagggcctct

SEQ ID NO: 9966 - protein, 7 aa, Artificial Sequence
  Description of Artificial Sequence: Synthetic peptide
GASTRAS

SEQ ID NO: 9967 - DNA, 21 bp, Artificial Sequence
  Description of Artificial Sequence: Synthetic oligonucleotide
tgggcatctacccggaaatcc

SEQ ID NO: 9968 - protein, 7 aa, Artificial Sequence
  Description of Artificial Sequence: Synthetic peptide
WASTRKS

SEQ ID NO: 9969 - DNA, 21 bp, Artificial Sequence
  Description of Artificial Sequence: Synthetic oligonucleotide
ggtgcatccagccggtccact

SEQ ID NO: 9970 - protein, 7 aa, Artificial Sequence
  Description of Artificial Sequence: Synthetic peptide
GASSRST

SEQ ID NO: 9971 - DNA, 21 bp, Artificial Sequence
  Description of Artificial Sequence: Synthetic oligonucleotide
tgggcatctacccggaaatcc

SEQ ID NO: 9972 - protein, 7 aa, Artificial Sequence
  Description of Artificial Sequence: Synthetic peptide
WASTRKS

SEQ ID NO: 9973 - DNA, 21 bp, Artificial Sequence
  Description of Artificial Sequence: Synthetic oligonucleotide
ggtgcatccagccggtccacg

SEQ ID NO: 9974 - protein, 7 aa, Artificial Sequence
  Description of Artificial Sequence: Synthetic peptide
GASSRST

SEQ ID NO: 9975 - DNA, 21 bp, Artificial Sequence
  Description of Artificial Sequence: Synthetic oligonucleotide
tgggcatctacccgggaatcc

SEQ ID NO: 9976 - protein, 7 aa, Artificial Sequence
  Description of Artificial Sequence: Synthetic peptide
WASTRES

SEQ ID NO: 9977 - DNA, 21 bp, Artificial Sequence
  Description of Artificial Sequence: Synthetic oligonucleotide
tgggcatctacccgggaatcc

SEQ ID NO: 9978 - protein, 7 aa, Artificial Sequence
  Description of Artificial Sequence: Synthetic peptide
WASTRES

SEQ ID NO: 9979 - DNA, 21 bp, Artificial Sequence
  Description of Artificial Sequence: Synthetic oligonucleotide
gctgcatccagtttgcaaagt

SEQ ID NO: 9980 - protein, 7 aa, Artificial Sequence
  Description of Artificial Sequence: Synthetic peptide
AASSLQS

SEQ ID NO: 9981 - DNA, 21 bp, Artificial Sequence
  Description of Artificial Sequence: Synthetic oligonucleotide
ggtgcatccagccggtccact

SEQ ID NO: 9982 - protein, 7 aa, Artificial Sequence
  Description of Artificial Sequence: Synthetic peptide
GASSRST

SEQ ID NO: 9983 - DNA, 21 bp, Artificial Sequence
  Description of Artificial Sequence: Synthetic oligonucleotide
ggtgcatccagccggtccact

SEQ ID NO: 9984 - protein, 7 aa, Artificial Sequence
  Description of Artificial Sequence: Synthetic peptide
GASSRST

SEQ ID NO: 9985 - DNA, 21 bp, Artificial Sequence
  Description of Artificial Sequence: Synthetic oligonucleotide
ggtgcatccagccggtccact

SEQ ID NO: 9986 - protein, 7 aa, Artificial Sequence
  Description of Artificial Sequence: Synthetic peptide
GASSRST

SEQ ID NO: 9987 - DNA, 21 bp, Artificial Sequence
  Description of Artificial Sequence: Synthetic oligonucleotide
tgggcatttactcggaaatcc

SEQ ID NO: 9988 - protein, 7 aa, Artificial Sequence
  Description of Artificial Sequence: Synthetic peptide
WAFTRKS

SEQ ID NO: 9989 - DNA, 21 bp, Artificial Sequence
  Description of Artificial Sequence: Synthetic oligonucleotide
ggtgcatccagccgggccact

SEQ ID NO: 9990 - protein, 7 aa, Artificial Sequence
  Description of Artificial Sequence: Synthetic peptide
GASSRAT

SEQ ID NO: 9991 - DNA, 21 bp, Artificial Sequence
  Description of Artificial Sequence: Synthetic oligonucleotide
ttgggttctaatcgggcctcc

SEQ ID NO: 9992 - protein, 7 aa, Artificial Sequence
  Description of Artificial Sequence: Synthetic peptide
LGSNRAS

SEQ ID NO: 9993 - DNA, 21 bp, Artificial Sequence
  Description of Artificial Sequence: Synthetic oligonucleotide
ggtgcatccagccggtccact

SEQ ID NO: 9994 - protein, 7 aa, Artificial Sequence
  Description of Artificial Sequence: Synthetic peptide
GASSRST

SEQ ID NO: 9995 - DNA, 21 bp, Artificial Sequence
  Description of Artificial Sequence: Synthetic oligonucleotide
ggtgcattcagcagggccact

SEQ ID NO: 9996 - protein, 7 aa, Artificial Sequence
  Description of Artificial Sequence: Synthetic peptide
GAFSRAT

SEQ ID NO: 9997 - DNA, 21 bp, Artificial Sequence
  Description of Artificial Sequence: Synthetic oligonucleotide
ggtgcatccagccggtccact

SEQ ID NO: 9998 - protein, 7 aa, Artificial Sequence
  Description of Artificial Sequence: Synthetic peptide
GASSRST

SEQ ID NO: 9999 - DNA, 21 bp, Artificial Sequence
  Description of Artificial Sequence: Synthetic oligonucleotide
ggtgcatctgccaggaccact

SEQ ID NO: 10000 - protein, 7 aa, Artificial Sequence
  Description of Artificial Sequence: Synthetic peptide
GASARTT

SEQ ID NO: 10001 - DNA, 21 bp, Artificial Sequence
  Description of Artificial Sequence: Synthetic oligonucleotide
ggtgcatccagccggtccact

SEQ ID NO: 10002 - protein, 7 aa, Artificial Sequence
  Description of Artificial Sequence: Synthetic peptide
GASSRST

SEQ ID NO: 10003 - DNA, 21 bp, Artificial Sequence
  Description of Artificial Sequence: Synthetic oligonucleotide
ggtgcatccagccgggccact

SEQ ID NO: 10004 - protein, 7 aa, Artificial Sequence
  Description of Artificial Sequence: Synthetic peptide
GASSRAT

SEQ ID NO: 10005 - DNA, 21 bp, Artificial Sequence
  Description of Artificial Sequence: Synthetic oligonucleotide
ggtgcatccagccgggccact

SEQ ID NO: 10006 - protein, 7 aa, Artificial Sequence
  Description of Artificial Sequence: Synthetic peptide
GASSRAT

SEQ ID NO: 10007 - DNA, 21 bp, Artificial Sequence
  Description of Artificial Sequence: Synthetic oligonucleotide
attgcatccagtttgcaaagt

SEQ ID NO: 10008 - protein, 7 aa, Artificial Sequence
  Description of Artificial Sequence: Synthetic peptide
IASSLQS

SEQ ID NO: 10009 - DNA, 21 bp, Artificial Sequence
  Description of Artificial Sequence: Synthetic oligonucleotide
tggacatctacccgggaatcc

SEQ ID NO: 10010 - protein, 7 aa, Artificial Sequence
  Description of Artificial Sequence: Synthetic peptide
WTSTRES

SEQ ID NO: 10011 - DNA, 21 bp, Artificial Sequence
  Description of Artificial Sequence: Synthetic oligonucleotide
tgggcatctacgcgggagtcc

SEQ ID NO: 10012 - protein, 7 aa, Artificial Sequence
  Description of Artificial Sequence: Synthetic peptide
WASTRES

SEQ ID NO: 10013 - DNA, 21 bp, Artificial Sequence
  Description of Artificial Sequence: Synthetic oligonucleotide
ggtgcatccagccggtccact

SEQ ID NO: 10014 - protein, 7 aa, Artificial Sequence
  Description of Artificial Sequence: Synthetic peptide
GASSRST

SEQ ID NO: 10015 - DNA, 21 bp, Artificial Sequence
  Description of Artificial Sequence: Synthetic oligonucleotide
ttgggttctaatcgggcctcc

SEQ ID NO: 10016 - protein, 7 aa, Artificial Sequence
  Description of Artificial Sequence: Synthetic peptide
LGSNRAS

SEQ ID NO: 10017 - DNA, 21 bp, Artificial Sequence
  Description of Artificial Sequence: Synthetic oligonucleotide
tgggcatctacccgggaatcc

SEQ ID NO: 10018 - protein, 7 aa, Artificial Sequence
  Description of Artificial Sequence: Synthetic peptide
WASTRES

SEQ ID NO: 10019 - DNA, 21 bp, Artificial Sequence
  Description of Artificial Sequence: Synthetic oligonucleotide
ggtgcatccagccggtccact

SEQ ID NO: 10020 - protein, 7 aa, Artificial Sequence
  Description of Artificial Sequence: Synthetic peptide
GASSRST

SEQ ID NO: 10021 - DNA, 21 bp, Artificial Sequence
  Description of Artificial Sequence: Synthetic oligonucleotide
ggtgcatccagccggtccact

SEQ ID NO: 10022 - protein, 7 aa, Artificial Sequence
  Description of Artificial Sequence: Synthetic peptide
GASSRST

SEQ ID NO: 10023 - DNA, 21 bp, Artificial Sequence
  Description of Artificial Sequence: Synthetic oligonucleotide
ggtgcatccagccggtccact

SEQ ID NO: 10024 - protein, 7 aa, Artificial Sequence
  Description of Artificial Sequence: Synthetic peptide
GASSRST

SEQ ID NO: 10025 - DNA, 21 bp, Artificial Sequence
  Description of Artificial Sequence: Synthetic oligonucleotide
ggtgcatccagccggtccact

SEQ ID NO: 10026 - protein, 7 aa, Artificial Sequence
  Description of Artificial Sequence: Synthetic peptide
GASSRST

SEQ ID NO: 10027 - DNA, 21 bp, Artificial Sequence
  Description of Artificial Sequence: Synthetic oligonucleotide
tgggcatctacccgggaatcc

SEQ ID NO: 10028 - protein, 7 aa, Artificial Sequence
  Description of Artificial Sequence: Synthetic peptide
WASTRES

SEQ ID NO: 10029 - DNA, 21 bp, Artificial Sequence
  Description of Artificial Sequence: Synthetic oligonucleotide
ggtgcatccagccgggccacg

SEQ ID NO: 10030 - protein, 7 aa, Artificial Sequence
  Description of Artificial Sequence: Synthetic peptide
GASSRAT

SEQ ID NO: 10031 - DNA, 21 bp, Artificial Sequence
  Description of Artificial Sequence: Synthetic oligonucleotide
ggtgcatccagcagggccact

SEQ ID NO: 10032 - protein, 7 aa, Artificial Sequence
  Description of Artificial Sequence: Synthetic peptide
GASSRAT

SEQ ID NO: 10033 - DNA, 21 bp, Artificial Sequence
  Description of Artificial Sequence: Synthetic oligonucleotide
ttgggttctaatcgggcctcc

SEQ ID NO: 10034 - protein, 7 aa, Artificial Sequence
  Description of Artificial Sequence: Synthetic peptide
LGSNRAS

SEQ ID NO: 10035 - DNA, 21 bp, Artificial Sequence
  Description of Artificial Sequence: Synthetic oligonucleotide
ggtgcatccaccagggccact

SEQ ID NO: 10036 - protein, 7 aa, Artificial Sequence
  Description of Artificial Sequence: Synthetic peptide
GASTRAT

SEQ ID NO: 10037 - DNA, 21 bp, Artificial Sequence
  Description of Artificial Sequence: Synthetic oligonucleotide
ggtgcatccagccggtccact

SEQ ID NO: 10038 - protein, 7 aa, Artificial Sequence
  Description of Artificial Sequence: Synthetic peptide
GASSRST

SEQ ID NO: 10039 - DNA, 21 bp, Artificial Sequence
  Description of Artificial Sequence: Synthetic oligonucleotide
tggacatctacccgggaatcc

SEQ ID NO: 10040 - protein, 7 aa, Artificial Sequence
  Description of Artificial Sequence: Synthetic peptide
WTSTRES

SEQ ID NO: 10041 - DNA, 21 bp, Artificial Sequence
  Description of Artificial Sequence: Synthetic oligonucleotide
ggtgcatccagccggtccact

SEQ ID NO: 10042 - protein, 7 aa, Artificial Sequence
  Description of Artificial Sequence: Synthetic peptide
GASSRST

SEQ ID NO: 10043 - DNA, 21 bp, Artificial Sequence
  Description of Artificial Sequence: Synthetic oligonucleotide
tgggcatctacccgggaatcc

SEQ ID NO: 10044 - protein, 7 aa, Artificial Sequence
  Description of Artificial Sequence: Synthetic peptide
WASTRES

SEQ ID NO: 10045 - DNA, 21 bp, Artificial Sequence
  Description of Artificial Sequence: Synthetic oligonucleotide
ggtgcatccagccgggccact

SEQ ID NO: 10046 - protein, 7 aa, Artificial Sequence
  Description of Artificial Sequence: Synthetic peptide
GASSRAT

SEQ ID NO: 10047 - DNA, 21 bp, Artificial Sequence
  Description of Artificial Sequence: Synthetic oligonucleotide
ggtgcatccagccggtccact

SEQ ID NO: 10048 - protein, 7 aa, Artificial Sequence
  Description of Artificial Sequence: Synthetic peptide
GASSRST

SEQ ID NO: 10049 - DNA, 21 bp, Artificial Sequence
  Description of Artificial Sequence: Synthetic oligonucleotide
ggtgcatccagcagggcccct

SEQ ID NO: 10050 - protein, 7 aa, Artificial Sequence
  Description of Artificial Sequence: Synthetic peptide
GASSRAP

SEQ ID NO: 10051 - DNA, 21 bp, Artificial Sequence
  Description of Artificial Sequence: Synthetic oligonucleotide
ggtgcatccagcagggccact

SEQ ID NO: 10052 - protein, 7 aa, Artificial Sequence
  Description of Artificial Sequence: Synthetic peptide
GASSRAT

SEQ ID NO: 10053 - DNA, 21 bp, Artificial Sequence
  Description of Artificial Sequence: Synthetic oligonucleotide
gctgcatccagtttgcaaagt

SEQ ID NO: 10054 - protein, 7 aa, Artificial Sequence
  Description of Artificial Sequence: Synthetic peptide
AASSLQS

SEQ ID NO: 10055 - DNA, 21 bp, Artificial Sequence
  Description of Artificial Sequence: Synthetic oligonucleotide
tggacatctacccgggaatcc

SEQ ID NO: 10056 - protein, 7 aa, Artificial Sequence
  Description of Artificial Sequence: Synthetic peptide
WTSTRES

SEQ ID NO: 10057 - DNA, 21 bp, Artificial Sequence
  Description of Artificial Sequence: Synthetic oligonucleotide
tgggcatctacccggaaatcc

SEQ ID NO: 10058 - protein, 7 aa, Artificial Sequence
  Description of Artificial Sequence: Synthetic peptide
WASTRKS

SEQ ID NO: 10059 - DNA, 21 bp, Artificial Sequence
  Description of Artificial Sequence: Synthetic oligonucleotide
tgggcatctacccgggaatcc

SEQ ID NO: 10060 - protein, 7 aa, Artificial Sequence
  Description of Artificial Sequence: Synthetic peptide
WASTRES

SEQ ID NO: 10061 - DNA, 21 bp, Artificial Sequence
  Description of Artificial Sequence: Synthetic oligonucleotide
tgggcatctacccgggaatcc

SEQ ID NO: 10062 - protein, 7 aa, Artificial Sequence
  Description of Artificial Sequence: Synthetic peptide
WASTRES

SEQ ID NO: 10063 - DNA, 21 bp, Artificial Sequence
  Description of Artificial Sequence: Synthetic oligonucleotide
ggtgcatccagccggtccact

SEQ ID NO: 10064 - protein, 7 aa, Artificial Sequence
  Description of Artificial Sequence: Synthetic peptide
GASSRST

SEQ ID NO: 10065 - DNA, 21 bp, Artificial Sequence
  Description of Artificial Sequence: Synthetic oligonucleotide
ggtgcatccagccgggccact

SEQ ID NO: 10066 - protein, 7 aa, Artificial Sequence
  Description of Artificial Sequence: Synthetic peptide
GASSRAT

SEQ ID NO: 10067 - DNA, 21 bp, Artificial Sequence
  Description of Artificial Sequence: Synthetic oligonucleotide
ggtgcatccaccagggccact

SEQ ID NO: 10068 - protein, 7 aa, Artificial Sequence
  Description of Artificial Sequence: Synthetic peptide
GASTRAT

SEQ ID NO: 10069 - DNA, 21 bp, Artificial Sequence
  Description of Artificial Sequence: Synthetic oligonucleotide
tgggcatctacccgggaatcc

SEQ ID NO: 10070 - protein, 7 aa, Artificial Sequence
  Description of Artificial Sequence: Synthetic peptide
WASTRES

SEQ ID NO: 10071 - DNA, 21 bp, Artificial Sequence
  Description of Artificial Sequence: Synthetic oligonucleotide
ggtgcatccagccggtccact

SEQ ID NO: 10072 - protein, 7 aa, Artificial Sequence
  Description of Artificial Sequence: Synthetic peptide
GASSRST

SEQ ID NO: 10073 - DNA, 21 bp, Artificial Sequence
  Description of Artificial Sequence: Synthetic oligonucleotide
ggtgcatccagccggtccact

SEQ ID NO: 10074 - protein, 7 aa, Artificial Sequence
  Description of Artificial Sequence: Synthetic peptide
GASSRST

SEQ ID NO: 10075 - DNA, 21 bp, Artificial Sequence
  Description of Artificial Sequence: Synthetic oligonucleotide
ggtgcatccagccgggccact

SEQ ID NO: 10076 - protein, 7 aa, Artificial Sequence
  Description of Artificial Sequence: Synthetic peptide
GASSRAT

SEQ ID NO: 10077 - DNA, 21 bp, Artificial Sequence
  Description of Artificial Sequence: Synthetic oligonucleotide
tgggcatctacccgggaatcc

SEQ ID NO: 10078 - protein, 7 aa, Artificial Sequence
  Description of Artificial Sequence: Synthetic peptide
WASTRES

SEQ ID NO: 10079 - DNA, 21 bp, Artificial Sequence
  Description of Artificial Sequence: Synthetic oligonucleotide
ggtgcatccaccagggcctct

SEQ ID NO: 10080 - protein, 7 aa, Artificial Sequence
  Description of Artificial Sequence: Synthetic peptide
GASTRAS

SEQ ID NO: 10081 - DNA, 21 bp, Artificial Sequence
  Description of Artificial Sequence: Synthetic oligonucleotide
tgggcatctacctgggaatcc

SEQ ID NO: 10082 - protein, 7 aa, Artificial Sequence
  Description of Artificial Sequence: Synthetic peptide
WASTWES

SEQ ID NO: 10083 - DNA, 21 bp, Artificial Sequence
  Description of Artificial Sequence: Synthetic oligonucleotide
gctgcatccactttgcaaagt

SEQ ID NO: 10084 - protein, 7 aa, Artificial Sequence
  Description of Artificial Sequence: Synthetic peptide
AASTLQS

SEQ ID NO: 10085 - DNA, 21 bp, Artificial Sequence
  Description of Artificial Sequence: Synthetic oligonucleotide
ggtgtatccagtttgcaaagt

SEQ ID NO: 10086 - protein, 7 aa, Artificial Sequence
  Description of Artificial Sequence: Synthetic peptide
GVSSLQS

SEQ ID NO: 10087 - DNA, 21 bp, Artificial Sequence
  Description of Artificial Sequence: Synthetic oligonucleotide
tgggcatctacccgggaatcc

SEQ ID NO: 10088 - protein, 7 aa, Artificial Sequence
  Description of Artificial Sequence: Synthetic peptide
WASTRES

SEQ ID NO: 10089 - DNA, 21 bp, Artificial Sequence
  Description of Artificial Sequence: Synthetic oligonucleotide
tgggcatctatccgggaatcc

SEQ ID NO: 10090 - protein, 7 aa, Artificial Sequence
  Description of Artificial Sequence: Synthetic peptide
WASIRES

SEQ ID NO: 10091 - DNA, 21 bp, Artificial Sequence
  Description of Artificial Sequence: Synthetic oligonucleotide
gctgcttccagtttgcaaagt

SEQ ID NO: 10092 - protein, 7 aa, Artificial Sequence
  Description of Artificial Sequence: Synthetic peptide
AASSLQS

SEQ ID NO: 10093 - DNA, 21 bp, Artificial Sequence
  Description of Artificial Sequence: Synthetic oligonucleotide
tggacatctacccgggaatcc

SEQ ID NO: 10094 - protein, 7 aa, Artificial Sequence
  Description of Artificial Sequence: Synthetic peptide
WTSTRES

SEQ ID NO: 10095 - DNA, 21 bp, Artificial Sequence
  Description of Artificial Sequence: Synthetic oligonucleotide
ggtgcatccagccggtccact

SEQ ID NO: 10096 - protein, 7 aa, Artificial Sequence
  Description of Artificial Sequence: Synthetic peptide
GASSRST

SEQ ID NO: 10097 - DNA, 21 bp, Artificial Sequence
  Description of Artificial Sequence: Synthetic oligonucleotide
tgggcatctacccgggaatcc

SEQ ID NO: 10098 - protein, 7 aa, Artificial Sequence
  Description of Artificial Sequence: Synthetic peptide
WASTRES

SEQ ID NO: 10099 - DNA, 21 bp, Artificial Sequence
  Description of Artificial Sequence: Synthetic oligonucleotide
ggtgcatccagccgggccact

SEQ ID NO: 10100 - protein, 7 aa, Artificial Sequence
  Description of Artificial Sequence: Synthetic peptide
GASSRAT

SEQ ID NO: 10101 - DNA, 21 bp, Artificial Sequence
  Description of Artificial Sequence: Synthetic oligonucleotide
gctgcatccagtttgcaaagt

SEQ ID NO: 10102 - protein, 7 aa, Artificial Sequence
  Description of Artificial Sequence: Synthetic peptide
AASSLQS

SEQ ID NO: 10103 - DNA, 21 bp, Artificial Sequence
  Description of Artificial Sequence: Synthetic oligonucleotide
gctgcatccagtttgcaaagt

SEQ ID NO: 10104 - protein, 7 aa, Artificial Sequence
  Description of Artificial Sequence: Synthetic peptide
AASSLQS

SEQ ID NO: 10105 - DNA, 21 bp, Artificial Sequence
  Description of Artificial Sequence: Synthetic oligonucleotide
actacatccagtttgcaaagt

SEQ ID NO: 10106 - protein, 7 aa, Artificial Sequence
  Description of Artificial Sequence: Synthetic peptide
TTSSLQS

SEQ ID NO: 10107 - DNA, 21 bp, Artificial Sequence
  Description of Artificial Sequence: Synthetic oligonucleotide
gaagtttccaaccggttctct

SEQ ID NO: 10108 - protein, 7 aa, Artificial Sequence
  Description of Artificial Sequence: Synthetic peptide
EVSNRFS

SEQ ID NO: 10109 - DNA, 21 bp, Artificial Sequence
  Description of Artificial Sequence: Synthetic oligonucleotide
tgggcatctacccgggaatcc

SEQ ID NO: 10110 - protein, 7 aa, Artificial Sequence
  Description of Artificial Sequence: Synthetic peptide
WASTRES

SEQ ID NO: 10111 - DNA, 21 bp, Artificial Sequence
  Description of Artificial Sequence: Synthetic oligonucleotide
ggtgtatctagtcgggccact

SEQ ID NO: 10112 - protein, 7 aa, Artificial Sequence
  Description of Artificial Sequence: Synthetic peptide
GVSSRAT

SEQ ID NO: 10113 - DNA, 21 bp, Artificial Sequence
  Description of Artificial Sequence: Synthetic oligonucleotide
gctgcatccagtttgcaaggt

SEQ ID NO: 10114 - protein, 7 aa, Artificial Sequence
  Description of Artificial Sequence: Synthetic peptide
AASSLQG

SEQ ID NO: 10115 - DNA, 21 bp, Artificial Sequence
  Description of Artificial Sequence: Synthetic oligonucleotide
tgggcatctacccggaaatcc

SEQ ID NO: 10116 - protein, 7 aa, Artificial Sequence
  Description of Artificial Sequence: Synthetic peptide
WASTRKS

SEQ ID NO: 10117 - DNA, 21 bp, Artificial Sequence
  Description of Artificial Sequence: Synthetic oligonucleotide
actacatccagtttgcaaagt

SEQ ID NO: 10118 - protein, 7 aa, Artificial Sequence
  Description of Artificial Sequence: Synthetic peptide
TTSSLQS

SEQ ID NO: 10119 - DNA, 21 bp, Artificial Sequence
  Description of Artificial Sequence: Synthetic oligonucleotide
tgggcatctacccgggaatcc

SEQ ID NO: 10120 - protein, 7 aa, Artificial Sequence
  Description of Artificial Sequence: Synthetic peptide
WASTRES

SEQ ID NO: 10121 - DNA, 21 bp, Artificial Sequence
  Description of Artificial Sequence: Synthetic oligonucleotide
gctgcatccagtttgcaaagt

SEQ ID NO: 10122 - protein, 7 aa, Artificial Sequence
  Description of Artificial Sequence: Synthetic peptide
AASSLQS

SEQ ID NO: 10123 - DNA, 21 bp, Artificial Sequence
  Description of Artificial Sequence: Synthetic oligonucleotide
gctgcatccagtttgcaaagt

SEQ ID NO: 10124 - protein, 7 aa, Artificial Sequence
  Description of Artificial Sequence: Synthetic peptide
AASSLQS

SEQ ID NO: 10125 - DNA, 21 bp, Artificial Sequence
  Description of Artificial Sequence: Synthetic oligonucleotide
gaagtttcccaccgggtctct

SEQ ID NO: 10126 - protein, 7 aa, Artificial Sequence
  Description of Artificial Sequence: Synthetic peptide
EVSHRVS

SEQ ID NO: 10127 - DNA, 21 bp, Artificial Sequence
  Description of Artificial Sequence: Synthetic oligonucleotide
ggtgcatccagcagggccact

SEQ ID NO: 10128 - protein, 7 aa, Artificial Sequence
  Description of Artificial Sequence: Synthetic peptide
GASSRAT

SEQ ID NO: 10129 - DNA, 21 bp, Artificial Sequence
  Description of Artificial Sequence: Synthetic oligonucleotide
ggtgcatccagcagggccact

SEQ ID NO: 10130 - protein, 7 aa, Artificial Sequence
  Description of Artificial Sequence: Synthetic peptide
GASSRAT

SEQ ID NO: 10131 - DNA, 21 bp, Artificial Sequence
  Description of Artificial Sequence: Synthetic oligonucleotide
tgggcatctacccgggaatcc

SEQ ID NO: 10132 - protein, 7 aa, Artificial Sequence
  Description of Artificial Sequence: Synthetic peptide
WASTRES

SEQ ID NO: 10133 - DNA, 21 bp, Artificial Sequence
  Description of Artificial Sequence: Synthetic oligonucleotide
tgggcatctacccgggaatcc

SEQ ID NO: 10134 - protein, 7 aa, Artificial Sequence
  Description of Artificial Sequence: Synthetic peptide
WASTRES

SEQ ID NO: 10135 - DNA, 21 bp, Artificial Sequence
  Description of Artificial Sequence: Synthetic oligonucleotide
gctgcatccagtttgcagagt

SEQ ID NO: 10136 - protein, 7 aa, Artificial Sequence
  Description of Artificial Sequence: Synthetic peptide
AASSLQS

SEQ ID NO: 10137 - DNA, 21 bp, Artificial Sequence
  Description of Artificial Sequence: Synthetic oligonucleotide
tgggcatctgcccgggaatcc

SEQ ID NO: 10138 - protein, 7 aa, Artificial Sequence
  Description of Artificial Sequence: Synthetic peptide
WASARES

SEQ ID NO: 10139 - DNA, 21 bp, Artificial Sequence
  Description of Artificial Sequence: Synthetic oligonucleotide
gaagtttccaaccggttctct

SEQ ID NO: 10140 - protein, 7 aa, Artificial Sequence
  Description of Artificial Sequence: Synthetic peptide
EVSNRFS

SEQ ID NO: 10141 - DNA, 21 bp, Artificial Sequence
  Description of Artificial Sequence: Synthetic oligonucleotide
ggtgcatccagcagggccact

SEQ ID NO: 10142 - protein, 7 aa, Artificial Sequence
  Description of Artificial Sequence: Synthetic peptide
GASSRAT

SEQ ID NO: 10143 - DNA, 21 bp, Artificial Sequence
  Description of Artificial Sequence: Synthetic oligonucleotide
gctgcatccagtttgcaaagt

SEQ ID NO: 10144 - protein, 7 aa, Artificial Sequence
  Description of Artificial Sequence: Synthetic peptide
AASSLQS

SEQ ID NO: 10145 - DNA, 21 bp, Artificial Sequence
  Description of Artificial Sequence: Synthetic oligonucleotide
gctgcatccagtttgcaaagt

SEQ ID NO: 10146 - protein, 7 aa, Artificial Sequence
  Description of Artificial Sequence: Synthetic peptide
AASSLQS

SEQ ID NO: 10147 - DNA, 21 bp, Artificial Sequence
  Description of Artificial Sequence: Synthetic oligonucleotide
gctgcatccagtttgcaaagt

SEQ ID NO: 10148 - protein, 7 aa, Artificial Sequence
  Description of Artificial Sequence: Synthetic peptide
AASSLQS

SEQ ID NO: 10149 - DNA, 21 bp, Artificial Sequence
  Description of Artificial Sequence: Synthetic oligonucleotide
gaagtttcccaccggttctct

SEQ ID NO: 10150 - protein, 7 aa, Artificial Sequence
  Description of Artificial Sequence: Synthetic peptide
EVSHRFS

SEQ ID NO: 10151 - DNA, 21 bp, Artificial Sequence
  Description of Artificial Sequence: Synthetic oligonucleotide
gctgcatccagtttgcaaagt

SEQ ID NO: 10152 - protein, 7 aa, Artificial Sequence
  Description of Artificial Sequence: Synthetic peptide
AASSLQS

SEQ ID NO: 10153 - DNA, 21 bp, Artificial Sequence
  Description of Artificial Sequence: Synthetic oligonucleotide
tgggcatctacccgggattcc

SEQ ID NO: 10154 - protein, 7 aa, Artificial Sequence
  Description of Artificial Sequence: Synthetic peptide
WASTRDS

SEQ ID NO: 10155 - DNA, 21 bp, Artificial Sequence
  Description of Artificial Sequence: Synthetic oligonucleotide
actgcatccagtttacagagt

SEQ ID NO: 10156 - protein, 7 aa, Artificial Sequence
  Description of Artificial Sequence: Synthetic peptide
TASSLQS

SEQ ID NO: 10157 - DNA, 21 bp, Artificial Sequence
  Description of Artificial Sequence: Synthetic oligonucleotide
gaagtttcctaccgggtctct

SEQ ID NO: 10158 - protein, 7 aa, Artificial Sequence
  Description of Artificial Sequence: Synthetic peptide
EVSYRVS

SEQ ID NO: 10159 - DNA, 21 bp, Artificial Sequence
  Description of Artificial Sequence: Synthetic oligonucleotide
gctgcatccagtttgcaaagt

SEQ ID NO: 10160 - protein, 7 aa, Artificial Sequence
  Description of Artificial Sequence: Synthetic peptide
AASSLQS

SEQ ID NO: 10161 - DNA, 21 bp, Artificial Sequence
  Description of Artificial Sequence: Synthetic oligonucleotide
tgggcatctacccggaaatcc

SEQ ID NO: 10162 - protein, 7 aa, Artificial Sequence
  Description of Artificial Sequence: Synthetic peptide
WASTRKS

SEQ ID NO: 10163 - DNA, 21 bp, Artificial Sequence
  Description of Artificial Sequence: Synthetic oligonucleotide
attgcatccagtttgcaaagt

SEQ ID NO: 10164 - protein, 7 aa, Artificial Sequence
  Description of Artificial Sequence: Synthetic peptide
IASSLQS

SEQ ID NO: 10165 - DNA, 21 bp, Artificial Sequence
  Description of Artificial Sequence: Synthetic oligonucleotide
gaagtttccaaccggttctct

SEQ ID NO: 10166 - protein, 7 aa, Artificial Sequence
  Description of Artificial Sequence: Synthetic peptide
EVSNRFS

SEQ ID NO: 10167 - DNA, 21 bp, Artificial Sequence
  Description of Artificial Sequence: Synthetic oligonucleotide
gaagtttcctaccgggtctct

SEQ ID NO: 10168 - protein, 7 aa, Artificial Sequence
  Description of Artificial Sequence: Synthetic peptide
EVSYRVS

SEQ ID NO: 10169 - DNA, 21 bp, Artificial Sequence
  Description of Artificial Sequence: Synthetic oligonucleotide
gctgcatccagtttgcaaagt

SEQ ID NO: 10170 - protein, 7 aa, Artificial Sequence
  Description of Artificial Sequence: Synthetic peptide
AASSLQS

SEQ ID NO: 10171 - DNA, 21 bp, Artificial Sequence
  Description of Artificial Sequence: Synthetic oligonucleotide
gctgcatccagtttgcaaagt

SEQ ID NO: 10172 - protein, 7 aa, Artificial Sequence
  Description of Artificial Sequence: Synthetic peptide
AASSLQS

SEQ ID NO: 10173 - DNA, 21 bp, Artificial Sequence
  Description of Artificial Sequence: Synthetic oligonucleotide
gaagtttcccaccggttctct

SEQ ID NO: 10174 - protein, 7 aa, Artificial Sequence
  Description of Artificial Sequence: Synthetic peptide
EVSHRFS

SEQ ID NO: 10175 - DNA, 21 bp, Artificial Sequence
  Description of Artificial Sequence: Synthetic oligonucleotide
gctgcatccaatttgcaaagt

SEQ ID NO: 10176 - protein, 7 aa, Artificial Sequence
  Description of Artificial Sequence: Synthetic peptide
AASNLQS

SEQ ID NO: 10177 - DNA, 21 bp, Artificial Sequence
  Description of Artificial Sequence: Synthetic oligonucleotide
tgggcatctacccgggaatcc

SEQ ID NO: 10178 - protein, 7 aa, Artificial Sequence
  Description of Artificial Sequence: Synthetic peptide
WASTRES

SEQ ID NO: 10179 - DNA, 21 bp, Artificial Sequence
  Description of Artificial Sequence: Synthetic oligonucleotide
actgcatccagtttgcaaagt

SEQ ID NO: 10180 - protein, 7 aa, Artificial Sequence
  Description of Artificial Sequence: Synthetic peptide
TASSLQS

SEQ ID NO: 10181 - DNA, 21 bp, Artificial Sequence
  Description of Artificial Sequence: Synthetic oligonucleotide
tgggcatctaccctgagatcc

SEQ ID NO: 10182 - protein, 7 aa, Artificial Sequence
  Description of Artificial Sequence: Synthetic peptide
WASTLRS

SEQ ID NO: 10183 - DNA, 21 bp, Artificial Sequence
  Description of Artificial Sequence: Synthetic oligonucleotide
tggtcatctacccgggaatcc

SEQ ID NO: 10184 - protein, 7 aa, Artificial Sequence
  Description of Artificial Sequence: Synthetic peptide
WSSTRES

SEQ ID NO: 10185 - DNA, 21 bp, Artificial Sequence
  Description of Artificial Sequence: Synthetic oligonucleotide
gctgcatccagtttgcaaagt

SEQ ID NO: 10186 - protein, 7 aa, Artificial Sequence
  Description of Artificial Sequence: Synthetic peptide
AASSLQS

SEQ ID NO: 10187 - DNA, 21 bp, Artificial Sequence
  Description of Artificial Sequence: Synthetic oligonucleotide
gctgcatccagtttgcaaagt

SEQ ID NO: 10188 - protein, 7 aa, Artificial Sequence
  Description of Artificial Sequence: Synthetic peptide
AASSLQS

SEQ ID NO: 10189 - DNA, 21 bp, Artificial Sequence
  Description of Artificial Sequence: Synthetic oligonucleotide
gctgcatccagtttgcaaggt

SEQ ID NO: 10190 - protein, 7 aa, Artificial Sequence
  Description of Artificial Sequence: Synthetic peptide
AASSLQG

SEQ ID NO: 10191 - DNA, 21 bp, Artificial Sequence
  Description of Artificial Sequence: Synthetic oligonucleotide
ggtgtatctagtagggccact

SEQ ID NO: 10192 - protein, 7 aa, Artificial Sequence
  Description of Artificial Sequence: Synthetic peptide
GVSSRAT

SEQ ID NO: 10193 - DNA, 21 bp, Artificial Sequence
  Description of Artificial Sequence: Synthetic oligonucleotide
gctgcatccagtttgcaaagt

SEQ ID NO: 10194 - protein, 7 aa, Artificial Sequence
  Description of Artificial Sequence: Synthetic peptide
AASSLQS

SEQ ID NO: 10195 - DNA, 21 bp, Artificial Sequence
  Description of Artificial Sequence: Synthetic oligonucleotide
gctgcatccagtttgcagagt

SEQ ID NO: 10196 - protein, 7 aa, Artificial Sequence
  Description of Artificial Sequence: Synthetic peptide
AASSLQS

SEQ ID NO: 10197 - DNA, 21 bp, Artificial Sequence
  Description of Artificial Sequence: Synthetic oligonucleotide
gctgcatccagtttgcaaagt

SEQ ID NO: 10198 - protein, 7 aa, Artificial Sequence
  Description of Artificial Sequence: Synthetic peptide
AASSLQS

SEQ ID NO: 10199 - DNA, 21 bp, Artificial Sequence
  Description of Artificial Sequence: Synthetic oligonucleotide
gctgcatccaatttgcaaagt

SEQ ID NO: 10200 - protein, 7 aa, Artificial Sequence
  Description of Artificial Sequence: Synthetic peptide
AASNLQS

SEQ ID NO: 10201 - DNA, 21 bp, Artificial Sequence
  Description of Artificial Sequence: Synthetic oligonucleotide
tgggcatctacccggaaatcc

SEQ ID NO: 10202 - protein, 7 aa, Artificial Sequence
  Description of Artificial Sequence: Synthetic peptide
WASTRKS

SEQ ID NO: 10203 - DNA, 21 bp, Artificial Sequence
  Description of Artificial Sequence: Synthetic oligonucleotide
gctgcatccagtttgcaaagt

SEQ ID NO: 10204 - protein, 7 aa, Artificial Sequence
  Description of Artificial Sequence: Synthetic peptide
AASSLQS

SEQ ID NO: 10205 - DNA, 21 bp, Artificial Sequence
  Description of Artificial Sequence: Synthetic oligonucleotide
gctgcatccagtttgcaaggt

SEQ ID NO: 10206 - protein, 7 aa, Artificial Sequence
  Description of Artificial Sequence: Synthetic peptide
AASSLQG

SEQ ID NO: 10207 - DNA, 21 bp, Artificial Sequence
  Description of Artificial Sequence: Synthetic oligonucleotide
tgggcatctacccggaaatcc

SEQ ID NO: 10208 - protein, 7 aa, Artificial Sequence
  Description of Artificial Sequence: Synthetic peptide
WASTRKS

SEQ ID NO: 10209 - DNA, 21 bp, Artificial Sequence
  Description of Artificial Sequence: Synthetic oligonucleotide
gctgcatccaatttgcaaagt

SEQ ID NO: 10210 - protein, 7 aa, Artificial Sequence
  Description of Artificial Sequence: Synthetic peptide
AASNLQS

SEQ ID NO: 10211 - DNA, 21 bp, Artificial Sequence
  Description of Artificial Sequence: Synthetic oligonucleotide
gttgcatccagtttgcaaaat

SEQ ID NO: 10212 - protein, 7 aa, Artificial Sequence
  Description of Artificial Sequence: Synthetic peptide
VASSLQN

SEQ ID NO: 10213 - DNA, 21 bp, Artificial Sequence
  Description of Artificial Sequence: Synthetic oligonucleotide
gaagtttccaaccggttctct

SEQ ID NO: 10214 - protein, 7 aa, Artificial Sequence
  Description of Artificial Sequence: Synthetic peptide
EVSNRFS

SEQ ID NO: 10215 - DNA, 21 bp, Artificial Sequence
  Description of Artificial Sequence: Synthetic oligonucleotide
actgcatccagtttgcaaagt

SEQ ID NO: 10216 - protein, 7 aa, Artificial Sequence
  Description of Artificial Sequence: Synthetic peptide
TASSLQS

SEQ ID NO: 10217 - DNA, 21 bp, Artificial Sequence
  Description of Artificial Sequence: Synthetic oligonucleotide
gaagtttcctaccggttctct

SEQ ID NO: 10218 - protein, 7 aa, Artificial Sequence
  Description of Artificial Sequence: Synthetic peptide
EVSYRFS

SEQ ID NO: 10219 - DNA, 21 bp, Artificial Sequence
  Description of Artificial Sequence: Synthetic oligonucleotide
actacatccagtttgcaaagt

SEQ ID NO: 10220 - protein, 7 aa, Artificial Sequence
  Description of Artificial Sequence: Synthetic peptide
TTSSLQS

SEQ ID NO: 10221 - DNA, 21 bp, Artificial Sequence
  Description of Artificial Sequence: Synthetic oligonucleotide
ggtgcatccaccagggccact

SEQ ID NO: 10222 - protein, 7 aa, Artificial Sequence
  Description of Artificial Sequence: Synthetic peptide
GASTRAT

SEQ ID NO: 10223 - DNA, 21 bp, Artificial Sequence
  Description of Artificial Sequence: Synthetic oligonucleotide
gaagtttccaaccggttctct

SEQ ID NO: 10224 - protein, 7 aa, Artificial Sequence
  Description of Artificial Sequence: Synthetic peptide
EVSNRFS

SEQ ID NO: 10225 - DNA, 21 bp, Artificial Sequence
  Description of Artificial Sequence: Synthetic oligonucleotide
actgcatccagtttggaaagt

SEQ ID NO: 10226 - protein, 7 aa, Artificial Sequence
  Description of Artificial Sequence: Synthetic peptide
TASSLES

SEQ ID NO: 10227 - DNA, 21 bp, Artificial Sequence
  Description of Artificial Sequence: Synthetic oligonucleotide
gatgcatccaggttgcaaagt

SEQ ID NO: 10228 - protein, 7 aa, Artificial Sequence
  Description of Artificial Sequence: Synthetic peptide
DASRLQS

SEQ ID NO: 10229 - DNA, 21 bp, Artificial Sequence
  Description of Artificial Sequence: Synthetic oligonucleotide
gaagtttcccaccggttctct

SEQ ID NO: 10230 - protein, 7 aa, Artificial Sequence
  Description of Artificial Sequence: Synthetic peptide
EVSHRFS

SEQ ID NO: 10231 - DNA, 21 bp, Artificial Sequence
  Description of Artificial Sequence: Synthetic oligonucleotide
actacatccagtttgcaaagt

SEQ ID NO: 10232 - protein, 7 aa, Artificial Sequence
  Description of Artificial Sequence: Synthetic peptide
TTSSLQS

SEQ ID NO: 10233 - DNA, 21 bp, Artificial Sequence
  Description of Artificial Sequence: Synthetic oligonucleotide
tgggcatctacccgggaatcc

SEQ ID NO: 10234 - protein, 7 aa, Artificial Sequence
  Description of Artificial Sequence: Synthetic peptide
WASTRES

SEQ ID NO: 10235 - DNA, 21 bp, Artificial Sequence
  Description of Artificial Sequence: Synthetic oligonucleotide
tgggcatctacccggaaatcc

SEQ ID NO: 10236 - protein, 7 aa, Artificial Sequence
  Description of Artificial Sequence: Synthetic peptide
WASTRKS

SEQ ID NO: 10237 - DNA, 21 bp, Artificial Sequence
  Description of Artificial Sequence: Synthetic oligonucleotide
tgggcatctacccggaaatcc

SEQ ID NO: 10238 - protein, 7 aa, Artificial Sequence
  Description of Artificial Sequence: Synthetic peptide
WASTRKS

SEQ ID NO: 10239 - DNA, 21 bp, Artificial Sequence
  Description of Artificial Sequence: Synthetic oligonucleotide
actacatccagtttgcaaagt

SEQ ID NO: 10240 - protein, 7 aa, Artificial Sequence
  Description of Artificial Sequence: Synthetic peptide
TTSSLQS

SEQ ID NO: 10241 - DNA, 21 bp, Artificial Sequence
  Description of Artificial Sequence: Synthetic oligonucleotide
gaaatttccaagcggttcact

SEQ ID NO: 10242 - protein, 7 aa, Artificial Sequence
  Description of Artificial Sequence: Synthetic peptide
EISKRFT

SEQ ID NO: 10243 - DNA, 21 bp, Artificial Sequence
  Description of Artificial Sequence: Synthetic oligonucleotide
ggtgtatctagtagggccact

SEQ ID NO: 10244 - protein, 7 aa, Artificial Sequence
  Description of Artificial Sequence: Synthetic peptide
GVSSRAT

SEQ ID NO: 10245 - DNA, 21 bp, Artificial Sequence
  Description of Artificial Sequence: Synthetic oligonucleotide
gctacatccagtttgcaaagt

SEQ ID NO: 10246 - protein, 7 aa, Artificial Sequence
  Description of Artificial Sequence: Synthetic peptide
ATSSLQS

SEQ ID NO: 10247 - DNA, 21 bp, Artificial Sequence
  Description of Artificial Sequence: Synthetic oligonucleotide
gctgcatccagtttgcaaggt

SEQ ID NO: 10248 - protein, 7 aa, Artificial Sequence
  Description of Artificial Sequence: Synthetic peptide
AASSLQG

SEQ ID NO: 10249 - DNA, 21 bp, Artificial Sequence
  Description of Artificial Sequence: Synthetic oligonucleotide
gctgcatccagtttgcaaagt

SEQ ID NO: 10250 - protein, 7 aa, Artificial Sequence
  Description of Artificial Sequence: Synthetic peptide
AASSLQS

SEQ ID NO: 10251 - DNA, 21 bp, Artificial Sequence
  Description of Artificial Sequence: Synthetic oligonucleotide
tgggcatctacccgggaatcc

SEQ ID NO: 10252 - protein, 7 aa, Artificial Sequence
  Description of Artificial Sequence: Synthetic peptide
WASTRES

SEQ ID NO: 10253 - DNA, 21 bp, Artificial Sequence
  Description of Artificial Sequence: Synthetic oligonucleotide
gctgcatccagtttgcaaagt

SEQ ID NO: 10254 - protein, 7 aa, Artificial Sequence
  Description of Artificial Sequence: Synthetic peptide
AASSLQS

SEQ ID NO: 10255 - DNA, 21 bp, Artificial Sequence
  Description of Artificial Sequence: Synthetic oligonucleotide
actacatccagtttgcaaagt

SEQ ID NO: 10256 - protein, 7 aa, Artificial Sequence
  Description of Artificial Sequence: Synthetic peptide
TTSSLQS

SEQ ID NO: 10257 - DNA, 21 bp, Artificial Sequence
  Description of Artificial Sequence: Synthetic oligonucleotide
gaagtttccaaccggttctct

SEQ ID NO: 10258 - protein, 7 aa, Artificial Sequence
  Description of Artificial Sequence: Synthetic peptide
EVSNRFS

SEQ ID NO: 10259 - DNA, 21 bp, Artificial Sequence
  Description of Artificial Sequence: Synthetic oligonucleotide
tgggcatctacccgggaatcc

SEQ ID NO: 10260 - protein, 7 aa, Artificial Sequence
  Description of Artificial Sequence: Synthetic peptide
WASTRES

SEQ ID NO: 10261 - DNA, 21 bp, Artificial Sequence
  Description of Artificial Sequence: Synthetic oligonucleotide
gctgcatccagtttgcgaagt

SEQ ID NO: 10262 - protein, 7 aa, Artificial Sequence
  Description of Artificial Sequence: Synthetic peptide
AASSLRS

SEQ ID NO: 10263 - DNA, 21 bp, Artificial Sequence
  Description of Artificial Sequence: Synthetic oligonucleotide
gaagtttccaagcggttcact

SEQ ID NO: 10264 - protein, 7 aa, Artificial Sequence
  Description of Artificial Sequence: Synthetic peptide
EVSKRFT

SEQ ID NO: 10265 - DNA, 21 bp, Artificial Sequence
  Description of Artificial Sequence: Synthetic oligonucleotide
ggtgtatctagtagggccact

SEQ ID NO: 10266 - protein, 7 aa, Artificial Sequence
  Description of Artificial Sequence: Synthetic peptide
GVSSRAT

SEQ ID NO: 10267 - DNA, 21 bp, Artificial Sequence
  Description of Artificial Sequence: Synthetic oligonucleotide
tgggcatctacccgggaattt

SEQ ID NO: 10268 - protein, 7 aa, Artificial Sequence
  Description of Artificial Sequence: Synthetic peptide
WASTREF

SEQ ID NO: 10269 - DNA, 21 bp, Artificial Sequence
  Description of Artificial Sequence: Synthetic oligonucleotide
gaagtttccaaccggttctct

SEQ ID NO: 10270 - protein, 7 aa, Artificial Sequence
  Description of Artificial Sequence: Synthetic peptide
EVSNRFS

SEQ ID NO: 10271 - DNA, 21 bp, Artificial Sequence
  Description of Artificial Sequence: Synthetic oligonucleotide
tgggcatctacccggaaatcc

SEQ ID NO: 10272 - protein, 7 aa, Artificial Sequence
  Description of Artificial Sequence: Synthetic peptide
WASTRKS

SEQ ID NO: 10273 - DNA, 21 bp, Artificial Sequence
  Description of Artificial Sequence: Synthetic oligonucleotide
tggacatctacccggaaatcc

SEQ ID NO: 10274 - protein, 7 aa, Artificial Sequence
  Description of Artificial Sequence: Synthetic peptide
WTSTRKS

SEQ ID NO: 10275 - DNA, 21 bp, Artificial Sequence
  Description of Artificial Sequence: Synthetic oligonucleotide
gctgcatccagtttgcaaagt

SEQ ID NO: 10276 - protein, 7 aa, Artificial Sequence
  Description of Artificial Sequence: Synthetic peptide
AASSLQS

SEQ ID NO: 10277 - DNA, 21 bp, Artificial Sequence
  Description of Artificial Sequence: Synthetic oligonucleotide
tgggcatctaaacgggattcc

SEQ ID NO: 10278 - protein, 7 aa, Artificial Sequence
  Description of Artificial Sequence: Synthetic peptide
WASKRDS

SEQ ID NO: 10279 - DNA, 21 bp, Artificial Sequence
  Description of Artificial Sequence: Synthetic oligonucleotide
gctgcatccagtttgcaaggt

SEQ ID NO: 10280 - protein, 7 aa, Artificial Sequence
  Description of Artificial Sequence: Synthetic peptide
AASSLQG

SEQ ID NO: 10281 - DNA, 21 bp, Artificial Sequence
  Description of Artificial Sequence: Synthetic oligonucleotide
gctgcatccagtttgcaaggt

SEQ ID NO: 10282 - protein, 7 aa, Artificial Sequence
  Description of Artificial Sequence: Synthetic peptide
AASSLQG

SEQ ID NO: 10283 - DNA, 21 bp, Artificial Sequence
  Description of Artificial Sequence: Synthetic oligonucleotide
actgcatccagtttgcaaagt

SEQ ID NO: 10284 - protein, 7 aa, Artificial Sequence
  Description of Artificial Sequence: Synthetic peptide
TASSLQS

SEQ ID NO: 10285 - DNA, 21 bp, Artificial Sequence
  Description of Artificial Sequence: Synthetic oligonucleotide
gaagtttccaatcggttctct

SEQ ID NO: 10286 - protein, 7 aa, Artificial Sequence
  Description of Artificial Sequence: Synthetic peptide
EVSNRFS

SEQ ID NO: 10287 - DNA, 21 bp, Artificial Sequence
  Description of Artificial Sequence: Synthetic oligonucleotide
tgggcatctacccggaaatcc

SEQ ID NO: 10288 - protein, 7 aa, Artificial Sequence
  Description of Artificial Sequence: Synthetic peptide
WASTRKS

SEQ ID NO: 10289 - DNA, 21 bp, Artificial Sequence
  Description of Artificial Sequence: Synthetic oligonucleotide
tggacatctacccgggaatcc

SEQ ID NO: 10290 - protein, 7 aa, Artificial Sequence
  Description of Artificial Sequence: Synthetic peptide
WTSTRES

SEQ ID NO: 10291 - DNA, 21 bp, Artificial Sequence
  Description of Artificial Sequence: Synthetic oligonucleotide
ggtgcatccaccagggccact

SEQ ID NO: 10292 - protein, 7 aa, Artificial Sequence
  Description of Artificial Sequence: Synthetic peptide
GASTRAT

SEQ ID NO: 10293 - DNA, 21 bp, Artificial Sequence
  Description of Artificial Sequence: Synthetic oligonucleotide
gctgcatccagtttgcaaagt

SEQ ID NO: 10294 - protein, 7 aa, Artificial Sequence
  Description of Artificial Sequence: Synthetic peptide
AASSLQS

SEQ ID NO: 10295 - DNA, 21 bp, Artificial Sequence
  Description of Artificial Sequence: Synthetic oligonucleotide
tgggcatctacccgggaatcc

SEQ ID NO: 10296 - protein, 7 aa, Artificial Sequence
  Description of Artificial Sequence: Synthetic peptide
WASTRES

SEQ ID NO: 10297 - DNA, 21 bp, Artificial Sequence
  Description of Artificial Sequence: Synthetic oligonucleotide
actgcatccagtttgcaaagt

SEQ ID NO: 10298 - protein, 7 aa, Artificial Sequence
  Description of Artificial Sequence: Synthetic peptide
TASSLQS

SEQ ID NO: 10299 - DNA, 21 bp, Artificial Sequence
  Description of Artificial Sequence: Synthetic oligonucleotide
gctgcatccagtttgctaagt

SEQ ID NO: 10300 - protein, 7 aa, Artificial Sequence
  Description of Artificial Sequence: Synthetic peptide
AASSLLS

SEQ ID NO: 10301 - DNA, 21 bp, Artificial Sequence
  Description of Artificial Sequence: Synthetic oligonucleotide
gctgcatccagtttgcaaagt

SEQ ID NO: 10302 - protein, 7 aa, Artificial Sequence
  Description of Artificial Sequence: Synthetic peptide
AASSLQS

SEQ ID NO: 10303 - DNA, 21 bp, Artificial Sequence
  Description of Artificial Sequence: Synthetic oligonucleotide
gctgcatccagtttgcaaagt

SEQ ID NO: 10304 - protein, 7 aa, Artificial Sequence
  Description of Artificial Sequence: Synthetic peptide
AASSLQS

SEQ ID NO: 10305 - DNA, 21 bp, Artificial Sequence
  Description of Artificial Sequence: Synthetic oligonucleotide
actgcatccagtttgcaaagt

SEQ ID NO: 10306 - protein, 7 aa, Artificial Sequence
  Description of Artificial Sequence: Synthetic peptide
TASSLQS

SEQ ID NO: 10307 - DNA, 21 bp, Artificial Sequence
  Description of Artificial Sequence: Synthetic oligonucleotide
gctgcatccagtttgcgaagt

SEQ ID NO: 10308 - protein, 7 aa, Artificial Sequence
  Description of Artificial Sequence: Synthetic peptide
AASSLRS

SEQ ID NO: 10309 - DNA, 21 bp, Artificial Sequence
  Description of Artificial Sequence: Synthetic oligonucleotide
cctgcatccagtttacaaact

SEQ ID NO: 10310 - protein, 7 aa, Artificial Sequence
  Description of Artificial Sequence: Synthetic peptide
PASSLQT

SEQ ID NO: 10311 - DNA, 21 bp, Artificial Sequence
  Description of Artificial Sequence: Synthetic oligonucleotide
gctgcatccagtttacaaagt

SEQ ID NO: 10312 - protein, 7 aa, Artificial Sequence
  Description of Artificial Sequence: Synthetic peptide
AASSLQS

SEQ ID NO: 10313 - DNA, 21 bp, Artificial Sequence
  Description of Artificial Sequence: Synthetic oligonucleotide
gctgcatccagtttgcaaagt

SEQ ID NO: 10314 - protein, 7 aa, Artificial Sequence
  Description of Artificial Sequence: Synthetic peptide
AASSLQS

SEQ ID NO: 10315 - DNA, 21 bp, Artificial Sequence
  Description of Artificial Sequence: Synthetic oligonucleotide
gttgcatccagtttgcaaagt

SEQ ID NO: 10316 - protein, 7 aa, Artificial Sequence
  Description of Artificial Sequence: Synthetic peptide
VASSLQS

SEQ ID NO: 10317 - DNA, 21 bp, Artificial Sequence
  Description of Artificial Sequence: Synthetic oligonucleotide
actgcatccagtttgcaaagt

SEQ ID NO: 10318 - protein, 7 aa, Artificial Sequence
  Description of Artificial Sequence: Synthetic peptide
TASSLQS

SEQ ID NO: 10319 - DNA, 21 bp, Artificial Sequence
  Description of Artificial Sequence: Synthetic oligonucleotide
gaaatttccaagcggttctct

SEQ ID NO: 10320 - protein, 7 aa, Artificial Sequence
  Description of Artificial Sequence: Synthetic peptide
EISKRFS

SEQ ID NO: 10321 - DNA, 21 bp, Artificial Sequence
  Description of Artificial Sequence: Synthetic oligonucleotide
gctgcatccagtttgcaaagt

SEQ ID NO: 10322 - protein, 7 aa, Artificial Sequence
  Description of Artificial Sequence: Synthetic peptide
AASSLQS

SEQ ID NO: 10323 - DNA, 21 bp, Artificial Sequence
  Description of Artificial Sequence: Synthetic oligonucleotide
actgcatccaatttgcaaagt

SEQ ID NO: 10324 - protein, 7 aa, Artificial Sequence
  Description of Artificial Sequence: Synthetic peptide
TASNLQS

SEQ ID NO: 10325 - DNA, 21 bp, Artificial Sequence
  Description of Artificial Sequence: Synthetic oligonucleotide
gctgcatccagtttacagagt

SEQ ID NO: 10326 - protein, 7 aa, Artificial Sequence
  Description of Artificial Sequence: Synthetic peptide
AASSLQS

SEQ ID NO: 10327 - DNA, 21 bp, Artificial Sequence
  Description of Artificial Sequence: Synthetic oligonucleotide
actgcatccaatttgcaaagt

SEQ ID NO: 10328 - protein, 7 aa, Artificial Sequence
  Description of Artificial Sequence: Synthetic peptide
TASNLQS

SEQ ID NO: 10329 - DNA, 21 bp, Artificial Sequence
  Description of Artificial Sequence: Synthetic oligonucleotide
gctgcatccagtttgcaaagt

SEQ ID NO: 10330 - protein, 7 aa, Artificial Sequence
  Description of Artificial Sequence: Synthetic peptide
AASSLQS

SEQ ID NO: 10331 - DNA, 21 bp, Artificial Sequence
  Description of Artificial Sequence: Synthetic oligonucleotide
actgcatccactttacaaagt

SEQ ID NO: 10332 - protein, 7 aa, Artificial Sequence
  Description of Artificial Sequence: Synthetic peptide
TASTLQS

SEQ ID NO: 10333 - DNA, 21 bp, Artificial Sequence
  Description of Artificial Sequence: Synthetic oligonucleotide
gctgcatccagtttgcaaagt

SEQ ID NO: 10334 - protein, 7 aa, Artificial Sequence
  Description of Artificial Sequence: Synthetic peptide
AASSLQS

SEQ ID NO: 10335 - DNA, 21 bp, Artificial Sequence
  Description of Artificial Sequence: Synthetic oligonucleotide
cgtgcatccagtttgcaaagt

SEQ ID NO: 10336 - protein, 7 aa, Artificial Sequence
  Description of Artificial Sequence: Synthetic peptide
RASSLQS

SEQ ID NO: 10337 - DNA, 21 bp, Artificial Sequence
  Description of Artificial Sequence: Synthetic oligonucleotide
actgcatccagtttgcaaagt

SEQ ID NO: 10338 - protein, 7 aa, Artificial Sequence
  Description of Artificial Sequence: Synthetic peptide
TASSLQS

SEQ ID NO: 10339 - DNA, 21 bp, Artificial Sequence
  Description of Artificial Sequence: Synthetic oligonucleotide
actgcatccagtttgcaaagt

SEQ ID NO: 10340 - protein, 7 aa, Artificial Sequence
  Description of Artificial Sequence: Synthetic peptide
TASSLQS

SEQ ID NO: 10341 - DNA, 21 bp, Artificial Sequence
  Description of Artificial Sequence: Synthetic oligonucleotide
tgggcatctacccgggaatcc

SEQ ID NO: 10342 - protein, 7 aa, Artificial Sequence
  Description of Artificial Sequence: Synthetic peptide
WASTRES

SEQ ID NO: 10343 - DNA, 21 bp, Artificial Sequence
  Description of Artificial Sequence: Synthetic oligonucleotide
gctgcatccagtttacaaagt

SEQ ID NO: 10344 - protein, 7 aa, Artificial Sequence
  Description of Artificial Sequence: Synthetic peptide
AASSLQS

SEQ ID NO: 10345 - DNA, 21 bp, Artificial Sequence
  Description of Artificial Sequence: Synthetic oligonucleotide
gatgcatccaatttgcaaagt

SEQ ID NO: 10346 - protein, 7 aa, Artificial Sequence
  Description of Artificial Sequence: Synthetic peptide
DASNLQS

SEQ ID NO: 10347 - DNA, 21 bp, Artificial Sequence
  Description of Artificial Sequence: Synthetic oligonucleotide
gctacatccaatttgcaaagt

SEQ ID NO: 10348 - protein, 7 aa, Artificial Sequence
  Description of Artificial Sequence: Synthetic peptide
ATSNLQS

SEQ ID NO: 10349 - DNA, 21 bp, Artificial Sequence
  Description of Artificial Sequence: Synthetic oligonucleotide
gatgcctccactttggaaaca

SEQ ID NO: 10350 - protein, 7 aa, Artificial Sequence
  Description of Artificial Sequence: Synthetic peptide
DASTLET

SEQ ID NO: 10351 - DNA, 21 bp, Artificial Sequence
  Description of Artificial Sequence: Synthetic oligonucleotide
gctgcatccagtttgcaaagt

SEQ ID NO: 10352 - protein, 7 aa, Artificial Sequence
  Description of Artificial Sequence: Synthetic peptide
AASSLQS

SEQ ID NO: 10353 - DNA, 21 bp, Artificial Sequence
  Description of Artificial Sequence: Synthetic oligonucleotide
gctgcatccagtttgcaaagt

SEQ ID NO: 10354 - protein, 7 aa, Artificial Sequence
  Description of Artificial Sequence: Synthetic peptide
AASSLQS

SEQ ID NO: 10355 - DNA, 21 bp, Artificial Sequence
  Description of Artificial Sequence: Synthetic oligonucleotide
gctgcatccagtttgcaaagt

SEQ ID NO: 10356 - protein, 7 aa, Artificial Sequence
  Description of Artificial Sequence: Synthetic peptide
AASSLQS

SEQ ID NO: 10357 - DNA, 21 bp, Artificial Sequence
  Description of Artificial Sequence: Synthetic oligonucleotide
gctgcatccagtctgcaaagt

SEQ ID NO: 10358 - protein, 7 aa, Artificial Sequence
  Description of Artificial Sequence: Synthetic peptide
AASSLQS

SEQ ID NO: 10359 - DNA, 21 bp, Artificial Sequence
  Description of Artificial Sequence: Synthetic oligonucleotide
gaagtatccaagcggttctct

SEQ ID NO: 10360 - protein, 7 aa, Artificial Sequence
  Description of Artificial Sequence: Synthetic peptide
EVSKRFS

SEQ ID NO: 10361 - DNA, 21 bp, Artificial Sequence
  Description of Artificial Sequence: Synthetic oligonucleotide
gcttcatccagtttgcaaagt

SEQ ID NO: 10362 - protein, 7 aa, Artificial Sequence
  Description of Artificial Sequence: Synthetic peptide
ASSSLQS

SEQ ID NO: 10363 - DNA, 21 bp, Artificial Sequence
  Description of Artificial Sequence: Synthetic oligonucleotide
gctgcatccagtttgcagaat

SEQ ID NO: 10364 - protein, 7 aa, Artificial Sequence
  Description of Artificial Sequence: Synthetic peptide
AASSLQN

SEQ ID NO: 10365 - DNA, 21 bp, Artificial Sequence
  Description of Artificial Sequence: Synthetic oligonucleotide
actgcatccaatttgcaaagt

SEQ ID NO: 10366 - protein, 7 aa, Artificial Sequence
  Description of Artificial Sequence: Synthetic peptide
TASNLQS

SEQ ID NO: 10367 - DNA, 21 bp, Artificial Sequence
  Description of Artificial Sequence: Synthetic oligonucleotide
gcttcatccagtttgcaaagt

SEQ ID NO: 10368 - protein, 7 aa, Artificial Sequence
  Description of Artificial Sequence: Synthetic peptide
ASSSLQS

SEQ ID NO: 10369 - DNA, 21 bp, Artificial Sequence
  Description of Artificial Sequence: Synthetic oligonucleotide
gctgcatccagtttgcaaagt

SEQ ID NO: 10370 - protein, 7 aa, Artificial Sequence
  Description of Artificial Sequence: Synthetic peptide
AASSLQS

SEQ ID NO: 10371 - DNA, 21 bp, Artificial Sequence
  Description of Artificial Sequence: Synthetic oligonucleotide
tgggcatctacccgggaatcc

SEQ ID NO: 10372 - protein, 7 aa, Artificial Sequence
  Description of Artificial Sequence: Synthetic peptide
WASTRES

SEQ ID NO: 10373 - DNA, 21 bp, Artificial Sequence
  Description of Artificial Sequence: Synthetic oligonucleotide
gctgcatccagtttgcaaagt

SEQ ID NO: 10374 - protein, 7 aa, Artificial Sequence
  Description of Artificial Sequence: Synthetic peptide
AASSLQS

SEQ ID NO: 10375 - DNA, 21 bp, Artificial Sequence
  Description of Artificial Sequence: Synthetic oligonucleotide
gttgcatccagtttgcaaagt

SEQ ID NO: 10376 - protein, 7 aa, Artificial Sequence
  Description of Artificial Sequence: Synthetic peptide
VASSLQS

SEQ ID NO: 10377 - DNA, 21 bp, Artificial Sequence
  Description of Artificial Sequence: Synthetic oligonucleotide
gttgcatccagtttgcaaagt

SEQ ID NO: 10378 - protein, 7 aa, Artificial Sequence
  Description of Artificial Sequence: Synthetic peptide
VASSLQS

SEQ ID NO: 10379 - DNA, 21 bp, Artificial Sequence
  Description of Artificial Sequence: Synthetic oligonucleotide
gctgcatccagtttgcaaagt

SEQ ID NO: 10380 - protein, 7 aa, Artificial Sequence
  Description of Artificial Sequence: Synthetic peptide
AASSLQS

SEQ ID NO: 10381 - DNA, 21 bp, Artificial Sequence
  Description of Artificial Sequence: Synthetic oligonucleotide
gaagtttccaaacggttctct

SEQ ID NO: 10382 - protein, 7 aa, Artificial Sequence
  Description of Artificial Sequence: Synthetic peptide
EVSKRFS

SEQ ID NO: 10383 - DNA, 21 bp, Artificial Sequence
  Description of Artificial Sequence: Synthetic oligonucleotide
ggtgcatccatcagggccact

SEQ ID NO: 10384 - protein, 7 aa, Artificial Sequence
  Description of Artificial Sequence: Synthetic peptide
GASIRAT

SEQ ID NO: 10385 - DNA, 21 bp, Artificial Sequence
  Description of Artificial Sequence: Synthetic oligonucleotide
gatgcatccaatttggaaaca

SEQ ID NO: 10386 - protein, 7 aa, Artificial Sequence
  Description of Artificial Sequence: Synthetic peptide
DASNLET

SEQ ID NO: 10387 - DNA, 21 bp, Artificial Sequence
  Description of Artificial Sequence: Synthetic oligonucleotide
gctgcatccactttgcaaagt

SEQ ID NO: 10388 - protein, 7 aa, Artificial Sequence
  Description of Artificial Sequence: Synthetic peptide
AASTLQS

SEQ ID NO: 10389 - DNA, 21 bp, Artificial Sequence
  Description of Artificial Sequence: Synthetic oligonucleotide
gatgcatccaattgggaaaca

SEQ ID NO: 10390 - protein, 7 aa, Artificial Sequence
  Description of Artificial Sequence: Synthetic peptide
DASNWET

SEQ ID NO: 10391 - DNA, 21 bp, Artificial Sequence
  Description of Artificial Sequence: Synthetic oligonucleotide
gctgcatccactttgcaaagt

SEQ ID NO: 10392 - protein, 7 aa, Artificial Sequence
  Description of Artificial Sequence: Synthetic peptide
AASTLQS

SEQ ID NO: 10393 - DNA, 21 bp, Artificial Sequence
  Description of Artificial Sequence: Synthetic oligonucleotide
gctgcatccagtttgcaaagt

SEQ ID NO: 10394 - protein, 7 aa, Artificial Sequence
  Description of Artificial Sequence: Synthetic peptide
AASSLQS

SEQ ID NO: 10395 - DNA, 21 bp, Artificial Sequence
  Description of Artificial Sequence: Synthetic oligonucleotide
gctgcatccagtttgcaaagt

SEQ ID NO: 10396 - protein, 7 aa, Artificial Sequence
  Description of Artificial Sequence: Synthetic peptide
AASSLQS

SEQ ID NO: 10397 - DNA, 21 bp, Artificial Sequence
  Description of Artificial Sequence: Synthetic oligonucleotide
gctgcatccagtttgcaaagt

SEQ ID NO: 10398 - protein, 7 aa, Artificial Sequence
  Description of Artificial Sequence: Synthetic peptide
AASSLQS

SEQ ID NO: 10399 - DNA, 21 bp, Artificial Sequence
  Description of Artificial Sequence: Synthetic oligonucleotide
cggacatctatccggaaatcc

SEQ ID NO: 10400 - protein, 7 aa, Artificial Sequence
  Description of Artificial Sequence: Synthetic peptide
RTSIRKS

SEQ ID NO: 10401 - DNA, 21 bp, Artificial Sequence
  Description of Artificial Sequence: Synthetic oligonucleotide
tgggcatctacccgggaatcc

SEQ ID NO: 10402 - protein, 7 aa, Artificial Sequence
  Description of Artificial Sequence: Synthetic peptide
WASTRES

SEQ ID NO: 10403 - DNA, 21 bp, Artificial Sequence
  Description of Artificial Sequence: Synthetic oligonucleotide
gaagtttccaagcggttctct

SEQ ID NO: 10404 - protein, 7 aa, Artificial Sequence
  Description of Artificial Sequence: Synthetic peptide
EVSKRFS

SEQ ID NO: 10405 - DNA, 21 bp, Artificial Sequence
  Description of Artificial Sequence: Synthetic oligonucleotide
gctgcatccagtttgcaaagt

SEQ ID NO: 10406 - protein, 7 aa, Artificial Sequence
  Description of Artificial Sequence: Synthetic peptide
AASSLQS

SEQ ID NO: 10407 - DNA, 21 bp, Artificial Sequence
  Description of Artificial Sequence: Synthetic oligonucleotide
cctgcatccagtttgcaaagt

SEQ ID NO: 10408 - protein, 7 aa, Artificial Sequence
  Description of Artificial Sequence: Synthetic peptide
PASSLQS

SEQ ID NO: 10409 - DNA, 21 bp, Artificial Sequence
  Description of Artificial Sequence: Synthetic oligonucleotide
gctgcatccagtttgctaagt

SEQ ID NO: 10410 - protein, 7 aa, Artificial Sequence
  Description of Artificial Sequence: Synthetic peptide
AASSLLS

SEQ ID NO: 10411 - DNA, 21 bp, Artificial Sequence
  Description of Artificial Sequence: Synthetic oligonucleotide
cctgcatccagtttgcaaagt

SEQ ID NO: 10412 - protein, 7 aa, Artificial Sequence
  Description of Artificial Sequence: Synthetic peptide
PASSLQS

SEQ ID NO: 10413 - DNA, 21 bp, Artificial Sequence
  Description of Artificial Sequence: Synthetic oligonucleotide
cctgcatccagtttgcaaagt

SEQ ID NO: 10414 - protein, 7 aa, Artificial Sequence
  Description of Artificial Sequence: Synthetic peptide
PASSLQS

SEQ ID NO: 10415 - DNA, 21 bp, Artificial Sequence
  Description of Artificial Sequence: Synthetic oligonucleotide
tgggcatctacccgagaatcc

SEQ ID NO: 10416 - protein, 7 aa, Artificial Sequence
  Description of Artificial Sequence: Synthetic peptide
WASTRES

SEQ ID NO: 10417 - DNA, 21 bp, Artificial Sequence
  Description of Artificial Sequence: Synthetic oligonucleotide
gctgcatccagtttgcaaagt

SEQ ID NO: 10418 - protein, 7 aa, Artificial Sequence
  Description of Artificial Sequence: Synthetic peptide
AASSLQS

SEQ ID NO: 10419 - DNA, 21 bp, Artificial Sequence
  Description of Artificial Sequence: Synthetic oligonucleotide
gaagtttccaaacggttctct

SEQ ID NO: 10420 - protein, 7 aa, Artificial Sequence
  Description of Artificial Sequence: Synthetic peptide
EVSKRFS

SEQ ID NO: 10421 - DNA, 21 bp, Artificial Sequence
  Description of Artificial Sequence: Synthetic oligonucleotide
gaagtttccaaacggttctct

SEQ ID NO: 10422 - protein, 7 aa, Artificial Sequence
  Description of Artificial Sequence: Synthetic peptide
EVSKRFS

SEQ ID NO: 10423 - DNA, 21 bp, Artificial Sequence
  Description of Artificial Sequence: Synthetic oligonucleotide
gctgcatccagtttgcaaagt

SEQ ID NO: 10424 - protein, 7 aa, Artificial Sequence
  Description of Artificial Sequence: Synthetic peptide
AASSLQS

SEQ ID NO: 10425 - DNA, 21 bp, Artificial Sequence
  Description of Artificial Sequence: Synthetic oligonucleotide
gctgaatccagtttgcaaagt

SEQ ID NO: 10426 - protein, 7 aa, Artificial Sequence
  Description of Artificial Sequence: Synthetic peptide
AESSLQS

SEQ ID NO: 10427 - DNA, 21 bp, Artificial Sequence
  Description of Artificial Sequence: Synthetic oligonucleotide
tgggcatctacccgggaatcc

SEQ ID NO: 10428 - protein, 7 aa, Artificial Sequence
  Description of Artificial Sequence: Synthetic peptide
WASTRES

SEQ ID NO: 10429 - DNA, 21 bp, Artificial Sequence
  Description of Artificial Sequence: Synthetic oligonucleotide
ttgggttctaatcgggcctcc

SEQ ID NO: 10430 - protein, 7 aa, Artificial Sequence
  Description of Artificial Sequence: Synthetic peptide
LGSNRAS

SEQ ID NO: 10431 - DNA, 21 bp, Artificial Sequence
  Description of Artificial Sequence: Synthetic oligonucleotide
gctgcatccagtttgcaaagt

SEQ ID NO: 10432 - protein, 7 aa, Artificial Sequence
  Description of Artificial Sequence: Synthetic peptide
AASSLQS

SEQ ID NO: 10433 - DNA, 21 bp, Artificial Sequence
  Description of Artificial Sequence: Synthetic oligonucleotide
tgggcatctacccgggaatcc

SEQ ID NO: 10434 - protein, 7 aa, Artificial Sequence
  Description of Artificial Sequence: Synthetic peptide
WASTRES

SEQ ID NO: 10435 - DNA, 21 bp, Artificial Sequence
  Description of Artificial Sequence: Synthetic oligonucleotide
ttgggttctaatcgggcctcc

SEQ ID NO: 10436 - protein, 7 aa, Artificial Sequence
  Description of Artificial Sequence: Synthetic peptide
LGSNRAS

SEQ ID NO: 10437 - DNA, 21 bp, Artificial Sequence
  Description of Artificial Sequence: Synthetic oligonucleotide
gctgcatccagtttgcaaagt

SEQ ID NO: 10438 - protein, 7 aa, Artificial Sequence
  Description of Artificial Sequence: Synthetic peptide
AASSLQS

SEQ ID NO: 10439 - DNA, 21 bp, Artificial Sequence
  Description of Artificial Sequence: Synthetic oligonucleotide
tctgcatccagtttgcaaagt

SEQ ID NO: 10440 - protein, 7 aa, Artificial Sequence
  Description of Artificial Sequence: Synthetic peptide
SASSLQS

SEQ ID NO: 10441 - DNA, 21 bp, Artificial Sequence
  Description of Artificial Sequence: Synthetic oligonucleotide
gctgcatccagtttgcaaagt

SEQ ID NO: 10442 - protein, 7 aa, Artificial Sequence
  Description of Artificial Sequence: Synthetic peptide
AASSLQS

SEQ ID NO: 10443 - DNA, 21 bp, Artificial Sequence
  Description of Artificial Sequence: Synthetic oligonucleotide
gctgcatccagtttgcaaagt

SEQ ID NO: 10444 - protein, 7 aa, Artificial Sequence
  Description of Artificial Sequence: Synthetic peptide
AASSLQS

SEQ ID NO: 10445 - DNA, 21 bp, Artificial Sequence
  Description of Artificial Sequence: Synthetic oligonucleotide
gaagtttccaaccggttctct

SEQ ID NO: 10446 - protein, 7 aa, Artificial Sequence
  Description of Artificial Sequence: Synthetic peptide
EVSNRFS

SEQ ID NO: 10447 - DNA, 21 bp, Artificial Sequence
  Description of Artificial Sequence: Synthetic oligonucleotide
gctgcatccagtttgcaaagt

SEQ ID NO: 10448 - protein, 7 aa, Artificial Sequence
  Description of Artificial Sequence: Synthetic peptide
AASSLQS

SEQ ID NO: 10449 - DNA, 21 bp, Artificial Sequence
  Description of Artificial Sequence: Synthetic oligonucleotide
gctacatccagtttgcaaagt

SEQ ID NO: 10450 - protein, 7 aa, Artificial Sequence
  Description of Artificial Sequence: Synthetic peptide
ATSSLQS

SEQ ID NO: 10451 - DNA, 21 bp, Artificial Sequence
  Description of Artificial Sequence: Synthetic oligonucleotide
gctgcatccagtttgcaaagt

SEQ ID NO: 10452 - protein, 7 aa, Artificial Sequence
  Description of Artificial Sequence: Synthetic peptide
AASSLQS

SEQ ID NO: 10453 - DNA, 21 bp, Artificial Sequence
  Description of Artificial Sequence: Synthetic oligonucleotide
gctgcatccactttgcaaagt

SEQ ID NO: 10454 - protein, 7 aa, Artificial Sequence
  Description of Artificial Sequence: Synthetic peptide
AASTLQS

SEQ ID NO: 10455 - DNA, 21 bp, Artificial Sequence
  Description of Artificial Sequence: Synthetic oligonucleotide
gctgcatccagtttgcaaaat

SEQ ID NO: 10456 - protein, 7 aa, Artificial Sequence
  Description of Artificial Sequence: Synthetic peptide
AASSLQN

SEQ ID NO: 10457 - DNA, 21 bp, Artificial Sequence
  Description of Artificial Sequence: Synthetic oligonucleotide
actgcatccagtttgcaaagt

SEQ ID NO: 10458 - protein, 7 aa, Artificial Sequence
  Description of Artificial Sequence: Synthetic peptide
TASSLQS

SEQ ID NO: 10459 - DNA, 21 bp, Artificial Sequence
  Description of Artificial Sequence: Synthetic oligonucleotide
tctgcgtccagtttgcaaagt

SEQ ID NO: 10460 - protein, 7 aa, Artificial Sequence
  Description of Artificial Sequence: Synthetic peptide
SASSLQS

SEQ ID NO: 10461 - DNA, 21 bp, Artificial Sequence
  Description of Artificial Sequence: Synthetic oligonucleotide
tgggcatctacccggaaatcc

SEQ ID NO: 10462 - protein, 7 aa, Artificial Sequence
  Description of Artificial Sequence: Synthetic peptide
WASTRKS

SEQ ID NO: 10463 - DNA, 21 bp, Artificial Sequence
  Description of Artificial Sequence: Synthetic oligonucleotide
gctgcatccagtttgcaaaat

SEQ ID NO: 10464 - protein, 7 aa, Artificial Sequence
  Description of Artificial Sequence: Synthetic peptide
AASSLQN

SEQ ID NO: 10465 - DNA, 21 bp, Artificial Sequence
  Description of Artificial Sequence: Synthetic oligonucleotide
actgcatccagtttgcaaagt

SEQ ID NO: 10466 - protein, 7 aa, Artificial Sequence
  Description of Artificial Sequence: Synthetic peptide
TASSLQS

SEQ ID NO: 10467 - DNA, 21 bp, Artificial Sequence
  Description of Artificial Sequence: Synthetic oligonucleotide
actgcatccagtttgcaaagt

SEQ ID NO: 10468 - protein, 7 aa, Artificial Sequence
  Description of Artificial Sequence: Synthetic peptide
TASSLQS

SEQ ID NO: 10469 - DNA, 21 bp, Artificial Sequence
  Description of Artificial Sequence: Synthetic oligonucleotide
gatgcatcaagtttgcaaagt

SEQ ID NO: 10470 - protein, 7 aa, Artificial Sequence
  Description of Artificial Sequence: Synthetic peptide
DASSLQS

SEQ ID NO: 10471 - DNA, 21 bp, Artificial Sequence
  Description of Artificial Sequence: Synthetic oligonucleotide
gtgggttctaatcgggcctcc

SEQ ID NO: 10472 - protein, 7 aa, Artificial Sequence
  Description of Artificial Sequence: Synthetic peptide
VGSNRAS

SEQ ID NO: 10473 - DNA, 21 bp, Artificial Sequence
  Description of Artificial Sequence: Synthetic oligonucleotide
gctgcattcagtttgcaaggt

SEQ ID NO: 10474 - protein, 7 aa, Artificial Sequence
  Description of Artificial Sequence: Synthetic peptide
AAFSLQG

SEQ ID NO: 10475 - DNA, 21 bp, Artificial Sequence
  Description of Artificial Sequence: Synthetic oligonucleotide
gatgcatccagtttgcaaagt

SEQ ID NO: 10476 - protein, 7 aa, Artificial Sequence
  Description of Artificial Sequence: Synthetic peptide
DASSLQS

SEQ ID NO: 10477 - DNA, 21 bp, Artificial Sequence
  Description of Artificial Sequence: Synthetic oligonucleotide
cctgcatccagtttgcaaagt

SEQ ID NO: 10478 - protein, 7 aa, Artificial Sequence
  Description of Artificial Sequence: Synthetic peptide
PASSLQS

SEQ ID NO: 10479 - DNA, 21 bp, Artificial Sequence
  Description of Artificial Sequence: Synthetic oligonucleotide
gctgaatccagtttgcaaagt

SEQ ID NO: 10480 - protein, 7 aa, Artificial Sequence
  Description of Artificial Sequence: Synthetic peptide
AESSLQS

SEQ ID NO: 10481 - DNA, 21 bp, Artificial Sequence
  Description of Artificial Sequence: Synthetic oligonucleotide
gaagtttcccaccggttctct

SEQ ID NO: 10482 - protein, 7 aa, Artificial Sequence
  Description of Artificial Sequence: Synthetic peptide
EVSHRFS

SEQ ID NO: 10483 - DNA, 21 bp, Artificial Sequence
  Description of Artificial Sequence: Synthetic oligonucleotide
gctgcatccagtttgcaaaat

SEQ ID NO: 10484 - protein, 7 aa, Artificial Sequence
  Description of Artificial Sequence: Synthetic peptide
AASSLQN

SEQ ID NO: 10485 - DNA, 21 bp, Artificial Sequence
  Description of Artificial Sequence: Synthetic oligonucleotide
tgggcatctactcgggaatcc

SEQ ID NO: 10486 - protein, 7 aa, Artificial Sequence
  Description of Artificial Sequence: Synthetic peptide
WASTRES

SEQ ID NO: 10487 - DNA, 21 bp, Artificial Sequence
  Description of Artificial Sequence: Synthetic oligonucleotide
gctgcatccagtttgcaaatt

SEQ ID NO: 10488 - protein, 7 aa, Artificial Sequence
  Description of Artificial Sequence: Synthetic peptide
AASSLQI

SEQ ID NO: 10489 - DNA, 21 bp, Artificial Sequence
  Description of Artificial Sequence: Synthetic oligonucleotide
gaagtttccaaccggttctct

SEQ ID NO: 10490 - protein, 7 aa, Artificial Sequence
  Description of Artificial Sequence: Synthetic peptide
EVSNRFS

SEQ ID NO: 10491 - DNA, 21 bp, Artificial Sequence
  Description of Artificial Sequence: Synthetic oligonucleotide
gaagtttcccaccggttctct

SEQ ID NO: 10492 - protein, 7 aa, Artificial Sequence
  Description of Artificial Sequence: Synthetic peptide
EVSHRFS

SEQ ID NO: 10493 - DNA, 21 bp, Artificial Sequence
  Description of Artificial Sequence: Synthetic oligonucleotide
actacatccagtttgcaaagt

SEQ ID NO: 10494 - protein, 7 aa, Artificial Sequence
  Description of Artificial Sequence: Synthetic peptide
TTSSLQS

SEQ ID NO: 10495 - DNA, 21 bp, Artificial Sequence
  Description of Artificial Sequence: Synthetic oligonucleotide
tgggcatctacccgggaatcc

SEQ ID NO: 10496 - protein, 7 aa, Artificial Sequence
  Description of Artificial Sequence: Synthetic peptide
WASTRES

SEQ ID NO: 10497 - DNA, 21 bp, Artificial Sequence
  Description of Artificial Sequence: Synthetic oligonucleotide
gctgcattcagtttgcaaggt

SEQ ID NO: 10498 - protein, 7 aa, Artificial Sequence
  Description of Artificial Sequence: Synthetic peptide
AAFSLQG

SEQ ID NO: 10499 - DNA, 21 bp, Artificial Sequence
  Description of Artificial Sequence: Synthetic oligonucleotide
gctgcatccagtttgcaaagt

SEQ ID NO: 10500 - protein, 7 aa, Artificial Sequence
  Description of Artificial Sequence: Synthetic peptide
AASSLQS

SEQ ID NO: 10501 - DNA, 21 bp, Artificial Sequence
  Description of Artificial Sequence: Synthetic oligonucleotide
actgcatccagtttgcaaagt

SEQ ID NO: 10502 - protein, 7 aa, Artificial Sequence
  Description of Artificial Sequence: Synthetic peptide
TASSLQS

SEQ ID NO: 10503 - DNA, 21 bp, Artificial Sequence
  Description of Artificial Sequence: Synthetic oligonucleotide
tctgcatccagtttgcaaagt

SEQ ID NO: 10504 - protein, 7 aa, Artificial Sequence
  Description of Artificial Sequence: Synthetic peptide
SASSLQS

SEQ ID NO: 10505 - DNA, 21 bp, Artificial Sequence
  Description of Artificial Sequence: Synthetic oligonucleotide
gctgcatccggtttgcaaagt

SEQ ID NO: 10506 - protein, 7 aa, Artificial Sequence
  Description of Artificial Sequence: Synthetic peptide
AASGLQS

SEQ ID NO: 10507 - DNA, 21 bp, Artificial Sequence
  Description of Artificial Sequence: Synthetic oligonucleotide
gctgcatccagtttgcaaagt

SEQ ID NO: 10508 - protein, 7 aa, Artificial Sequence
  Description of Artificial Sequence: Synthetic peptide
AASSLQS

SEQ ID NO: 10509 - DNA, 21 bp, Artificial Sequence
  Description of Artificial Sequence: Synthetic oligonucleotide
tggacatctacccgggaatcc

SEQ ID NO: 10510 - protein, 7 aa, Artificial Sequence
  Description of Artificial Sequence: Synthetic peptide
WTSTRES

SEQ ID NO: 10511 - DNA, 21 bp, Artificial Sequence
  Description of Artificial Sequence: Synthetic oligonucleotide
gctgcatccagtttgcacagt

SEQ ID NO: 10512 - protein, 7 aa, Artificial Sequence
  Description of Artificial Sequence: Synthetic peptide
AASSLHS

SEQ ID NO: 10513 - DNA, 21 bp, Artificial Sequence
  Description of Artificial Sequence: Synthetic oligonucleotide
gaagtttccaaccggttctct

SEQ ID NO: 10514 - protein, 7 aa, Artificial Sequence
  Description of Artificial Sequence: Synthetic peptide
EVSNRFS

SEQ ID NO: 10515 - DNA, 21 bp, Artificial Sequence
  Description of Artificial Sequence: Synthetic oligonucleotide
ttgggttctaatcgggcctcc

SEQ ID NO: 10516 - protein, 7 aa, Artificial Sequence
  Description of Artificial Sequence: Synthetic peptide
LGSNRAS

SEQ ID NO: 10517 - DNA, 21 bp, Artificial Sequence
  Description of Artificial Sequence: Synthetic oligonucleotide
gctgcatccagtttgcaaagt

SEQ ID NO: 10518 - protein, 7 aa, Artificial Sequence
  Description of Artificial Sequence: Synthetic peptide
AASSLQS

SEQ ID NO: 10519 - DNA, 21 bp, Artificial Sequence
  Description of Artificial Sequence: Synthetic oligonucleotide
gctgcatccagtttgcaaagt

SEQ ID NO: 10520 - protein, 7 aa, Artificial Sequence
  Description of Artificial Sequence: Synthetic peptide
AASSLQS

SEQ ID NO: 10521 - DNA, 21 bp, Artificial Sequence
  Description of Artificial Sequence: Synthetic oligonucleotide
gctgcatccagtttgcaaagt

SEQ ID NO: 10522 - protein, 7 aa, Artificial Sequence
  Description of Artificial Sequence: Synthetic peptide
AASSLQS

SEQ ID NO: 10523 - DNA, 21 bp, Artificial Sequence
  Description of Artificial Sequence: Synthetic oligonucleotide
gctgcatccagtttgcaaagt

SEQ ID NO: 10524 - protein, 7 aa, Artificial Sequence
  Description of Artificial Sequence: Synthetic peptide
AASSLQS

SEQ ID NO: 10525 - DNA, 21 bp, Artificial Sequence
  Description of Artificial Sequence: Synthetic oligonucleotide
gctgcatccagtttgcaaagt

SEQ ID NO: 10526 - protein, 7 aa, Artificial Sequence
  Description of Artificial Sequence: Synthetic peptide
AASSLQS

SEQ ID NO: 10527 - DNA, 21 bp, Artificial Sequence
  Description of Artificial Sequence: Synthetic oligonucleotide
gaagtttccaaccggttctct

SEQ ID NO: 10528 - protein, 7 aa, Artificial Sequence
  Description of Artificial Sequence: Synthetic peptide
EVSNRFS

SEQ ID NO: 10529 - DNA, 21 bp, Artificial Sequence
  Description of Artificial Sequence: Synthetic oligonucleotide
tgggcatctacccgggaatcc

SEQ ID NO: 10530 - protein, 7 aa, Artificial Sequence
  Description of Artificial Sequence: Synthetic peptide
WASTRES

SEQ ID NO: 10531 - DNA, 21 bp, Artificial Sequence
  Description of Artificial Sequence: Synthetic oligonucleotide
gctgcttccagtttgcaaagt

SEQ ID NO: 10532 - protein, 7 aa, Artificial Sequence
  Description of Artificial Sequence: Synthetic peptide
AASSLQS

SEQ ID NO: 10533 - DNA, 21 bp, Artificial Sequence
  Description of Artificial Sequence: Synthetic oligonucleotide
gctgcatccagtttgcagagt

SEQ ID NO: 10534 - protein, 7 aa, Artificial Sequence
  Description of Artificial Sequence: Synthetic peptide
AASSLQS

SEQ ID NO: 10535 - DNA, 21 bp, Artificial Sequence
  Description of Artificial Sequence: Synthetic oligonucleotide
gctgcatccagtttgcaaaat

SEQ ID NO: 10536 - protein, 7 aa, Artificial Sequence
  Description of Artificial Sequence: Synthetic peptide
AASSLQN

SEQ ID NO: 10537 - DNA, 21 bp, Artificial Sequence
  Description of Artificial Sequence: Synthetic oligonucleotide
gaagtttccaaccggttttct

SEQ ID NO: 10538 - protein, 7 aa, Artificial Sequence
  Description of Artificial Sequence: Synthetic peptide
EVSNRFS

SEQ ID NO: 10539 - DNA, 21 bp, Artificial Sequence
  Description of Artificial Sequence: Synthetic oligonucleotide
gctgcatccagtttgcaaagt

SEQ ID NO: 10540 - protein, 7 aa, Artificial Sequence
  Description of Artificial Sequence: Synthetic peptide
AASSLQS

SEQ ID NO: 10541 - DNA, 21 bp, Artificial Sequence
  Description of Artificial Sequence: Synthetic oligonucleotide
gaggtttcccaccggttctct

SEQ ID NO: 10542 - protein, 7 aa, Artificial Sequence
  Description of Artificial Sequence: Synthetic peptide
EVSHRFS

SEQ ID NO: 10543 - DNA, 21 bp, Artificial Sequence
  Description of Artificial Sequence: Synthetic oligonucleotide
gctgcatccagtttgcaaagt

SEQ ID NO: 10544 - protein, 7 aa, Artificial Sequence
  Description of Artificial Sequence: Synthetic peptide
AASSLQS

SEQ ID NO: 10545 - DNA, 21 bp, Artificial Sequence
  Description of Artificial Sequence: Synthetic oligonucleotide
gcaacttccaaccggttccct

SEQ ID NO: 10546 - protein, 7 aa, Artificial Sequence
  Description of Artificial Sequence: Synthetic peptide
ATSNRFP

SEQ ID NO: 10547 - DNA, 21 bp, Artificial Sequence
  Description of Artificial Sequence: Synthetic oligonucleotide
actgcatccagtttgcaaagt

SEQ ID NO: 10548 - protein, 7 aa, Artificial Sequence
  Description of Artificial Sequence: Synthetic peptide
TASSLQS

SEQ ID NO: 10549 - DNA, 21 bp, Artificial Sequence
  Description of Artificial Sequence: Synthetic oligonucleotide
ggtgtatccagtttacaaagt

SEQ ID NO: 10550 - protein, 7 aa, Artificial Sequence
  Description of Artificial Sequence: Synthetic peptide
GVSSLQS

SEQ ID NO: 10551 - DNA, 21 bp, Artificial Sequence
  Description of Artificial Sequence: Synthetic oligonucleotide
gaagtttccaaccggttctct

SEQ ID NO: 10552 - protein, 7 aa, Artificial Sequence
  Description of Artificial Sequence: Synthetic peptide
EVSNRFS

SEQ ID NO: 10553 - DNA, 21 bp, Artificial Sequence
  Description of Artificial Sequence: Synthetic oligonucleotide
gctgcatccagtttgcaaagt

SEQ ID NO: 10554 - protein, 7 aa, Artificial Sequence
  Description of Artificial Sequence: Synthetic peptide
AASSLQS

SEQ ID NO: 10555 - DNA, 21 bp, Artificial Sequence
  Description of Artificial Sequence: Synthetic oligonucleotide
actacattgaatttgcaaagt

SEQ ID NO: 10556 - protein, 7 aa, Artificial Sequence
  Description of Artificial Sequence: Synthetic peptide
TTLNLQS

SEQ ID NO: 10557 - DNA, 21 bp, Artificial Sequence
  Description of Artificial Sequence: Synthetic oligonucleotide
tgggcatctacccgggaatcc

SEQ ID NO: 10558 - protein, 7 aa, Artificial Sequence
  Description of Artificial Sequence: Synthetic peptide
WASTRES

SEQ ID NO: 10559 - DNA, 21 bp, Artificial Sequence
  Description of Artificial Sequence: Synthetic oligonucleotide
actgcatccagtttgcaaagt

SEQ ID NO: 10560 - protein, 7 aa, Artificial Sequence
  Description of Artificial Sequence: Synthetic peptide
TASSLQS

SEQ ID NO: 10561 - DNA, 21 bp, Artificial Sequence
  Description of Artificial Sequence: Synthetic oligonucleotide
gaagtttccaatcggttctct

SEQ ID NO: 10562 - protein, 7 aa, Artificial Sequence
  Description of Artificial Sequence: Synthetic peptide
EVSNRFS

SEQ ID NO: 10563 - DNA, 21 bp, Artificial Sequence
  Description of Artificial Sequence: Synthetic oligonucleotide
gctgcatccagtttacaaagt

SEQ ID NO: 10564 - protein, 7 aa, Artificial Sequence
  Description of Artificial Sequence: Synthetic peptide
AASSLQS

SEQ ID NO: 10565 - DNA, 21 bp, Artificial Sequence
  Description of Artificial Sequence: Synthetic oligonucleotide
gatgcatccaatttggaaaca

SEQ ID NO: 10566 - protein, 7 aa, Artificial Sequence
  Description of Artificial Sequence: Synthetic peptide
DASNLET

SEQ ID NO: 10567 - DNA, 21 bp, Artificial Sequence
  Description of Artificial Sequence: Synthetic oligonucleotide
gttgtatccagtttgcaaagt

SEQ ID NO: 10568 - protein, 7 aa, Artificial Sequence
  Description of Artificial Sequence: Synthetic peptide
VVSSLQS

SEQ ID NO: 10569 - DNA, 21 bp, Artificial Sequence
  Description of Artificial Sequence: Synthetic oligonucleotide
ggtgcatccagcagggccact

SEQ ID NO: 10570 - protein, 7 aa, Artificial Sequence
  Description of Artificial Sequence: Synthetic peptide
GASSRAT

SEQ ID NO: 10571 - DNA, 21 bp, Artificial Sequence
  Description of Artificial Sequence: Synthetic oligonucleotide
tctgcttcccagtccttctca

SEQ ID NO: 10572 - protein, 7 aa, Artificial Sequence
  Description of Artificial Sequence: Synthetic peptide
SASQSFS

SEQ ID NO: 10573 - DNA, 21 bp, Artificial Sequence
  Description of Artificial Sequence: Synthetic oligonucleotide
aaaacatccagtttacaaagt

SEQ ID NO: 10574 - protein, 7 aa, Artificial Sequence
  Description of Artificial Sequence: Synthetic peptide
KTSSLQS

SEQ ID NO: 10575 - DNA, 21 bp, Artificial Sequence
  Description of Artificial Sequence: Synthetic oligonucleotide
ggtgcatccaccagggccact

SEQ ID NO: 10576 - protein, 7 aa, Artificial Sequence
  Description of Artificial Sequence: Synthetic peptide
GASTRAT

SEQ ID NO: 10577 - DNA, 21 bp, Artificial Sequence
  Description of Artificial Sequence: Synthetic oligonucleotide
tatgcttcccagtccttctca

SEQ ID NO: 10578 - protein, 7 aa, Artificial Sequence
  Description of Artificial Sequence: Synthetic peptide
YASQSFS

SEQ ID NO: 10579 - DNA, 21 bp, Artificial Sequence
  Description of Artificial Sequence: Synthetic oligonucleotide
aaagcatccagtttgcaaagt

SEQ ID NO: 10580 - protein, 7 aa, Artificial Sequence
  Description of Artificial Sequence: Synthetic peptide
KASSLQS

SEQ ID NO: 10581 - DNA, 21 bp, Artificial Sequence
  Description of Artificial Sequence: Synthetic oligonucleotide
gaggtttccaaccggttcgct

SEQ ID NO: 10582 - protein, 7 aa, Artificial Sequence
  Description of Artificial Sequence: Synthetic peptide
EVSNRFA

SEQ ID NO: 10583 - DNA, 21 bp, Artificial Sequence
  Description of Artificial Sequence: Synthetic oligonucleotide
tatgcttcccagtccttctca

SEQ ID NO: 10584 - protein, 7 aa, Artificial Sequence
  Description of Artificial Sequence: Synthetic peptide
YASQSFS

SEQ ID NO: 10585 - DNA, 21 bp, Artificial Sequence
  Description of Artificial Sequence: Synthetic oligonucleotide
actgcatccagtttgcaaagt

SEQ ID NO: 10586 - protein, 7 aa, Artificial Sequence
  Description of Artificial Sequence: Synthetic peptide
TASSLQS

SEQ ID NO: 10587 - DNA, 21 bp, Artificial Sequence
  Description of Artificial Sequence: Synthetic oligonucleotide
gttgcatccactttgcaatca

SEQ ID NO: 10588 - protein, 7 aa, Artificial Sequence
  Description of Artificial Sequence: Synthetic peptide
VASTLQS

SEQ ID NO: 10589 - DNA, 21 bp, Artificial Sequence
  Description of Artificial Sequence: Synthetic oligonucleotide
gctgcatccagtttgcaaagt

SEQ ID NO: 10590 - protein, 7 aa, Artificial Sequence
  Description of Artificial Sequence: Synthetic peptide
AASSLQS

SEQ ID NO: 10591 - DNA, 21 bp, Artificial Sequence
  Description of Artificial Sequence: Synthetic oligonucleotide
aaagcatccagtttgcaaggt

SEQ ID NO: 10592 - protein, 7 aa, Artificial Sequence
  Description of Artificial Sequence: Synthetic peptide
KASSLQG

SEQ ID NO: 10593 - DNA, 21 bp, Artificial Sequence
  Description of Artificial Sequence: Synthetic oligonucleotide
gaactttccaaccggttctct

SEQ ID NO: 10594 - protein, 7 aa, Artificial Sequence
  Description of Artificial Sequence: Synthetic peptide
ELSNRFS

SEQ ID NO: 10595 - DNA, 21 bp, Artificial Sequence
  Description of Artificial Sequence: Synthetic oligonucleotide
tgggcatctacccgggaatcc

SEQ ID NO: 10596 - protein, 7 aa, Artificial Sequence
  Description of Artificial Sequence: Synthetic peptide
WASTRES

SEQ ID NO: 10597 - DNA, 21 bp, Artificial Sequence
  Description of Artificial Sequence: Synthetic oligonucleotide
ggtgcatccagcagggccact

SEQ ID NO: 10598 - protein, 7 aa, Artificial Sequence
  Description of Artificial Sequence: Synthetic peptide
GASSRAT

SEQ ID NO: 10599 - DNA, 21 bp, Artificial Sequence
  Description of Artificial Sequence: Synthetic oligonucleotide
gctgcatccagtttgcaaagt

SEQ ID NO: 10600 - protein, 7 aa, Artificial Sequence
  Description of Artificial Sequence: Synthetic peptide
AASSLQS

SEQ ID NO: 10601 - DNA, 21 bp, Artificial Sequence
  Description of Artificial Sequence: Synthetic oligonucleotide
ggtgcatccagcagggccact

SEQ ID NO: 10602 - protein, 7 aa, Artificial Sequence
  Description of Artificial Sequence: Synthetic peptide
GASSRAT

SEQ ID NO: 10603 - DNA, 21 bp, Artificial Sequence
  Description of Artificial Sequence: Synthetic oligonucleotide
ggtgcatccagcagggccact

SEQ ID NO: 10604 - protein, 7 aa, Artificial Sequence
  Description of Artificial Sequence: Synthetic peptide
GASSRAT

SEQ ID NO: 10605 - DNA, 21 bp, Artificial Sequence
  Description of Artificial Sequence: Synthetic oligonucleotide
ggtgcatccagcagggccact

SEQ ID NO: 10606 - protein, 7 aa, Artificial Sequence
  Description of Artificial Sequence: Synthetic peptide
GASSRAT

SEQ ID NO: 10607 - DNA, 21 bp, Artificial Sequence
  Description of Artificial Sequence: Synthetic oligonucleotide
gaggtttccaaccggttcgct

SEQ ID NO: 10608 - protein, 7 aa, Artificial Sequence
  Description of Artificial Sequence: Synthetic peptide
EVSNRFA

SEQ ID NO: 10609 - DNA, 21 bp, Artificial Sequence
  Description of Artificial Sequence: Synthetic oligonucleotide
tgggcatctacccgaaaatcc

SEQ ID NO: 10610 - protein, 7 aa, Artificial Sequence
  Description of Artificial Sequence: Synthetic peptide
WASTRKS

SEQ ID NO: 10611 - DNA, 21 bp, Artificial Sequence
  Description of Artificial Sequence: Synthetic oligonucleotide
actgcatccagtttgcaaaat

SEQ ID NO: 10612 - protein, 7 aa, Artificial Sequence
  Description of Artificial Sequence: Synthetic peptide
TASSLQN

SEQ ID NO: 10613 - DNA, 21 bp, Artificial Sequence
  Description of Artificial Sequence: Synthetic oligonucleotide
aaagcatccagtttgcaaagt

SEQ ID NO: 10614 - protein, 7 aa, Artificial Sequence
  Description of Artificial Sequence: Synthetic peptide
KASSLQS

SEQ ID NO: 10615 - DNA, 21 bp, Artificial Sequence
  Description of Artificial Sequence: Synthetic oligonucleotide
gctgcatccagtttgcaaagt

SEQ ID NO: 10616 - protein, 7 aa, Artificial Sequence
  Description of Artificial Sequence: Synthetic peptide
AASSLQS

SEQ ID NO: 10617 - DNA, 21 bp, Artificial Sequence
  Description of Artificial Sequence: Synthetic oligonucleotide
tatgcttcccagtccctctca

SEQ ID NO: 10618 - protein, 7 aa, Artificial Sequence
  Description of Artificial Sequence: Synthetic peptide
YASQSLS

SEQ ID NO: 10619 - DNA, 21 bp, Artificial Sequence
  Description of Artificial Sequence: Synthetic oligonucleotide
ggtgcttccaacagggccact

SEQ ID NO: 10620 - protein, 7 aa, Artificial Sequence
  Description of Artificial Sequence: Synthetic peptide
GASNRAT

SEQ ID NO: 10621 - DNA, 21 bp, Artificial Sequence
  Description of Artificial Sequence: Synthetic oligonucleotide
tatgcttcccagtccttctca

SEQ ID NO: 10622 - protein, 7 aa, Artificial Sequence
  Description of Artificial Sequence: Synthetic peptide
YASQSFS

SEQ ID NO: 10623 - DNA, 21 bp, Artificial Sequence
  Description of Artificial Sequence: Synthetic oligonucleotide
gttgcatccagtttggaaagt

SEQ ID NO: 10624 - protein, 7 aa, Artificial Sequence
  Description of Artificial Sequence: Synthetic peptide
VASSLES

SEQ ID NO: 10625 - DNA, 21 bp, Artificial Sequence
  Description of Artificial Sequence: Synthetic oligonucleotide
gaggtttccaaccggttcgct

SEQ ID NO: 10626 - protein, 7 aa, Artificial Sequence
  Description of Artificial Sequence: Synthetic peptide
EVSNRFA

SEQ ID NO: 10627 - DNA, 21 bp, Artificial Sequence
  Description of Artificial Sequence: Synthetic oligonucleotide
gctgcatccagtttgcaaagt

SEQ ID NO: 10628 - protein, 7 aa, Artificial Sequence
  Description of Artificial Sequence: Synthetic peptide
AASSLQS

SEQ ID NO: 10629 - DNA, 21 bp, Artificial Sequence
  Description of Artificial Sequence: Synthetic oligonucleotide
ggtgtttccagtttgcagagt

SEQ ID NO: 10630 - protein, 7 aa, Artificial Sequence
  Description of Artificial Sequence: Synthetic peptide
GVSSLQS

SEQ ID NO: 10631 - DNA, 21 bp, Artificial Sequence
  Description of Artificial Sequence: Synthetic oligonucleotide
gctgcatccagtttgcaaagt

SEQ ID NO: 10632 - protein, 7 aa, Artificial Sequence
  Description of Artificial Sequence: Synthetic peptide
AASSLQS

SEQ ID NO: 10633 - DNA, 21 bp, Artificial Sequence
  Description of Artificial Sequence: Synthetic oligonucleotide
attgcatccagtttgcaaagt

SEQ ID NO: 10634 - protein, 7 aa, Artificial Sequence
  Description of Artificial Sequence: Synthetic peptide
IASSLQS

SEQ ID NO: 10635 - DNA, 21 bp, Artificial Sequence
  Description of Artificial Sequence: Synthetic oligonucleotide
attgcatccagtttgcaaagt

SEQ ID NO: 10636 - protein, 7 aa, Artificial Sequence
  Description of Artificial Sequence: Synthetic peptide
IASSLQS

SEQ ID NO: 10637 - DNA, 21 bp, Artificial Sequence
  Description of Artificial Sequence: Synthetic oligonucleotide
gttgcatccagtttgcaaagt

SEQ ID NO: 10638 - protein, 7 aa, Artificial Sequence
  Description of Artificial Sequence: Synthetic peptide
VASSLQS

SEQ ID NO: 10639 - DNA, 21 bp, Artificial Sequence
  Description of Artificial Sequence: Synthetic oligonucleotide
gctgcatccagtttgcaaagt

SEQ ID NO: 10640 - protein, 7 aa, Artificial Sequence
  Description of Artificial Sequence: Synthetic peptide
AASSLQS

SEQ ID NO: 10641 - DNA, 21 bp, Artificial Sequence
  Description of Artificial Sequence: Synthetic oligonucleotide
gaagtttccaagcggttctct

SEQ ID NO: 10642 - protein, 7 aa, Artificial Sequence
  Description of Artificial Sequence: Synthetic peptide
EVSKRFS

SEQ ID NO: 10643 - DNA, 21 bp, Artificial Sequence
  Description of Artificial Sequence: Synthetic oligonucleotide
gctgcatccagtttacaaagt

SEQ ID NO: 10644 - protein, 7 aa, Artificial Sequence
  Description of Artificial Sequence: Synthetic peptide
AASSLQS

SEQ ID NO: 10645 - DNA, 21 bp, Artificial Sequence
  Description of Artificial Sequence: Synthetic oligonucleotide
gctgcttccagtttgcaaagt

SEQ ID NO: 10646 - protein, 7 aa, Artificial Sequence
  Description of Artificial Sequence: Synthetic peptide
AASSLQS

SEQ ID NO: 10647 - DNA, 21 bp, Artificial Sequence
  Description of Artificial Sequence: Synthetic oligonucleotide
gctgcatccaatttgcaaagt

SEQ ID NO: 10648 - protein, 7 aa, Artificial Sequence
  Description of Artificial Sequence: Synthetic peptide
AASNLQS

SEQ ID NO: 10649 - DNA, 21 bp, Artificial Sequence
  Description of Artificial Sequence: Synthetic oligonucleotide
gctgcatccagtttgcaaagt

SEQ ID NO: 10650 - protein, 7 aa, Artificial Sequence
  Description of Artificial Sequence: Synthetic peptide
AASSLQS

SEQ ID NO: 10651 - DNA, 21 bp, Artificial Sequence
  Description of Artificial Sequence: Synthetic oligonucleotide
gaagtttccaaccggttctct

SEQ ID NO: 10652 - protein, 7 aa, Artificial Sequence
  Description of Artificial Sequence: Synthetic peptide
EVSNRFS

SEQ ID NO: 10653 - DNA, 21 bp, Artificial Sequence
  Description of Artificial Sequence: Synthetic oligonucleotide
gaagtttccaaccggttctct

SEQ ID NO: 10654 - protein, 7 aa, Artificial Sequence
  Description of Artificial Sequence: Synthetic peptide
EVSNRFS

SEQ ID NO: 10655 - DNA, 21 bp, Artificial Sequence
  Description of Artificial Sequence: Synthetic oligonucleotide
tgggcatctacccgggaatcc

SEQ ID NO: 10656 - protein, 7 aa, Artificial Sequence
  Description of Artificial Sequence: Synthetic peptide
WASTRES

SEQ ID NO: 10657 - DNA, 21 bp, Artificial Sequence
  Description of Artificial Sequence: Synthetic oligonucleotide
ggtgcatccagcagggccact

SEQ ID NO: 10658 - protein, 7 aa, Artificial Sequence
  Description of Artificial Sequence: Synthetic peptide
GASSRAT

SEQ ID NO: 10659 - DNA, 21 bp, Artificial Sequence
  Description of Artificial Sequence: Synthetic oligonucleotide
actgcatccagtttgcaaagt

SEQ ID NO: 10660 - protein, 7 aa, Artificial Sequence
  Description of Artificial Sequence: Synthetic peptide
TASSLQS

SEQ ID NO: 10661 - DNA, 21 bp, Artificial Sequence
  Description of Artificial Sequence: Synthetic oligonucleotide
gctgtgtccagtttgcaaagt

SEQ ID NO: 10662 - protein, 7 aa, Artificial Sequence
  Description of Artificial Sequence: Synthetic peptide
AVSSLQS

SEQ ID NO: 10663 - DNA, 21 bp, Artificial Sequence
  Description of Artificial Sequence: Synthetic oligonucleotide
ggtgcatccagcagggccact

SEQ ID NO: 10664 - protein, 7 aa, Artificial Sequence
  Description of Artificial Sequence: Synthetic peptide
GASSRAT

SEQ ID NO: 10665 - DNA, 21 bp, Artificial Sequence
  Description of Artificial Sequence: Synthetic oligonucleotide
ggtgcataccgcagggccact

SEQ ID NO: 10666 - protein, 7 aa, Artificial Sequence
  Description of Artificial Sequence: Synthetic peptide
GAYRRAT

SEQ ID NO: 10667 - DNA, 21 bp, Artificial Sequence
  Description of Artificial Sequence: Synthetic oligonucleotide
tgggcatctacccgggaatcc

SEQ ID NO: 10668 - protein, 7 aa, Artificial Sequence
  Description of Artificial Sequence: Synthetic peptide
WASTRES

SEQ ID NO: 10669 - DNA, 21 bp, Artificial Sequence
  Description of Artificial Sequence: Synthetic oligonucleotide
tctgcttcccagtccttctca

SEQ ID NO: 10670 - protein, 7 aa, Artificial Sequence
  Description of Artificial Sequence: Synthetic peptide
SASQSFS

SEQ ID NO: 10671 - DNA, 21 bp, Artificial Sequence
  Description of Artificial Sequence: Synthetic oligonucleotide
actgcatccagtttgcaaagt

SEQ ID NO: 10672 - protein, 7 aa, Artificial Sequence
  Description of Artificial Sequence: Synthetic peptide
TASSLQS

SEQ ID NO: 10673 - DNA, 21 bp, Artificial Sequence
  Description of Artificial Sequence: Synthetic oligonucleotide
gctgcatccagtttgcaaagt

SEQ ID NO: 10674 - protein, 7 aa, Artificial Sequence
  Description of Artificial Sequence: Synthetic peptide
AASSLQS

SEQ ID NO: 10675 - DNA, 21 bp, Artificial Sequence
  Description of Artificial Sequence: Synthetic oligonucleotide
tgggcatctacccgggaatcc

SEQ ID NO: 10676 - protein, 7 aa, Artificial Sequence
  Description of Artificial Sequence: Synthetic peptide
WASTRES

SEQ ID NO: 10677 - DNA, 21 bp, Artificial Sequence
  Description of Artificial Sequence: Synthetic oligonucleotide
tgggcatctacccggaaatcc

SEQ ID NO: 10678 - protein, 7 aa, Artificial Sequence
  Description of Artificial Sequence: Synthetic peptide
WASTRKS

SEQ ID NO: 10679 - DNA, 21 bp, Artificial Sequence
  Description of Artificial Sequence: Synthetic oligonucleotide
gaggtttccaaccggttctct

SEQ ID NO: 10680 - protein, 7 aa, Artificial Sequence
  Description of Artificial Sequence: Synthetic peptide
EVSNRFS

SEQ ID NO: 10681 - DNA, 21 bp, Artificial Sequence
  Description of Artificial Sequence: Synthetic oligonucleotide
tatgcttcccagtccttctca

SEQ ID NO: 10682 - protein, 7 aa, Artificial Sequence
  Description of Artificial Sequence: Synthetic peptide
YASQSFS

SEQ ID NO: 10683 - DNA, 21 bp, Artificial Sequence
  Description of Artificial Sequence: Synthetic oligonucleotide
aaagcatccagtttacaaagt

SEQ ID NO: 10684 - protein, 7 aa, Artificial Sequence
  Description of Artificial Sequence: Synthetic peptide
KASSLQS

SEQ ID NO: 10685 - DNA, 21 bp, Artificial Sequence
  Description of Artificial Sequence: Synthetic oligonucleotide
tatgcttcccagtccttctca

SEQ ID NO: 10686 - protein, 7 aa, Artificial Sequence
  Description of Artificial Sequence: Synthetic peptide
YASQSFS

SEQ ID NO: 10687 - DNA, 21 bp, Artificial Sequence
  Description of Artificial Sequence: Synthetic oligonucleotide
gctgcatccagtttgcaaagt

SEQ ID NO: 10688 - protein, 7 aa, Artificial Sequence
  Description of Artificial Sequence: Synthetic peptide
AASSLQS

SEQ ID NO: 10689 - DNA, 21 bp, Artificial Sequence
  Description of Artificial Sequence: Synthetic oligonucleotide
ggtccatccagcagggccact

SEQ ID NO: 10690 - protein, 7 aa, Artificial Sequence
  Description of Artificial Sequence: Synthetic peptide
GPSSRAT

SEQ ID NO: 10691 - DNA, 21 bp, Artificial Sequence
  Description of Artificial Sequence: Synthetic oligonucleotide
ggtgcatccactagggccact

SEQ ID NO: 10692 - protein, 7 aa, Artificial Sequence
  Description of Artificial Sequence: Synthetic peptide
GASTRAT

SEQ ID NO: 10693 - DNA, 21 bp, Artificial Sequence
  Description of Artificial Sequence: Synthetic oligonucleotide
tatgcttcccagtccttctca

SEQ ID NO: 10694 - protein, 7 aa, Artificial Sequence
  Description of Artificial Sequence: Synthetic peptide
YASQSFS

SEQ ID NO: 10695 - DNA, 21 bp, Artificial Sequence
  Description of Artificial Sequence: Synthetic oligonucleotide
gctgcatccagtttgcaaagt

SEQ ID NO: 10696 - protein, 7 aa, Artificial Sequence
  Description of Artificial Sequence: Synthetic peptide
AASSLQS

SEQ ID NO: 10697 - DNA, 21 bp, Artificial Sequence
  Description of Artificial Sequence: Synthetic oligonucleotide
gctgcatccagtttgcaaagt

SEQ ID NO: 10698 - protein, 7 aa, Artificial Sequence
  Description of Artificial Sequence: Synthetic peptide
AASSLQS

SEQ ID NO: 10699 - DNA, 21 bp, Artificial Sequence
  Description of Artificial Sequence: Synthetic oligonucleotide
tgggcctctacccgggaatcc

SEQ ID NO: 10700 - protein, 7 aa, Artificial Sequence
  Description of Artificial Sequence: Synthetic peptide
WASTRES

SEQ ID NO: 10701 - DNA, 21 bp, Artificial Sequence
  Description of Artificial Sequence: Synthetic oligonucleotide
aaagcatccagtttgcaaagt

SEQ ID NO: 10702 - protein, 7 aa, Artificial Sequence
  Description of Artificial Sequence: Synthetic peptide
KASSLQS

SEQ ID NO: 10703 - DNA, 21 bp, Artificial Sequence
  Description of Artificial Sequence: Synthetic oligonucleotide
gctgcatccagtttgcaaagt

SEQ ID NO: 10704 - protein, 7 aa, Artificial Sequence
  Description of Artificial Sequence: Synthetic peptide
AASSLQS

SEQ ID NO: 10705 - DNA, 21 bp, Artificial Sequence
  Description of Artificial Sequence: Synthetic oligonucleotide
gctgcatccagtttgcaaagt

SEQ ID NO: 10706 - protein, 7 aa, Artificial Sequence
  Description of Artificial Sequence: Synthetic peptide
AASSLQS

SEQ ID NO: 10707 - DNA, 21 bp, Artificial Sequence
  Description of Artificial Sequence: Synthetic oligonucleotide
ggtgcatccagtttgcaaagt

SEQ ID NO: 10708 - protein, 7 aa, Artificial Sequence
  Description of Artificial Sequence: Synthetic peptide
GASSLQS

SEQ ID NO: 10709 - DNA, 21 bp, Artificial Sequence
  Description of Artificial Sequence: Synthetic oligonucleotide
ggtgcatctagcagggccact

SEQ ID NO: 10710 - protein, 7 aa, Artificial Sequence
  Description of Artificial Sequence: Synthetic peptide
GASSRAT

SEQ ID NO: 10711 - DNA, 21 bp, Artificial Sequence
  Description of Artificial Sequence: Synthetic oligonucleotide
gctgcatccagtttgcaaagt

SEQ ID NO: 10712 - protein, 7 aa, Artificial Sequence
  Description of Artificial Sequence: Synthetic peptide
AASSLQS

SEQ ID NO: 10713 - DNA, 21 bp, Artificial Sequence
  Description of Artificial Sequence: Synthetic oligonucleotide
ggtgcatccagcagggccact

SEQ ID NO: 10714 - protein, 7 aa, Artificial Sequence
  Description of Artificial Sequence: Synthetic peptide
GASSRAT

SEQ ID NO: 10715 - DNA, 21 bp, Artificial Sequence
  Description of Artificial Sequence: Synthetic oligonucleotide
gttgtatccagtttacaaagt

SEQ ID NO: 10716 - protein, 7 aa, Artificial Sequence
  Description of Artificial Sequence: Synthetic peptide
VVSSLQS

SEQ ID NO: 10717 - DNA, 21 bp, Artificial Sequence
  Description of Artificial Sequence: Synthetic oligonucleotide
gctgcatccagtttgcaaagt

SEQ ID NO: 10718 - protein, 7 aa, Artificial Sequence
  Description of Artificial Sequence: Synthetic peptide
AASSLQS

SEQ ID NO: 10719 - DNA, 21 bp, Artificial Sequence
  Description of Artificial Sequence: Synthetic oligonucleotide
tatgcttcccagtcattctca

SEQ ID NO: 10720 - protein, 7 aa, Artificial Sequence
  Description of Artificial Sequence: Synthetic peptide
YASQSFS

SEQ ID NO: 10721 - DNA, 21 bp, Artificial Sequence
  Description of Artificial Sequence: Synthetic oligonucleotide
gctgcatccagtttgcaaagt

SEQ ID NO: 10722 - protein, 7 aa, Artificial Sequence
  Description of Artificial Sequence: Synthetic peptide
AASSLQS

SEQ ID NO: 10723 - DNA, 21 bp, Artificial Sequence
  Description of Artificial Sequence: Synthetic oligonucleotide
aaagcatccagtttgcaaagt

SEQ ID NO: 10724 - protein, 7 aa, Artificial Sequence
  Description of Artificial Sequence: Synthetic peptide
KASSLQS

SEQ ID NO: 10725 - DNA, 21 bp, Artificial Sequence
  Description of Artificial Sequence: Synthetic oligonucleotide
actgcatccagtttgcaaagt

SEQ ID NO: 10726 - protein, 7 aa, Artificial Sequence
  Description of Artificial Sequence: Synthetic peptide
TASSLQS

SEQ ID NO: 10727 - DNA, 21 bp, Artificial Sequence
  Description of Artificial Sequence: Synthetic oligonucleotide
gctgcatccagtttgcaaagt

SEQ ID NO: 10728 - protein, 7 aa, Artificial Sequence
  Description of Artificial Sequence: Synthetic peptide
AASSLQS

SEQ ID NO: 10729 - DNA, 21 bp, Artificial Sequence
  Description of Artificial Sequence: Synthetic oligonucleotide
ggtgcatccagcagggccact

SEQ ID NO: 10730 - protein, 7 aa, Artificial Sequence
  Description of Artificial Sequence: Synthetic peptide
GASSRAT

SEQ ID NO: 10731 - DNA, 21 bp, Artificial Sequence
  Description of Artificial Sequence: Synthetic oligonucleotide
aaagcatccagtttgcaaagt

SEQ ID NO: 10732 - protein, 7 aa, Artificial Sequence
  Description of Artificial Sequence: Synthetic peptide
KASSLQS

SEQ ID NO: 10733 - DNA, 21 bp, Artificial Sequence
  Description of Artificial Sequence: Synthetic oligonucleotide
gaggtttccaaccggttcgct

SEQ ID NO: 10734 - protein, 7 aa, Artificial Sequence
  Description of Artificial Sequence: Synthetic peptide
EVSNRFA

SEQ ID NO: 10735 - DNA, 21 bp, Artificial Sequence
  Description of Artificial Sequence: Synthetic oligonucleotide
gctgcatccagtttgcaaagt

SEQ ID NO: 10736 - protein, 7 aa, Artificial Sequence
  Description of Artificial Sequence: Synthetic peptide
AASSLQS

SEQ ID NO: 10737 - DNA, 21 bp, Artificial Sequence
  Description of Artificial Sequence: Synthetic oligonucleotide
gctgaatccagtttacaaagt

SEQ ID NO: 10738 - protein, 7 aa, Artificial Sequence
  Description of Artificial Sequence: Synthetic peptide
AESSLQS

SEQ ID NO: 10739 - DNA, 21 bp, Artificial Sequence
  Description of Artificial Sequence: Synthetic oligonucleotide
gctgcatccagtttgcaaagt

SEQ ID NO: 10740 - protein, 7 aa, Artificial Sequence
  Description of Artificial Sequence: Synthetic peptide
AASSLQS

SEQ ID NO: 10741 - DNA, 21 bp, Artificial Sequence
  Description of Artificial Sequence: Synthetic oligonucleotide
ggtgtatcccgcagggccact

SEQ ID NO: 10742 - protein, 7 aa, Artificial Sequence
  Description of Artificial Sequence: Synthetic peptide
GVSRRAT

SEQ ID NO: 10743 - DNA, 21 bp, Artificial Sequence
  Description of Artificial Sequence: Synthetic oligonucleotide
ggtgcatcccgcagggccact

SEQ ID NO: 10744 - protein, 7 aa, Artificial Sequence
  Description of Artificial Sequence: Synthetic peptide
GASRRAT

SEQ ID NO: 10745 - DNA, 21 bp, Artificial Sequence
  Description of Artificial Sequence: Synthetic oligonucleotide
ggtgcatcccgcagggccact

SEQ ID NO: 10746 - protein, 7 aa, Artificial Sequence
  Description of Artificial Sequence: Synthetic peptide
GASRRAT

SEQ ID NO: 10747 - DNA, 21 bp, Artificial Sequence
  Description of Artificial Sequence: Synthetic oligonucleotide
ggtgtttccagtttgcaaagt

SEQ ID NO: 10748 - protein, 7 aa, Artificial Sequence
  Description of Artificial Sequence: Synthetic peptide
GVSSLQS

SEQ ID NO: 10749 - DNA, 21 bp, Artificial Sequence
  Description of Artificial Sequence: Synthetic oligonucleotide
ggtgcatccaacagggccact

SEQ ID NO: 10750 - protein, 7 aa, Artificial Sequence
  Description of Artificial Sequence: Synthetic peptide
GASNRAT

SEQ ID NO: 10751 - DNA, 21 bp, Artificial Sequence
  Description of Artificial Sequence: Synthetic oligonucleotide
ggtgcatccagcagggccact

SEQ ID NO: 10752 - protein, 7 aa, Artificial Sequence
  Description of Artificial Sequence: Synthetic peptide
GASSRAT

SEQ ID NO: 10753 - DNA, 21 bp, Artificial Sequence
  Description of Artificial Sequence: Synthetic oligonucleotide
gctgcatccactttacaatca

SEQ ID NO: 10754 - protein, 7 aa, Artificial Sequence
  Description of Artificial Sequence: Synthetic peptide
AASTLQS

SEQ ID NO: 10755 - DNA, 21 bp, Artificial Sequence
  Description of Artificial Sequence: Synthetic oligonucleotide
tgggcatctacccgaaaatcc

SEQ ID NO: 10756 - protein, 7 aa, Artificial Sequence
  Description of Artificial Sequence: Synthetic peptide
WASTRKS

SEQ ID NO: 10757 - DNA, 21 bp, Artificial Sequence
  Description of Artificial Sequence: Synthetic oligonucleotide
gctgcatccagtttgcaaagt

SEQ ID NO: 10758 - protein, 7 aa, Artificial Sequence
  Description of Artificial Sequence: Synthetic peptide
AASSLQS

SEQ ID NO: 10759 - DNA, 21 bp, Artificial Sequence
  Description of Artificial Sequence: Synthetic oligonucleotide
tatgcttcccagtccttctca

SEQ ID NO: 10760 - protein, 7 aa, Artificial Sequence
  Description of Artificial Sequence: Synthetic peptide
YASQSFS

SEQ ID NO: 10761 - DNA, 21 bp, Artificial Sequence
  Description of Artificial Sequence: Synthetic oligonucleotide
ggtgcatccagcagggccact

SEQ ID NO: 10762 - protein, 7 aa, Artificial Sequence
  Description of Artificial Sequence: Synthetic peptide
GASSRAT

SEQ ID NO: 10763 - DNA, 21 bp, Artificial Sequence
  Description of Artificial Sequence: Synthetic oligonucleotide
ggtgcatccagcagggccact

SEQ ID NO: 10764 - protein, 7 aa, Artificial Sequence
  Description of Artificial Sequence: Synthetic peptide
GASSRAT

SEQ ID NO: 10765 - DNA, 21 bp, Artificial Sequence
  Description of Artificial Sequence: Synthetic oligonucleotide
gctgcatccagtttgcaaagt

SEQ ID NO: 10766 - protein, 7 aa, Artificial Sequence
  Description of Artificial Sequence: Synthetic peptide
AASSLQS

SEQ ID NO: 10767 - DNA, 21 bp, Artificial Sequence
  Description of Artificial Sequence: Synthetic oligonucleotide
tctgcatccagtttgcaaagg

SEQ ID NO: 10768 - protein, 7 aa, Artificial Sequence
  Description of Artificial Sequence: Synthetic peptide
SASSLQR

SEQ ID NO: 10769 - DNA, 21 bp, Artificial Sequence
  Description of Artificial Sequence: Synthetic oligonucleotide
ggtgcatccagcagggccact

SEQ ID NO: 10770 - protein, 7 aa, Artificial Sequence
  Description of Artificial Sequence: Synthetic peptide
GASSRAT

SEQ ID NO: 10771 - DNA, 21 bp, Artificial Sequence
  Description of Artificial Sequence: Synthetic oligonucleotide
ggtgcatccagcagggccact

SEQ ID NO: 10772 - protein, 7 aa, Artificial Sequence
  Description of Artificial Sequence: Synthetic peptide
GASSRAT

SEQ ID NO: 10773 - DNA, 21 bp, Artificial Sequence
  Description of Artificial Sequence: Synthetic oligonucleotide
gctgcatccagtttgcaaagt

SEQ ID NO: 10774 - protein, 7 aa, Artificial Sequence
  Description of Artificial Sequence: Synthetic peptide
AASSLQS

SEQ ID NO: 10775 - DNA, 21 bp, Artificial Sequence
  Description of Artificial Sequence: Synthetic oligonucleotide
ggtgcatcccgcagggccact

SEQ ID NO: 10776 - protein, 7 aa, Artificial Sequence
  Description of Artificial Sequence: Synthetic peptide
GASRRAT

SEQ ID NO: 10777 - DNA, 21 bp, Artificial Sequence
  Description of Artificial Sequence: Synthetic oligonucleotide
tatgcttcccagtcattctca

SEQ ID NO: 10778 - protein, 7 aa, Artificial Sequence
  Description of Artificial Sequence: Synthetic peptide
YASQSFS

SEQ ID NO: 10779 - DNA, 21 bp, Artificial Sequence
  Description of Artificial Sequence: Synthetic oligonucleotide
gctgcatccagtttgcaaagt

SEQ ID NO: 10780 - protein, 7 aa, Artificial Sequence
  Description of Artificial Sequence: Synthetic peptide
AASSLQS

SEQ ID NO: 10781 - DNA, 21 bp, Artificial Sequence
  Description of Artificial Sequence: Synthetic oligonucleotide
ggtgcatccaggagggccact

SEQ ID NO: 10782 - protein, 7 aa, Artificial Sequence
  Description of Artificial Sequence: Synthetic peptide
GASRRAT

SEQ ID NO: 10783 - DNA, 21 bp, Artificial Sequence
  Description of Artificial Sequence: Synthetic oligonucleotide
gatgcatccagcagggccact

SEQ ID NO: 10784 - protein, 7 aa, Artificial Sequence
  Description of Artificial Sequence: Synthetic peptide
DASSRAT

SEQ ID NO: 10785 - DNA, 21 bp, Artificial Sequence
  Description of Artificial Sequence: Synthetic oligonucleotide
ggtgcatccaccagggccact

SEQ ID NO: 10786 - protein, 7 aa, Artificial Sequence
  Description of Artificial Sequence: Synthetic peptide
GASTRAT

SEQ ID NO: 10787 - DNA, 21 bp, Artificial Sequence
  Description of Artificial Sequence: Synthetic oligonucleotide
gctgcatccagtttgcaaagt

SEQ ID NO: 10788 - protein, 7 aa, Artificial Sequence
  Description of Artificial Sequence: Synthetic peptide
AASSLQS

SEQ ID NO: 10789 - DNA, 21 bp, Artificial Sequence
  Description of Artificial Sequence: Synthetic oligonucleotide
tctgcttcccagtccttctca

SEQ ID NO: 10790 - protein, 7 aa, Artificial Sequence
  Description of Artificial Sequence: Synthetic peptide
SASQSFS

SEQ ID NO: 10791 - DNA, 21 bp, Artificial Sequence
  Description of Artificial Sequence: Synthetic oligonucleotide
ggtgcttccaacagggccact

SEQ ID NO: 10792 - protein, 7 aa, Artificial Sequence
  Description of Artificial Sequence: Synthetic peptide
GASNRAT

SEQ ID NO: 10793 - DNA, 21 bp, Artificial Sequence
  Description of Artificial Sequence: Synthetic oligonucleotide
gaggtttccaaccggttctct

SEQ ID NO: 10794 - protein, 7 aa, Artificial Sequence
  Description of Artificial Sequence: Synthetic peptide
EVSNRFS

SEQ ID NO: 10795 - DNA, 21 bp, Artificial Sequence
  Description of Artificial Sequence: Synthetic oligonucleotide
ggtgcatccagcagggccact

SEQ ID NO: 10796 - protein, 7 aa, Artificial Sequence
  Description of Artificial Sequence: Synthetic peptide
GASSRAT

SEQ ID NO: 10797 - DNA, 21 bp, Artificial Sequence
  Description of Artificial Sequence: Synthetic oligonucleotide
ggtgcatccagcagggccact

SEQ ID NO: 10798 - protein, 7 aa, Artificial Sequence
  Description of Artificial Sequence: Synthetic peptide
GASSRAT

SEQ ID NO: 10799 - DNA, 21 bp, Artificial Sequence
  Description of Artificial Sequence: Synthetic oligonucleotide
ggtgcatccaggttgcaaagt

SEQ ID NO: 10800 - protein, 7 aa, Artificial Sequence
  Description of Artificial Sequence: Synthetic peptide
GASRLQS

SEQ ID NO: 10801 - DNA, 21 bp, Artificial Sequence
  Description of Artificial Sequence: Synthetic oligonucleotide
gctgcatccagtttgcaaagt

SEQ ID NO: 10802 - protein, 7 aa, Artificial Sequence
  Description of Artificial Sequence: Synthetic peptide
AASSLQS

SEQ ID NO: 10803 - DNA, 21 bp, Artificial Sequence
  Description of Artificial Sequence: Synthetic oligonucleotide
ggtgcatccagcagggccact

SEQ ID NO: 10804 - protein, 7 aa, Artificial Sequence
  Description of Artificial Sequence: Synthetic peptide
GASSRAT

SEQ ID NO: 10805 - DNA, 21 bp, Artificial Sequence
  Description of Artificial Sequence: Synthetic oligonucleotide
gctgcatccagtttacaaagt

SEQ ID NO: 10806 - protein, 7 aa, Artificial Sequence
  Description of Artificial Sequence: Synthetic peptide
AASSLQS

SEQ ID NO: 10807 - DNA, 21 bp, Artificial Sequence
  Description of Artificial Sequence: Synthetic oligonucleotide
gctgcatccagtttacaaagt

SEQ ID NO: 10808 - protein, 7 aa, Artificial Sequence
  Description of Artificial Sequence: Synthetic peptide
AASSLQS

SEQ ID NO: 10809 - DNA, 21 bp, Artificial Sequence
  Description of Artificial Sequence: Synthetic oligonucleotide
gctgcatccagtttgcaaagt

SEQ ID NO: 10810 - protein, 7 aa, Artificial Sequence
  Description of Artificial Sequence: Synthetic peptide
AASSLQS

SEQ ID NO: 10811 - DNA, 21 bp, Artificial Sequence
  Description of Artificial Sequence: Synthetic oligonucleotide
ggtgcatccaacagggccact

SEQ ID NO: 10812 - protein, 7 aa, Artificial Sequence
  Description of Artificial Sequence: Synthetic peptide
GASNRAT

SEQ ID NO: 10813 - DNA, 21 bp, Artificial Sequence
  Description of Artificial Sequence: Synthetic oligonucleotide
gctgcatccagtttgctaggt

SEQ ID NO: 10814 - protein, 7 aa, Artificial Sequence
  Description of Artificial Sequence: Synthetic peptide
AASSLLG

SEQ ID NO: 10815 - DNA, 21 bp, Artificial Sequence
  Description of Artificial Sequence: Synthetic oligonucleotide
tatgcttcccagtccttctca

SEQ ID NO: 10816 - protein, 7 aa, Artificial Sequence
  Description of Artificial Sequence: Synthetic peptide
YASQSFS

SEQ ID NO: 10817 - DNA, 21 bp, Artificial Sequence
  Description of Artificial Sequence: Synthetic oligonucleotide
aaagtatccagtttgcaaagt

SEQ ID NO: 10818 - protein, 7 aa, Artificial Sequence
  Description of Artificial Sequence: Synthetic peptide
KVSSLQS

SEQ ID NO: 10819 - DNA, 21 bp, Artificial Sequence
  Description of Artificial Sequence: Synthetic oligonucleotide
ggtgcatttagtagggccact

SEQ ID NO: 10820 - protein, 7 aa, Artificial Sequence
  Description of Artificial Sequence: Synthetic peptide
GAFSRAT

SEQ ID NO: 10821 - DNA, 21 bp, Artificial Sequence
  Description of Artificial Sequence: Synthetic oligonucleotide
gctgcatccagtttgcaaagt

SEQ ID NO: 10822 - protein, 7 aa, Artificial Sequence
  Description of Artificial Sequence: Synthetic peptide
AASSLQS

SEQ ID NO: 10823 - DNA, 21 bp, Artificial Sequence
  Description of Artificial Sequence: Synthetic oligonucleotide
gctgcatccgatttgcaaagt

SEQ ID NO: 10824 - protein, 7 aa, Artificial Sequence
  Description of Artificial Sequence: Synthetic peptide
AASDLQS

SEQ ID NO: 10825 - DNA, 21 bp, Artificial Sequence
  Description of Artificial Sequence: Synthetic oligonucleotide
tatgcttcccagtccttctca

SEQ ID NO: 10826 - protein, 7 aa, Artificial Sequence
  Description of Artificial Sequence: Synthetic peptide
YASQSFS

SEQ ID NO: 10827 - DNA, 21 bp, Artificial Sequence
  Description of Artificial Sequence: Synthetic oligonucleotide
tatgcttcccagtccttctca

SEQ ID NO: 10828 - protein, 7 aa, Artificial Sequence
  Description of Artificial Sequence: Synthetic peptide
YASQSFS

SEQ ID NO: 10829 - DNA, 21 bp, Artificial Sequence
  Description of Artificial Sequence: Synthetic oligonucleotide
tgggcatctaccctggaatct

SEQ ID NO: 10830 - protein, 7 aa, Artificial Sequence
  Description of Artificial Sequence: Synthetic peptide
WASTLES

SEQ ID NO: 10831 - DNA, 21 bp, Artificial Sequence
  Description of Artificial Sequence: Synthetic oligonucleotide
ggtgtttccagtttgcagagt

SEQ ID NO: 10832 - protein, 7 aa, Artificial Sequence
  Description of Artificial Sequence: Synthetic peptide
GVSSLQS

SEQ ID NO: 10833 - DNA, 21 bp, Artificial Sequence
  Description of Artificial Sequence: Synthetic oligonucleotide
tgggcatctatccgggaatcc

SEQ ID NO: 10834 - protein, 7 aa, Artificial Sequence
  Description of Artificial Sequence: Synthetic peptide
WASIRES

SEQ ID NO: 10835 - DNA, 21 bp, Artificial Sequence
  Description of Artificial Sequence: Synthetic oligonucleotide
tgggcatctaccctggaatct

SEQ ID NO: 10836 - protein, 7 aa, Artificial Sequence
  Description of Artificial Sequence: Synthetic peptide
WASTLES

SEQ ID NO: 10837 - DNA, 21 bp, Artificial Sequence
  Description of Artificial Sequence: Synthetic oligonucleotide
gctgcatccagtttgcaaagt

SEQ ID NO: 10838 - protein, 7 aa, Artificial Sequence
  Description of Artificial Sequence: Synthetic peptide
AASSLQS

SEQ ID NO: 10839 - DNA, 21 bp, Artificial Sequence
  Description of Artificial Sequence: Synthetic oligonucleotide
actgcatccagtttgcaaggt

SEQ ID NO: 10840 - protein, 7 aa, Artificial Sequence
  Description of Artificial Sequence: Synthetic peptide
TASSLQG

SEQ ID NO: 10841 - DNA, 21 bp, Artificial Sequence
  Description of Artificial Sequence: Synthetic oligonucleotide
gctgcatccagtttgcaaagt

SEQ ID NO: 10842 - protein, 7 aa, Artificial Sequence
  Description of Artificial Sequence: Synthetic peptide
AASSLQS

SEQ ID NO: 10843 - DNA, 21 bp, Artificial Sequence
  Description of Artificial Sequence: Synthetic oligonucleotide
tgggcatctacccgggaatcc

SEQ ID NO: 10844 - protein, 7 aa, Artificial Sequence
  Description of Artificial Sequence: Synthetic peptide
WASTRES

SEQ ID NO: 10845 - DNA, 21 bp, Artificial Sequence
  Description of Artificial Sequence: Synthetic oligonucleotide
gctgcatccagtttgcaaagt

SEQ ID NO: 10846 - protein, 7 aa, Artificial Sequence
  Description of Artificial Sequence: Synthetic peptide
AASSLQS

SEQ ID NO: 10847 - DNA, 21 bp, Artificial Sequence
  Description of Artificial Sequence: Synthetic oligonucleotide
gctgcatccagtttgctaggt

SEQ ID NO: 10848 - protein, 7 aa, Artificial Sequence
  Description of Artificial Sequence: Synthetic peptide
AASSLLG

SEQ ID NO: 10849 - DNA, 21 bp, Artificial Sequence
  Description of Artificial Sequence: Synthetic oligonucleotide
gctgcatccagtttgcaaagt

SEQ ID NO: 10850 - protein, 7 aa, Artificial Sequence
  Description of Artificial Sequence: Synthetic peptide
AASSLQS

SEQ ID NO: 10851 - DNA, 21 bp, Artificial Sequence
  Description of Artificial Sequence: Synthetic oligonucleotide
ggtgcatccagcagggccact

SEQ ID NO: 10852 - protein, 7 aa, Artificial Sequence
  Description of Artificial Sequence: Synthetic peptide
GASSRAT

SEQ ID NO: 10853 - DNA, 21 bp, Artificial Sequence
  Description of Artificial Sequence: Synthetic oligonucleotide
gctgcatccagtttgcaaagt

SEQ ID NO: 10854 - protein, 7 aa, Artificial Sequence
  Description of Artificial Sequence: Synthetic peptide
AASSLQS

SEQ ID NO: 10855 - DNA, 21 bp, Artificial Sequence
  Description of Artificial Sequence: Synthetic oligonucleotide
ggtgcataccgcagggccact

SEQ ID NO: 10856 - protein, 7 aa, Artificial Sequence
  Description of Artificial Sequence: Synthetic peptide
GAYRRAT

SEQ ID NO: 10857 - DNA, 21 bp, Artificial Sequence
  Description of Artificial Sequence: Synthetic oligonucleotide
aaaacatccagtttgcaaagt

SEQ ID NO: 10858 - protein, 7 aa, Artificial Sequence
  Description of Artificial Sequence: Synthetic peptide
KTSSLQS

SEQ ID NO: 10859 - DNA, 21 bp, Artificial Sequence
  Description of Artificial Sequence: Synthetic oligonucleotide
gctgcatccagtttgcaaagt

SEQ ID NO: 10860 - protein, 7 aa, Artificial Sequence
  Description of Artificial Sequence: Synthetic peptide
AASSLQS

SEQ ID NO: 10861 - DNA, 21 bp, Artificial Sequence
  Description of Artificial Sequence: Synthetic oligonucleotide
ggtgcatccagcagggccact

SEQ ID NO: 10862 - protein, 7 aa, Artificial Sequence
  Description of Artificial Sequence: Synthetic peptide
GASSRAT

SEQ ID NO: 10863 - DNA, 21 bp, Artificial Sequence
  Description of Artificial Sequence: Synthetic oligonucleotide
tgggcatctacccgggaatcc

SEQ ID NO: 10864 - protein, 7 aa, Artificial Sequence
  Description of Artificial Sequence: Synthetic peptide
WASTRES

SEQ ID NO: 10865 - DNA, 21 bp, Artificial Sequence
  Description of Artificial Sequence: Synthetic oligonucleotide
ggtgcatccagtttgcaaagt

SEQ ID NO: 10866 - protein, 7 aa, Artificial Sequence
  Description of Artificial Sequence: Synthetic peptide
GASSLQS

SEQ ID NO: 10867 - DNA, 21 bp, Artificial Sequence
  Description of Artificial Sequence: Synthetic oligonucleotide
tgggcatctacccgggaatcc

SEQ ID NO: 10868 - protein, 7 aa, Artificial Sequence
  Description of Artificial Sequence: Synthetic peptide
WASTRES

SEQ ID NO: 10869 - DNA, 21 bp, Artificial Sequence
  Description of Artificial Sequence: Synthetic oligonucleotide
tgggcatctacccgggaatcc

SEQ ID NO: 10870 - protein, 7 aa, Artificial Sequence
  Description of Artificial Sequence: Synthetic peptide
WASTRES

SEQ ID NO: 10871 - DNA, 21 bp, Artificial Sequence
  Description of Artificial Sequence: Synthetic oligonucleotide
gaagtttccaaccggttctct

SEQ ID NO: 10872 - protein, 7 aa, Artificial Sequence
  Description of Artificial Sequence: Synthetic peptide
EVSNRFS

SEQ ID NO: 10873 - DNA, 21 bp, Artificial Sequence
  Description of Artificial Sequence: Synthetic oligonucleotide
gctgcatccagtttgcaaagt

SEQ ID NO: 10874 - protein, 7 aa, Artificial Sequence
  Description of Artificial Sequence: Synthetic peptide
AASSLQS

SEQ ID NO: 10875 - DNA, 21 bp, Artificial Sequence
  Description of Artificial Sequence: Synthetic oligonucleotide
ggtgcatccagtttacaaagt

SEQ ID NO: 10876 - protein, 7 aa, Artificial Sequence
  Description of Artificial Sequence: Synthetic peptide
GASSLQS

SEQ ID NO: 10877 - DNA, 21 bp, Artificial Sequence
  Description of Artificial Sequence: Synthetic oligonucleotide
gctgcatccagtgtgcaaagt

SEQ ID NO: 10878 - protein, 7 aa, Artificial Sequence
  Description of Artificial Sequence: Synthetic peptide
AASSVQS

SEQ ID NO: 10879 - DNA, 21 bp, Artificial Sequence
  Description of Artificial Sequence: Synthetic oligonucleotide
aaaacatccagtttgcaaagt

SEQ ID NO: 10880 - protein, 7 aa, Artificial Sequence
  Description of Artificial Sequence: Synthetic peptide
KTSSLQS

SEQ ID NO: 10881 - DNA, 21 bp, Artificial Sequence
  Description of Artificial Sequence: Synthetic oligonucleotide
ggtgcatccagcagggccact

SEQ ID NO: 10882 - protein, 7 aa, Artificial Sequence
  Description of Artificial Sequence: Synthetic peptide
GASSRAT

SEQ ID NO: 10883 - DNA, 21 bp, Artificial Sequence
  Description of Artificial Sequence: Synthetic oligonucleotide
ggtgcattcagtagggccact

SEQ ID NO: 10884 - protein, 7 aa, Artificial Sequence
  Description of Artificial Sequence: Synthetic peptide
GAFSRAT

SEQ ID NO: 10885 - DNA, 21 bp, Artificial Sequence
  Description of Artificial Sequence: Synthetic oligonucleotide
ggtgcattcagcagggccagt

SEQ ID NO: 10886 - protein, 7 aa, Artificial Sequence
  Description of Artificial Sequence: Synthetic peptide
GAFSRAS

SEQ ID NO: 10887 - DNA, 21 bp, Artificial Sequence
  Description of Artificial Sequence: Synthetic oligonucleotide
gctgcatccagtttgcaaagt

SEQ ID NO: 10888 - protein, 7 aa, Artificial Sequence
  Description of Artificial Sequence: Synthetic peptide
AASSLQS

SEQ ID NO: 10889 - DNA, 21 bp, Artificial Sequence
  Description of Artificial Sequence: Synthetic oligonucleotide
gctgcatccagtttgcaaagt

SEQ ID NO: 10890 - protein, 7 aa, Artificial Sequence
  Description of Artificial Sequence: Synthetic peptide
AASSLQS

SEQ ID NO: 10891 - DNA, 21 bp, Artificial Sequence
  Description of Artificial Sequence: Synthetic oligonucleotide
gaggtttccaaccggttctct

SEQ ID NO: 10892 - protein, 7 aa, Artificial Sequence
  Description of Artificial Sequence: Synthetic peptide
EVSNRFS

SEQ ID NO: 10893 - DNA, 21 bp, Artificial Sequence
  Description of Artificial Sequence: Synthetic oligonucleotide
ggtgcatccagcagggccact

SEQ ID NO: 10894 - protein, 7 aa, Artificial Sequence
  Description of Artificial Sequence: Synthetic peptide
GASSRAT

SEQ ID NO: 10895 - DNA, 21 bp, Artificial Sequence
  Description of Artificial Sequence: Synthetic oligonucleotide
ggtgcatccagcagggccact

SEQ ID NO: 10896 - protein, 7 aa, Artificial Sequence
  Description of Artificial Sequence: Synthetic peptide
GASSRAT

SEQ ID NO: 10897 - DNA, 21 bp, Artificial Sequence
  Description of Artificial Sequence: Synthetic oligonucleotide
tctgcatccagtttgcaaagg

SEQ ID NO: 10898 - protein, 7 aa, Artificial Sequence
  Description of Artificial Sequence: Synthetic peptide
SASSLQR

SEQ ID NO: 10899 - DNA, 21 bp, Artificial Sequence
  Description of Artificial Sequence: Synthetic oligonucleotide
gctgcatccagtttgcaaagt

SEQ ID NO: 10900 - protein, 7 aa, Artificial Sequence
  Description of Artificial Sequence: Synthetic peptide
AASSLQS

SEQ ID NO: 10901 - DNA, 21 bp, Artificial Sequence
  Description of Artificial Sequence: Synthetic oligonucleotide
ggtgcatccactagggccact

SEQ ID NO: 10902 - protein, 7 aa, Artificial Sequence
  Description of Artificial Sequence: Synthetic peptide
GASTRAT

SEQ ID NO: 10903 - DNA, 21 bp, Artificial Sequence
  Description of Artificial Sequence: Synthetic oligonucleotide
gctgcatccagtttgcaaagt

SEQ ID NO: 10904 - protein, 7 aa, Artificial Sequence
  Description of Artificial Sequence: Synthetic peptide
AASSLQS

SEQ ID NO: 10905 - DNA, 21 bp, Artificial Sequence
  Description of Artificial Sequence: Synthetic oligonucleotide
ggtgcatccagcagggccact

SEQ ID NO: 10906 - protein, 7 aa, Artificial Sequence
  Description of Artificial Sequence: Synthetic peptide
GASSRAT

SEQ ID NO: 10907 - DNA, 21 bp, Artificial Sequence
  Description of Artificial Sequence: Synthetic oligonucleotide
ggtgcattcagcagggccact

SEQ ID NO: 10908 - protein, 7 aa, Artificial Sequence
  Description of Artificial Sequence: Synthetic peptide
GAFSRAT

SEQ ID NO: 10909 - DNA, 21 bp, Artificial Sequence
  Description of Artificial Sequence: Synthetic oligonucleotide
gctgagtccagtttacaaagt

SEQ ID NO: 10910 - protein, 7 aa, Artificial Sequence
  Description of Artificial Sequence: Synthetic peptide
AESSLQS

SEQ ID NO: 10911 - DNA, 21 bp, Artificial Sequence
  Description of Artificial Sequence: Synthetic oligonucleotide
gctgcatccagtttgcaaagt

SEQ ID NO: 10912 - protein, 7 aa, Artificial Sequence
  Description of Artificial Sequence: Synthetic peptide
AASSLQS

SEQ ID NO: 10913 - DNA, 21 bp, Artificial Sequence
  Description of Artificial Sequence: Synthetic oligonucleotide
tatgcttcccagtccttctca

SEQ ID NO: 10914 - protein, 7 aa, Artificial Sequence
  Description of Artificial Sequence: Synthetic peptide
YASQSFS

SEQ ID NO: 10915 - DNA, 21 bp, Artificial Sequence
  Description of Artificial Sequence: Synthetic oligonucleotide
tgggcatctacccgggaatcc

SEQ ID NO: 10916 - protein, 7 aa, Artificial Sequence
  Description of Artificial Sequence: Synthetic peptide
WASTRES

SEQ ID NO: 10917 - DNA, 21 bp, Artificial Sequence
  Description of Artificial Sequence: Synthetic oligonucleotide
tctgcttcccagtccttctca

SEQ ID NO: 10918 - protein, 7 aa, Artificial Sequence
  Description of Artificial Sequence: Synthetic peptide
SASQSFS

SEQ ID NO: 10919 - DNA, 21 bp, Artificial Sequence
  Description of Artificial Sequence: Synthetic oligonucleotide
actgcatccagtttgcaaagt

SEQ ID NO: 10920 - protein, 7 aa, Artificial Sequence
  Description of Artificial Sequence: Synthetic peptide
TASSLQS

SEQ ID NO: 10921 - DNA, 21 bp, Artificial Sequence
  Description of Artificial Sequence: Synthetic oligonucleotide
ggtgcatccagcagggccact

SEQ ID NO: 10922 - protein, 7 aa, Artificial Sequence
  Description of Artificial Sequence: Synthetic peptide
GASSRAT

SEQ ID NO: 10923 - DNA, 21 bp, Artificial Sequence
  Description of Artificial Sequence: Synthetic oligonucleotide
tctgcatccagtttgcatact

SEQ ID NO: 10924 - protein, 7 aa, Artificial Sequence
  Description of Artificial Sequence: Synthetic peptide
SASSLHT

SEQ ID NO: 10925 - DNA, 21 bp, Artificial Sequence
  Description of Artificial Sequence: Synthetic oligonucleotide
tctgcatccattttacaaagg

SEQ ID NO: 10926 - protein, 7 aa, Artificial Sequence
  Description of Artificial Sequence: Synthetic peptide
SASILQR

SEQ ID NO: 10927 - DNA, 21 bp, Artificial Sequence
  Description of Artificial Sequence: Synthetic oligonucleotide
ggtgcatccagcagggccact

SEQ ID NO: 10928 - protein, 7 aa, Artificial Sequence
  Description of Artificial Sequence: Synthetic peptide
GASSRAT

SEQ ID NO: 10929 - DNA, 21 bp, Artificial Sequence
  Description of Artificial Sequence: Synthetic oligonucleotide
agtaatgatcagcggccctca

SEQ ID NO: 10930 - protein, 7 aa, Artificial Sequence
  Description of Artificial Sequence: Synthetic peptide
SNDQRPS

SEQ ID NO: 10931 - DNA, 21 bp, Artificial Sequence
  Description of Artificial Sequence: Synthetic oligonucleotide
ggtgcatccaccagggccact

SEQ ID NO: 10932 - protein, 7 aa, Artificial Sequence
  Description of Artificial Sequence: Synthetic peptide
GASTRAT

SEQ ID NO: 10933 - DNA, 21 bp, Artificial Sequence
  Description of Artificial Sequence: Synthetic oligonucleotide
ggtgcatccagcagggccact

SEQ ID NO: 10934 - protein, 7 aa, Artificial Sequence
  Description of Artificial Sequence: Synthetic peptide
GASSRAT

SEQ ID NO: 10935 - DNA, 21 bp, Artificial Sequence
  Description of Artificial Sequence: Synthetic oligonucleotide
tatgcttcccagtccttctca

SEQ ID NO: 10936 - protein, 7 aa, Artificial Sequence
  Description of Artificial Sequence: Synthetic peptide
YASQSFS

SEQ ID NO: 10937 - DNA, 21 bp, Artificial Sequence
  Description of Artificial Sequence: Synthetic oligonucleotide
tctacatccagtttgcattct

SEQ ID NO: 10938 - protein, 7 aa, Artificial Sequence
  Description of Artificial Sequence: Synthetic peptide
STSSLHS

SEQ ID NO: 10939 - DNA, 21 bp, Artificial Sequence
  Description of Artificial Sequence: Synthetic oligonucleotide
gctgcatccagtttgcaaagt

SEQ ID NO: 10940 - protein, 7 aa, Artificial Sequence
  Description of Artificial Sequence: Synthetic peptide
AASSLQS

SEQ ID NO: 10941 - DNA, 21 bp, Artificial Sequence
  Description of Artificial Sequence: Synthetic oligonucleotide
ttgggttctaatcgggcctcc

SEQ ID NO: 10942 - protein, 7 aa, Artificial Sequence
  Description of Artificial Sequence: Synthetic peptide
LGSNRAS

SEQ ID NO: 10943 - DNA, 21 bp, Artificial Sequence
  Description of Artificial Sequence: Synthetic oligonucleotide
gctgcatccaggttgcaaagt

SEQ ID NO: 10944 - protein, 7 aa, Artificial Sequence
  Description of Artificial Sequence: Synthetic peptide
AASRLQS

SEQ ID NO: 10945 - DNA, 21 bp, Artificial Sequence
  Description of Artificial Sequence: Synthetic oligonucleotide
ggtgcatccaccagggccact

SEQ ID NO: 10946 - protein, 7 aa, Artificial Sequence
  Description of Artificial Sequence: Synthetic peptide
GASTRAT

SEQ ID NO: 10947 - DNA, 21 bp, Artificial Sequence
  Description of Artificial Sequence: Synthetic oligonucleotide
ggtgcatccaccagggccact

SEQ ID NO: 10948 - protein, 7 aa, Artificial Sequence
  Description of Artificial Sequence: Synthetic peptide
GASTRAT

SEQ ID NO: 10949 - DNA, 21 bp, Artificial Sequence
  Description of Artificial Sequence: Synthetic oligonucleotide
ttgggttctaatcgggcctcc

SEQ ID NO: 10950 - protein, 7 aa, Artificial Sequence
  Description of Artificial Sequence: Synthetic peptide
LGSNRAS

SEQ ID NO: 10951 - DNA, 21 bp, Artificial Sequence
  Description of Artificial Sequence: Synthetic oligonucleotide
ggtgcatccagcagggccact

SEQ ID NO: 10952 - protein, 7 aa, Artificial Sequence
  Description of Artificial Sequence: Synthetic peptide
GASSRAT

SEQ ID NO: 10953 - DNA, 21 bp, Artificial Sequence
  Description of Artificial Sequence: Synthetic oligonucleotide
ggtgcatccactagggccact

SEQ ID NO: 10954 - protein, 7 aa, Artificial Sequence
  Description of Artificial Sequence: Synthetic peptide
GASTRAT

SEQ ID NO: 10955 - DNA, 21 bp, Artificial Sequence
  Description of Artificial Sequence: Synthetic oligonucleotide
gttgcatccaggttgcaaagt

SEQ ID NO: 10956 - protein, 7 aa, Artificial Sequence
  Description of Artificial Sequence: Synthetic peptide
VASRLQS

SEQ ID NO: 10957 - DNA, 21 bp, Artificial Sequence
  Description of Artificial Sequence: Synthetic oligonucleotide
gctgcatccagtttgcaaagt

SEQ ID NO: 10958 - protein, 7 aa, Artificial Sequence
  Description of Artificial Sequence: Synthetic peptide
AASSLQS

SEQ ID NO: 10959 - DNA, 21 bp, Artificial Sequence
  Description of Artificial Sequence: Synthetic oligonucleotide
gctgcatccagtttgcaaagt

SEQ ID NO: 10960 - protein, 7 aa, Artificial Sequence
  Description of Artificial Sequence: Synthetic peptide
AASSLQS

SEQ ID NO: 10961 - DNA, 21 bp, Artificial Sequence
  Description of Artificial Sequence: Synthetic oligonucleotide
agggcatccagtgtgcaaaat

SEQ ID NO: 10962 - protein, 7 aa, Artificial Sequence
  Description of Artificial Sequence: Synthetic peptide
RASSVQN

SEQ ID NO: 10963 - DNA, 21 bp, Artificial Sequence
  Description of Artificial Sequence: Synthetic oligonucleotide
tgggcatctacccgggaatcc

SEQ ID NO: 10964 - protein, 7 aa, Artificial Sequence
  Description of Artificial Sequence: Synthetic peptide
WASTRES

SEQ ID NO: 10965 - DNA, 21 bp, Artificial Sequence
  Description of Artificial Sequence: Synthetic oligonucleotide
tgggcatctacccgggaatcc

SEQ ID NO: 10966 - protein, 7 aa, Artificial Sequence
  Description of Artificial Sequence: Synthetic peptide
WASTRES

SEQ ID NO: 10967 - DNA, 21 bp, Artificial Sequence
  Description of Artificial Sequence: Synthetic oligonucleotide
gctgcagccagtttgcaaggt

SEQ ID NO: 10968 - protein, 7 aa, Artificial Sequence
  Description of Artificial Sequence: Synthetic peptide
AAASLQG

SEQ ID NO: 10969 - DNA, 21 bp, Artificial Sequence
  Description of Artificial Sequence: Synthetic oligonucleotide
gctgcatccagtttgcaaagt

SEQ ID NO: 10970 - protein, 7 aa, Artificial Sequence
  Description of Artificial Sequence: Synthetic peptide
AASSLQS

SEQ ID NO: 10971 - DNA, 21 bp, Artificial Sequence
  Description of Artificial Sequence: Synthetic oligonucleotide
ggtgcatccaccagggccact

SEQ ID NO: 10972 - protein, 7 aa, Artificial Sequence
  Description of Artificial Sequence: Synthetic peptide
GASTRAT

SEQ ID NO: 10973 - DNA, 21 bp, Artificial Sequence
  Description of Artificial Sequence: Synthetic oligonucleotide
ggtgcatccagtttgcaacgt

SEQ ID NO: 10974 - protein, 7 aa, Artificial Sequence
  Description of Artificial Sequence: Synthetic peptide
GASSLQR

SEQ ID NO: 10975 - DNA, 21 bp, Artificial Sequence
  Description of Artificial Sequence: Synthetic oligonucleotide
gctgcatccagtttgcaaagt

SEQ ID NO: 10976 - protein, 7 aa, Artificial Sequence
  Description of Artificial Sequence: Synthetic peptide
AASSLQS

SEQ ID NO: 10977 - DNA, 21 bp, Artificial Sequence
  Description of Artificial Sequence: Synthetic oligonucleotide
gctgcatccagtttgcaaagt

SEQ ID NO: 10978 - protein, 7 aa, Artificial Sequence
  Description of Artificial Sequence: Synthetic peptide
AASSLQS

SEQ ID NO: 10979 - DNA, 21 bp, Artificial Sequence
  Description of Artificial Sequence: Synthetic oligonucleotide
tctgcatccagtttgcaaagt

SEQ ID NO: 10980 - protein, 7 aa, Artificial Sequence
  Description of Artificial Sequence: Synthetic peptide
SASSLQS

SEQ ID NO: 10981 - DNA, 21 bp, Artificial Sequence
  Description of Artificial Sequence: Synthetic oligonucleotide
ggtgcatccaggagggccact

SEQ ID NO: 10982 - protein, 7 aa, Artificial Sequence
  Description of Artificial Sequence: Synthetic peptide
GASRRAT

SEQ ID NO: 10983 - DNA, 21 bp, Artificial Sequence
  Description of Artificial Sequence: Synthetic oligonucleotide
gctgcatccagtttgcaaagt

SEQ ID NO: 10984 - protein, 7 aa, Artificial Sequence
  Description of Artificial Sequence: Synthetic peptide
AASSLQS

SEQ ID NO: 10985 - DNA, 21 bp, Artificial Sequence
  Description of Artificial Sequence: Synthetic oligonucleotide
ggtgcatccaccagggccact

SEQ ID NO: 10986 - protein, 7 aa, Artificial Sequence
  Description of Artificial Sequence: Synthetic peptide
GASTRAT

SEQ ID NO: 10987 - DNA, 21 bp, Artificial Sequence
  Description of Artificial Sequence: Synthetic oligonucleotide
ggtgtctccagtttgcaaagt

SEQ ID NO: 10988 - protein, 7 aa, Artificial Sequence
  Description of Artificial Sequence: Synthetic peptide
GVSSLQS

SEQ ID NO: 10989 - DNA, 21 bp, Artificial Sequence
  Description of Artificial Sequence: Synthetic oligonucleotide
ggtgcatccagcagggccgct

SEQ ID NO: 10990 - protein, 7 aa, Artificial Sequence
  Description of Artificial Sequence: Synthetic peptide
GASSRAA

SEQ ID NO: 10991 - DNA, 21 bp, Artificial Sequence
  Description of Artificial Sequence: Synthetic oligonucleotide
ttgggttctaatcgggcctcc

SEQ ID NO: 10992 - protein, 7 aa, Artificial Sequence
  Description of Artificial Sequence: Synthetic peptide
LGSNRAS

SEQ ID NO: 10993 - DNA, 21 bp, Artificial Sequence
  Description of Artificial Sequence: Synthetic oligonucleotide
ggtgcatccaccagggccact

SEQ ID NO: 10994 - protein, 7 aa, Artificial Sequence
  Description of Artificial Sequence: Synthetic peptide
GASTRAT

SEQ ID NO: 10995 - DNA, 21 bp, Artificial Sequence
  Description of Artificial Sequence: Synthetic oligonucleotide
tctgcatcctttttgcaaaga

SEQ ID NO: 10996 - protein, 7 aa, Artificial Sequence
  Description of Artificial Sequence: Synthetic peptide
SASFLQR

SEQ ID NO: 10997 - DNA, 21 bp, Artificial Sequence
  Description of Artificial Sequence: Synthetic oligonucleotide
ggtgcatccagcagggccact

SEQ ID NO: 10998 - protein, 7 aa, Artificial Sequence
  Description of Artificial Sequence: Synthetic peptide
GASSRAT

SEQ ID NO: 10999 - DNA, 21 bp, Artificial Sequence
  Description of Artificial Sequence: Synthetic oligonucleotide
gctgcatccagtttgcaaagt

SEQ ID NO: 11000 - protein, 7 aa, Artificial Sequence
  Description of Artificial Sequence: Synthetic peptide
AASSLQS

SEQ ID NO: 11001 - DNA, 21 bp, Artificial Sequence
  Description of Artificial Sequence: Synthetic oligonucleotide
tatgcttcccagtccttctca

SEQ ID NO: 11002 - protein, 7 aa, Artificial Sequence
  Description of Artificial Sequence: Synthetic peptide
YASQSFS

SEQ ID NO: 11003 - DNA, 21 bp, Artificial Sequence
  Description of Artificial Sequence: Synthetic oligonucleotide
gctgcatccagtttgcaaagt

SEQ ID NO: 11004 - protein, 7 aa, Artificial Sequence
  Description of Artificial Sequence: Synthetic peptide
AASSLQS

SEQ ID NO: 11005 - DNA, 21 bp, Artificial Sequence
  Description of Artificial Sequence: Synthetic oligonucleotide
gctgcatccagtttgcaaagt

SEQ ID NO: 11006 - protein, 7 aa, Artificial Sequence
  Description of Artificial Sequence: Synthetic peptide
AASSLQS

SEQ ID NO: 11007 - DNA, 21 bp, Artificial Sequence
  Description of Artificial Sequence: Synthetic oligonucleotide
gctgcatccagtttgcaaagt

SEQ ID NO: 11008 - protein, 7 aa, Artificial Sequence
  Description of Artificial Sequence: Synthetic peptide
AASSLQS

SEQ ID NO: 11009 - DNA, 21 bp, Artificial Sequence
  Description of Artificial Sequence: Synthetic oligonucleotide
gctgcatccagtttgcaaagt

SEQ ID NO: 11010 - protein, 7 aa, Artificial Sequence
  Description of Artificial Sequence: Synthetic peptide
AASSLQS

SEQ ID NO: 11011 - DNA, 21 bp, Artificial Sequence
  Description of Artificial Sequence: Synthetic oligonucleotide
ttgggttctaatcgggcctcc

SEQ ID NO: 11012 - protein, 7 aa, Artificial Sequence
  Description of Artificial Sequence: Synthetic peptide
LGSNRAS

SEQ ID NO: 11013 - DNA, 21 bp, Artificial Sequence
  Description of Artificial Sequence: Synthetic oligonucleotide
ggtgcatccagcagggccact

SEQ ID NO: 11014 - protein, 7 aa, Artificial Sequence
  Description of Artificial Sequence: Synthetic peptide
GASSRAT

SEQ ID NO: 11015 - DNA, 21 bp, Artificial Sequence
  Description of Artificial Sequence: Synthetic oligonucleotide
gctgcatccagtttgcaaagt

SEQ ID NO: 11016 - protein, 7 aa, Artificial Sequence
  Description of Artificial Sequence: Synthetic peptide
AASSLQS

SEQ ID NO: 11017 - DNA, 21 bp, Artificial Sequence
  Description of Artificial Sequence: Synthetic oligonucleotide
ggtgcatccagcagggccact

SEQ ID NO: 11018 - protein, 7 aa, Artificial Sequence
  Description of Artificial Sequence: Synthetic peptide
GASSRAT

SEQ ID NO: 11019 - DNA, 21 bp, Artificial Sequence
  Description of Artificial Sequence: Synthetic oligonucleotide
gctgcatccagtttgcaaagt

SEQ ID NO: 11020 - protein, 7 aa, Artificial Sequence
  Description of Artificial Sequence: Synthetic peptide
AASSLQS

SEQ ID NO: 11021 - DNA, 21 bp, Artificial Sequence
  Description of Artificial Sequence: Synthetic oligonucleotide
gctgcatccagtttgcaaagt

SEQ ID NO: 11022 - protein, 7 aa, Artificial Sequence
  Description of Artificial Sequence: Synthetic peptide
AASSLQS

SEQ ID NO: 11023 - DNA, 21 bp, Artificial Sequence
  Description of Artificial Sequence: Synthetic oligonucleotide
gctgcatccagtttgcaaagt

SEQ ID NO: 11024 - protein, 7 aa, Artificial Sequence
  Description of Artificial Sequence: Synthetic peptide
AASSLQS

SEQ ID NO: 11025 - DNA, 21 bp, Artificial Sequence
  Description of Artificial Sequence: Synthetic oligonucleotide
gctgcatccagtttgtttagt

SEQ ID NO: 11026 - protein, 7 aa, Artificial Sequence
  Description of Artificial Sequence: Synthetic peptide
AASSLFS

SEQ ID NO: 11027 - DNA, 21 bp, Artificial Sequence
  Description of Artificial Sequence: Synthetic oligonucleotide
ggtgcatccaccagggccact

SEQ ID NO: 11028 - protein, 7 aa, Artificial Sequence
  Description of Artificial Sequence: Synthetic peptide
GASTRAT

SEQ ID NO: 11029 - DNA, 21 bp, Artificial Sequence
  Description of Artificial Sequence: Synthetic oligonucleotide
gctgcatccagtttgcaaagt

SEQ ID NO: 11030 - protein, 7 aa, Artificial Sequence
  Description of Artificial Sequence: Synthetic peptide
AASSLQS

SEQ ID NO: 11031 - DNA, 21 bp, Artificial Sequence
  Description of Artificial Sequence: Synthetic oligonucleotide
gctgcatccagtttgcaaagt

SEQ ID NO: 11032 - protein, 7 aa, Artificial Sequence
  Description of Artificial Sequence: Synthetic peptide
AASSLQS

SEQ ID NO: 11033 - DNA, 21 bp, Artificial Sequence
  Description of Artificial Sequence: Synthetic oligonucleotide
ttggtttctaatcgggcctcc

SEQ ID NO: 11034 - protein, 7 aa, Artificial Sequence
  Description of Artificial Sequence: Synthetic peptide
LVSNRAS

SEQ ID NO: 11035 - DNA, 21 bp, Artificial Sequence
  Description of Artificial Sequence: Synthetic oligonucleotide
gatgcatccagtttggaaagt

SEQ ID NO: 11036 - protein, 7 aa, Artificial Sequence
  Description of Artificial Sequence: Synthetic peptide
DASSLES

SEQ ID NO: 11037 - DNA, 21 bp, Artificial Sequence
  Description of Artificial Sequence: Synthetic oligonucleotide
gctgcatccagattgcaaagt

SEQ ID NO: 11038 - protein, 7 aa, Artificial Sequence
  Description of Artificial Sequence: Synthetic peptide
AASRLQS

SEQ ID NO: 11039 - DNA, 21 bp, Artificial Sequence
  Description of Artificial Sequence: Synthetic oligonucleotide
ggtgcatccagcagggccact

SEQ ID NO: 11040 - protein, 7 aa, Artificial Sequence
  Description of Artificial Sequence: Synthetic peptide
GASSRAT

SEQ ID NO: 11041 - DNA, 21 bp, Artificial Sequence
  Description of Artificial Sequence: Synthetic oligonucleotide
gctgcatccagtttgctaagt

SEQ ID NO: 11042 - protein, 7 aa, Artificial Sequence
  Description of Artificial Sequence: Synthetic peptide
AASSLLS

SEQ ID NO: 11043 - DNA, 21 bp, Artificial Sequence
  Description of Artificial Sequence: Synthetic oligonucleotide
gctgcatccagtttgcaaagt

SEQ ID NO: 11044 - protein, 7 aa, Artificial Sequence
  Description of Artificial Sequence: Synthetic peptide
AASSLQS

SEQ ID NO: 11045 - DNA, 21 bp, Artificial Sequence
  Description of Artificial Sequence: Synthetic oligonucleotide
ttgggttctaatcgggcctcc

SEQ ID NO: 11046 - protein, 7 aa, Artificial Sequence
  Description of Artificial Sequence: Synthetic peptide
LGSNRAS

SEQ ID NO: 11047 - DNA, 21 bp, Artificial Sequence
  Description of Artificial Sequence: Synthetic oligonucleotide
gctgcatccagtttgcaaagt

SEQ ID NO: 11048 - protein, 7 aa, Artificial Sequence
  Description of Artificial Sequence: Synthetic peptide
AASSLQS

SEQ ID NO: 11049 - DNA, 21 bp, Artificial Sequence
  Description of Artificial Sequence: Synthetic oligonucleotide
gctgcatccagtttgcaaagt

SEQ ID NO: 11050 - protein, 7 aa, Artificial Sequence
  Description of Artificial Sequence: Synthetic peptide
AASSLQS

SEQ ID NO: 11051 - DNA, 21 bp, Artificial Sequence
  Description of Artificial Sequence: Synthetic oligonucleotide
gctgcatccagtttgcaaagt

SEQ ID NO: 11052 - protein, 7 aa, Artificial Sequence
  Description of Artificial Sequence: Synthetic peptide
AASSLQS

SEQ ID NO: 11053 - DNA, 21 bp, Artificial Sequence
  Description of Artificial Sequence: Synthetic oligonucleotide
ggtacatccaccagggccact

SEQ ID NO: 11054 - protein, 7 aa, Artificial Sequence
  Description of Artificial Sequence: Synthetic peptide
GTSTRAT

SEQ ID NO: 11055 - DNA, 21 bp, Artificial Sequence
  Description of Artificial Sequence: Synthetic oligonucleotide
tctgcatccaatttgcaaagt

SEQ ID NO: 11056 - protein, 7 aa, Artificial Sequence
  Description of Artificial Sequence: Synthetic peptide
SASNLQS

SEQ ID NO: 11057 - DNA, 21 bp, Artificial Sequence
  Description of Artificial Sequence: Synthetic oligonucleotide
gctgcatccagtttgcaaagt

SEQ ID NO: 11058 - protein, 7 aa, Artificial Sequence
  Description of Artificial Sequence: Synthetic peptide
AASSLQS

SEQ ID NO: 11059 - DNA, 21 bp, Artificial Sequence
  Description of Artificial Sequence: Synthetic oligonucleotide
gctgcatccagattgcaaagt

SEQ ID NO: 11060 - protein, 7 aa, Artificial Sequence
  Description of Artificial Sequence: Synthetic peptide
AASRLQS

SEQ ID NO: 11061 - DNA, 21 bp, Artificial Sequence
  Description of Artificial Sequence: Synthetic oligonucleotide
gctgcatccagtttgcaaagt

SEQ ID NO: 11062 - protein, 7 aa, Artificial Sequence
  Description of Artificial Sequence: Synthetic peptide
AASSLQS

SEQ ID NO: 11063 - DNA, 21 bp, Artificial Sequence
  Description of Artificial Sequence: Synthetic oligonucleotide
gctgcatccagtgtgctaagt

SEQ ID NO: 11064 - protein, 7 aa, Artificial Sequence
  Description of Artificial Sequence: Synthetic peptide
AASSVLS

SEQ ID NO: 11065 - DNA, 21 bp, Artificial Sequence
  Description of Artificial Sequence: Synthetic oligonucleotide
gctgcatccagtttgcaaagt

SEQ ID NO: 11066 - protein, 7 aa, Artificial Sequence
  Description of Artificial Sequence: Synthetic peptide
AASSLQS

SEQ ID NO: 11067 - DNA, 21 bp, Artificial Sequence
  Description of Artificial Sequence: Synthetic oligonucleotide
gctgcatccagattgcaaagt

SEQ ID NO: 11068 - protein, 7 aa, Artificial Sequence
  Description of Artificial Sequence: Synthetic peptide
AASRLQS

SEQ ID NO: 11069 - DNA, 21 bp, Artificial Sequence
  Description of Artificial Sequence: Synthetic oligonucleotide
gctgcatccagtttgcaaagt

SEQ ID NO: 11070 - protein, 7 aa, Artificial Sequence
  Description of Artificial Sequence: Synthetic peptide
AASSLQS

SEQ ID NO: 11071 - DNA, 21 bp, Artificial Sequence
  Description of Artificial Sequence: Synthetic oligonucleotide
tgggcatctacccgggaatcc

SEQ ID NO: 11072 - protein, 7 aa, Artificial Sequence
  Description of Artificial Sequence: Synthetic peptide
WASTRES

SEQ ID NO: 11073 - DNA, 21 bp, Artificial Sequence
  Description of Artificial Sequence: Synthetic oligonucleotide
tgggcatctacccgggaatcc

SEQ ID NO: 11074 - protein, 7 aa, Artificial Sequence
  Description of Artificial Sequence: Synthetic peptide
WASTRES

SEQ ID NO: 11075 - DNA, 21 bp, Artificial Sequence
  Description of Artificial Sequence: Synthetic oligonucleotide
gctgcatccagtttgcaaagt

SEQ ID NO: 11076 - protein, 7 aa, Artificial Sequence
  Description of Artificial Sequence: Synthetic peptide
AASSLQS

SEQ ID NO: 11077 - DNA, 21 bp, Artificial Sequence
  Description of Artificial Sequence: Synthetic oligonucleotide
gctgcatccagtttgcaaagt

SEQ ID NO: 11078 - protein, 7 aa, Artificial Sequence
  Description of Artificial Sequence: Synthetic peptide
AASSLQS

SEQ ID NO: 11079 - DNA, 21 bp, Artificial Sequence
  Description of Artificial Sequence: Synthetic oligonucleotide
tatgcttcccagtccttctca

SEQ ID NO: 11080 - protein, 7 aa, Artificial Sequence
  Description of Artificial Sequence: Synthetic peptide
YASQSFS

SEQ ID NO: 11081 - DNA, 21 bp, Artificial Sequence
  Description of Artificial Sequence: Synthetic oligonucleotide
gctgcatccagtttgcaaagt

SEQ ID NO: 11082 - protein, 7 aa, Artificial Sequence
  Description of Artificial Sequence: Synthetic peptide
AASSLQS

SEQ ID NO: 11083 - DNA, 21 bp, Artificial Sequence
  Description of Artificial Sequence: Synthetic oligonucleotide
gctgcatccagtttgcaaagt

SEQ ID NO: 11084 - protein, 7 aa, Artificial Sequence
  Description of Artificial Sequence: Synthetic peptide
AASSLQS

SEQ ID NO: 11085 - DNA, 21 bp, Artificial Sequence
  Description of Artificial Sequence: Synthetic oligonucleotide
gctgcatccagtttgcaaagt

SEQ ID NO: 11086 - protein, 7 aa, Artificial Sequence
  Description of Artificial Sequence: Synthetic peptide
AASSLQS

SEQ ID NO: 11087 - DNA, 21 bp, Artificial Sequence
  Description of Artificial Sequence: Synthetic oligonucleotide
gctgcatccagtttgcaaagt

SEQ ID NO: 11088 - protein, 7 aa, Artificial Sequence
  Description of Artificial Sequence: Synthetic peptide
AASSLQS

SEQ ID NO: 11089 - DNA, 21 bp, Artificial Sequence
  Description of Artificial Sequence: Synthetic oligonucleotide
gctgcatccagtttgcaaagt

SEQ ID NO: 11090 - protein, 7 aa, Artificial Sequence
  Description of Artificial Sequence: Synthetic peptide
AASSLQS

SEQ ID NO: 11091 - DNA, 21 bp, Artificial Sequence
  Description of Artificial Sequence: Synthetic oligonucleotide
gctgcatccagtttgcaaagt

SEQ ID NO: 11092 - protein, 7 aa, Artificial Sequence
  Description of Artificial Sequence: Synthetic peptide
AASSLQS

SEQ ID NO: 11093 - DNA, 21 bp, Artificial Sequence
  Description of Artificial Sequence: Synthetic oligonucleotide
gctgcatccagtttgcatagt

SEQ ID NO: 11094 - protein, 7 aa, Artificial Sequence
  Description of Artificial Sequence: Synthetic peptide
AASSLHS

SEQ ID NO: 11095 - DNA, 21 bp, Artificial Sequence
  Description of Artificial Sequence: Synthetic oligonucleotide
tatgcttcccagtccctctca

SEQ ID NO: 11096 - protein, 7 aa, Artificial Sequence
  Description of Artificial Sequence: Synthetic peptide
YASQSLS

SEQ ID NO: 11097 - DNA, 21 bp, Artificial Sequence
  Description of Artificial Sequence: Synthetic oligonucleotide
ggtgcatccagcagggccact

SEQ ID NO: 11098 - protein, 7 aa, Artificial Sequence
  Description of Artificial Sequence: Synthetic peptide
GASSRAT

SEQ ID NO: 11099 - DNA, 21 bp, Artificial Sequence
  Description of Artificial Sequence: Synthetic oligonucleotide
gctgcatccagtttgcaaagt

SEQ ID NO: 11100 - protein, 7 aa, Artificial Sequence
  Description of Artificial Sequence: Synthetic peptide
AASSLQS

SEQ ID NO: 11101 - DNA, 21 bp, Artificial Sequence
  Description of Artificial Sequence: Synthetic oligonucleotide
gctgcatccagtttacagagt

SEQ ID NO: 11102 - protein, 7 aa, Artificial Sequence
  Description of Artificial Sequence: Synthetic peptide
AASSLQS

SEQ ID NO: 11103 - DNA, 21 bp, Artificial Sequence
  Description of Artificial Sequence: Synthetic oligonucleotide
ggtgcatccagcagggccatt

SEQ ID NO: 11104 - protein, 7 aa, Artificial Sequence
  Description of Artificial Sequence: Synthetic peptide
GASSRAI

SEQ ID NO: 11105 - DNA, 21 bp, Artificial Sequence
  Description of Artificial Sequence: Synthetic oligonucleotide
ggtgcatccaccagggccact

SEQ ID NO: 11106 - protein, 7 aa, Artificial Sequence
  Description of Artificial Sequence: Synthetic peptide
GASTRAT

SEQ ID NO: 11107 - DNA, 21 bp, Artificial Sequence
  Description of Artificial Sequence: Synthetic oligonucleotide
ggtacatccaccagggccact

SEQ ID NO: 11108 - protein, 7 aa, Artificial Sequence
  Description of Artificial Sequence: Synthetic peptide
GTSTRAT

SEQ ID NO: 11109 - DNA, 21 bp, Artificial Sequence
  Description of Artificial Sequence: Synthetic oligonucleotide
gctgcatccagtttgcaaagt

SEQ ID NO: 11110 - protein, 7 aa, Artificial Sequence
  Description of Artificial Sequence: Synthetic peptide
AASSLQS

SEQ ID NO: 11111 - DNA, 21 bp, Artificial Sequence
  Description of Artificial Sequence: Synthetic oligonucleotide
ggtgcatccagtttgcaaagt

SEQ ID NO: 11112 - protein, 7 aa, Artificial Sequence
  Description of Artificial Sequence: Synthetic peptide
GASSLQS

SEQ ID NO: 11113 - DNA, 21 bp, Artificial Sequence
  Description of Artificial Sequence: Synthetic oligonucleotide
tatgcttcccagtccttctca

SEQ ID NO: 11114 - protein, 7 aa, Artificial Sequence
  Description of Artificial Sequence: Synthetic peptide
YASQSFS

SEQ ID NO: 11115 - DNA, 21 bp, Artificial Sequence
  Description of Artificial Sequence: Synthetic oligonucleotide
gctgcatccagtttgcaaagt

SEQ ID NO: 11116 - protein, 7 aa, Artificial Sequence
  Description of Artificial Sequence: Synthetic peptide
AASSLQS

SEQ ID NO: 11117 - DNA, 21 bp, Artificial Sequence
  Description of Artificial Sequence: Synthetic oligonucleotide
gctgcatccagtttgcaaagt

SEQ ID NO: 11118 - protein, 7 aa, Artificial Sequence
  Description of Artificial Sequence: Synthetic peptide
AASSLQS

SEQ ID NO: 11119 - DNA, 21 bp, Artificial Sequence
  Description of Artificial Sequence: Synthetic oligonucleotide
gctgcatccagattgcaaagt

SEQ ID NO: 11120 - protein, 7 aa, Artificial Sequence
  Description of Artificial Sequence: Synthetic peptide
AASRLQS

SEQ ID NO: 11121 - DNA, 21 bp, Artificial Sequence
  Description of Artificial Sequence: Synthetic oligonucleotide
gctgcatccagtttgcaaagt

SEQ ID NO: 11122 - protein, 7 aa, Artificial Sequence
  Description of Artificial Sequence: Synthetic peptide
AASSLQS

SEQ ID NO: 11123 - DNA, 21 bp, Artificial Sequence
  Description of Artificial Sequence: Synthetic oligonucleotide
gctgcatccagtttgcaaagt

SEQ ID NO: 11124 - protein, 7 aa, Artificial Sequence
  Description of Artificial Sequence: Synthetic peptide
AASSLQS

SEQ ID NO: 11125 - DNA, 21 bp, Artificial Sequence
  Description of Artificial Sequence: Synthetic oligonucleotide
gctgcatccagtttgcaaagt

SEQ ID NO: 11126 - protein, 7 aa, Artificial Sequence
  Description of Artificial Sequence: Synthetic peptide
AASSLQS

SEQ ID NO: 11127 - DNA, 21 bp, Artificial Sequence
  Description of Artificial Sequence: Synthetic oligonucleotide
tctgcatccaatttgcaaagt

SEQ ID NO: 11128 - protein, 7 aa, Artificial Sequence
  Description of Artificial Sequence: Synthetic peptide
SASNLQS

SEQ ID NO: 11129 - DNA, 21 bp, Artificial Sequence
  Description of Artificial Sequence: Synthetic oligonucleotide
gttacatccagcagggccact

SEQ ID NO: 11130 - protein, 7 aa, Artificial Sequence
  Description of Artificial Sequence: Synthetic peptide
VTSSRAT

SEQ ID NO: 11131 - DNA, 21 bp, Artificial Sequence
  Description of Artificial Sequence: Synthetic oligonucleotide
ggtgcatccagtttgcaaagt

SEQ ID NO: 11132 - protein, 7 aa, Artificial Sequence
  Description of Artificial Sequence: Synthetic peptide
GASSLQS

SEQ ID NO: 11133 - DNA, 21 bp, Artificial Sequence
  Description of Artificial Sequence: Synthetic oligonucleotide
actgcatccaatttgcaaagt

SEQ ID NO: 11134 - protein, 7 aa, Artificial Sequence
  Description of Artificial Sequence: Synthetic peptide
TASNLQS

SEQ ID NO: 11135 - DNA, 21 bp, Artificial Sequence
  Description of Artificial Sequence: Synthetic oligonucleotide
gctgcatccaatttacaaagt

SEQ ID NO: 11136 - protein, 7 aa, Artificial Sequence
  Description of Artificial Sequence: Synthetic peptide
AASNLQS

SEQ ID NO: 11137 - DNA, 21 bp, Artificial Sequence
  Description of Artificial Sequence: Synthetic oligonucleotide
actgcatccaatttgcaaagt

SEQ ID NO: 11138 - protein, 7 aa, Artificial Sequence
  Description of Artificial Sequence: Synthetic peptide
TASNLQS

SEQ ID NO: 11139 - DNA, 21 bp, Artificial Sequence
  Description of Artificial Sequence: Synthetic oligonucleotide
actgcatccaatttgcaaagt

SEQ ID NO: 11140 - protein, 7 aa, Artificial Sequence
  Description of Artificial Sequence: Synthetic peptide
TASNLQS

SEQ ID NO: 11141 - DNA, 21 bp, Artificial Sequence
  Description of Artificial Sequence: Synthetic oligonucleotide
tgggcatctacccgggaaacc

SEQ ID NO: 11142 - protein, 7 aa, Artificial Sequence
  Description of Artificial Sequence: Synthetic peptide
WASTRET

SEQ ID NO: 11143 - DNA, 21 bp, Artificial Sequence
  Description of Artificial Sequence: Synthetic oligonucleotide
gctgcatccagtttgcaaagt

SEQ ID NO: 11144 - protein, 7 aa, Artificial Sequence
  Description of Artificial Sequence: Synthetic peptide
AASSLQS

SEQ ID NO: 11145 - DNA, 21 bp, Artificial Sequence
  Description of Artificial Sequence: Synthetic oligonucleotide
actgcatcgagtttgcaaagt

SEQ ID NO: 11146 - protein, 7 aa, Artificial Sequence
  Description of Artificial Sequence: Synthetic peptide
TASSLQS

SEQ ID NO: 11147 - DNA, 21 bp, Artificial Sequence
  Description of Artificial Sequence: Synthetic oligonucleotide
ggtgcatcaagcagggccact

SEQ ID NO: 11148 - protein, 7 aa, Artificial Sequence
  Description of Artificial Sequence: Synthetic peptide
GASSRAT

SEQ ID NO: 11149 - DNA, 21 bp, Artificial Sequence
  Description of Artificial Sequence: Synthetic oligonucleotide
actgcatccaatttgcaaagt

SEQ ID NO: 11150 - protein, 7 aa, Artificial Sequence
  Description of Artificial Sequence: Synthetic peptide
TASNLQS

SEQ ID NO: 11151 - DNA, 21 bp, Artificial Sequence
  Description of Artificial Sequence: Synthetic oligonucleotide
attgcatcgagtttgcaaagt

SEQ ID NO: 11152 - protein, 7 aa, Artificial Sequence
  Description of Artificial Sequence: Synthetic peptide
IASSLQS

SEQ ID NO: 11153 - DNA, 21 bp, Artificial Sequence
  Description of Artificial Sequence: Synthetic oligonucleotide
gctgcatccagtttgcaaagt

SEQ ID NO: 11154 - protein, 7 aa, Artificial Sequence
  Description of Artificial Sequence: Synthetic peptide
AASSLQS

SEQ ID NO: 11155 - DNA, 21 bp, Artificial Sequence
  Description of Artificial Sequence: Synthetic oligonucleotide
actgcatccaatttgcaaagt

SEQ ID NO: 11156 - protein, 7 aa, Artificial Sequence
  Description of Artificial Sequence: Synthetic peptide
TASNLQS

SEQ ID NO: 11157 - DNA, 21 bp, Artificial Sequence
  Description of Artificial Sequence: Synthetic oligonucleotide
tgggcatctacccgggaatcc

SEQ ID NO: 11158 - protein, 7 aa, Artificial Sequence
  Description of Artificial Sequence: Synthetic peptide
WASTRES

SEQ ID NO: 11159 - DNA, 21 bp, Artificial Sequence
  Description of Artificial Sequence: Synthetic oligonucleotide
gctgcatccaatttgcaaagt

SEQ ID NO: 11160 - protein, 7 aa, Artificial Sequence
  Description of Artificial Sequence: Synthetic peptide
AASNLQS

SEQ ID NO: 11161 - DNA, 21 bp, Artificial Sequence
  Description of Artificial Sequence: Synthetic oligonucleotide
gctgcatccagtttgcaaagt

SEQ ID NO: 11162 - protein, 7 aa, Artificial Sequence
  Description of Artificial Sequence: Synthetic peptide
AASSLQS

SEQ ID NO: 11163 - DNA, 21 bp, Artificial Sequence
  Description of Artificial Sequence: Synthetic oligonucleotide
gctgcatccagtttgcaaagt

SEQ ID NO: 11164 - protein, 7 aa, Artificial Sequence
  Description of Artificial Sequence: Synthetic peptide
AASSLQS

SEQ ID NO: 11165 - DNA, 21 bp, Artificial Sequence
  Description of Artificial Sequence: Synthetic oligonucleotide
gctgcatccagtttgcaaagt

SEQ ID NO: 11166 - protein, 7 aa, Artificial Sequence
  Description of Artificial Sequence: Synthetic peptide
AASSLQS

SEQ ID NO: 11167 - DNA, 21 bp, Artificial Sequence
  Description of Artificial Sequence: Synthetic oligonucleotide
gaaatttccaaccggttctct

SEQ ID NO: 11168 - protein, 7 aa, Artificial Sequence
  Description of Artificial Sequence: Synthetic peptide
EISNRFS

SEQ ID NO: 11169 - DNA, 21 bp, Artificial Sequence
  Description of Artificial Sequence: Synthetic oligonucleotide
gctacatccagtttgcaaagt

SEQ ID NO: 11170 - protein, 7 aa, Artificial Sequence
  Description of Artificial Sequence: Synthetic peptide
ATSSLQS

SEQ ID NO: 11171 - DNA, 21 bp, Artificial Sequence
  Description of Artificial Sequence: Synthetic oligonucleotide
gctgcatccagtttgcaaagt

SEQ ID NO: 11172 - protein, 7 aa, Artificial Sequence
  Description of Artificial Sequence: Synthetic peptide
AASSLQS

SEQ ID NO: 11173 - DNA, 21 bp, Artificial Sequence
  Description of Artificial Sequence: Synthetic oligonucleotide
tgggcatctacccgggaatcc

SEQ ID NO: 11174 - protein, 7 aa, Artificial Sequence
  Description of Artificial Sequence: Synthetic peptide
WASTRES

SEQ ID NO: 11175 - DNA, 21 bp, Artificial Sequence
  Description of Artificial Sequence: Synthetic oligonucleotide
gctgcatccagtttgcaaagt

SEQ ID NO: 11176 - protein, 7 aa, Artificial Sequence
  Description of Artificial Sequence: Synthetic peptide
AASSLQS

SEQ ID NO: 11177 - DNA, 21 bp, Artificial Sequence
  Description of Artificial Sequence: Synthetic oligonucleotide
gaaatttccaaccggttctct

SEQ ID NO: 11178 - protein, 7 aa, Artificial Sequence
  Description of Artificial Sequence: Synthetic peptide
EISNRFS

SEQ ID NO: 11179 - DNA, 21 bp, Artificial Sequence
  Description of Artificial Sequence: Synthetic oligonucleotide
tggtcgtctacccggaaatcc

SEQ ID NO: 11180 - protein, 7 aa, Artificial Sequence
  Description of Artificial Sequence: Synthetic peptide
WSSTRKS

SEQ ID NO: 11181 - DNA, 21 bp, Artificial Sequence
  Description of Artificial Sequence: Synthetic oligonucleotide
tgggcatctacccgggagtcc

SEQ ID NO: 11182 - protein, 7 aa, Artificial Sequence
  Description of Artificial Sequence: Synthetic peptide
WASTRES

SEQ ID NO: 11183 - DNA, 21 bp, Artificial Sequence
  Description of Artificial Sequence: Synthetic oligonucleotide
gctgcatccagtttacaaagt

SEQ ID NO: 11184 - protein, 7 aa, Artificial Sequence
  Description of Artificial Sequence: Synthetic peptide
AASSLQS

SEQ ID NO: 11185 - DNA, 21 bp, Artificial Sequence
  Description of Artificial Sequence: Synthetic oligonucleotide
gaaatttccaaccggttctct

SEQ ID NO: 11186 - protein, 7 aa, Artificial Sequence
  Description of Artificial Sequence: Synthetic peptide
EISNRFS

SEQ ID NO: 11187 - DNA, 21 bp, Artificial Sequence
  Description of Artificial Sequence: Synthetic oligonucleotide
tgggcatctacccgggaatcc

SEQ ID NO: 11188 - protein, 7 aa, Artificial Sequence
  Description of Artificial Sequence: Synthetic peptide
WASTRES

SEQ ID NO: 11189 - DNA, 21 bp, Artificial Sequence
  Description of Artificial Sequence: Synthetic oligonucleotide
gaaatttccaaccggttctct

SEQ ID NO: 11190 - protein, 7 aa, Artificial Sequence
  Description of Artificial Sequence: Synthetic peptide
EISNRFS

SEQ ID NO: 11191 - DNA, 21 bp, Artificial Sequence
  Description of Artificial Sequence: Synthetic oligonucleotide
gctgcatccagtttgcaaagt

SEQ ID NO: 11192 - protein, 7 aa, Artificial Sequence
  Description of Artificial Sequence: Synthetic peptide
AASSLQS

SEQ ID NO: 11193 - DNA, 21 bp, Artificial Sequence
  Description of Artificial Sequence: Synthetic oligonucleotide
gatacatccagcagggccact

SEQ ID NO: 11194 - protein, 7 aa, Artificial Sequence
  Description of Artificial Sequence: Synthetic peptide
DTSSRAT

SEQ ID NO: 11195 - DNA, 21 bp, Artificial Sequence
  Description of Artificial Sequence: Synthetic oligonucleotide
tgggcatctacccgggaatcc

SEQ ID NO: 11196 - protein, 7 aa, Artificial Sequence
  Description of Artificial Sequence: Synthetic peptide
WASTRES

SEQ ID NO: 11197 - DNA, 21 bp, Artificial Sequence
  Description of Artificial Sequence: Synthetic oligonucleotide
gaaatttccaaccggttctct

SEQ ID NO: 11198 - protein, 7 aa, Artificial Sequence
  Description of Artificial Sequence: Synthetic peptide
EISNRFS

SEQ ID NO: 11199 - DNA, 21 bp, Artificial Sequence
  Description of Artificial Sequence: Synthetic oligonucleotide
tgggcatctacccgggaatcc

SEQ ID NO: 11200 - protein, 7 aa, Artificial Sequence
  Description of Artificial Sequence: Synthetic peptide
WASTRES

SEQ ID NO: 11201 - DNA, 21 bp, Artificial Sequence
  Description of Artificial Sequence: Synthetic oligonucleotide
gctgcaaccagtttgcaaagt

SEQ ID NO: 11202 - protein, 7 aa, Artificial Sequence
  Description of Artificial Sequence: Synthetic peptide
AATSLQS

SEQ ID NO: 11203 - DNA, 21 bp, Artificial Sequence
  Description of Artificial Sequence: Synthetic oligonucleotide
gctgcatccagtttacaaagt

SEQ ID NO: 11204 - protein, 7 aa, Artificial Sequence
  Description of Artificial Sequence: Synthetic peptide
AASSLQS

SEQ ID NO: 11205 - DNA, 21 bp, Artificial Sequence
  Description of Artificial Sequence: Synthetic oligonucleotide
ggtgcatccagcagggccact

SEQ ID NO: 11206 - protein, 7 aa, Artificial Sequence
  Description of Artificial Sequence: Synthetic peptide
GASSRAT

SEQ ID NO: 11207 - DNA, 21 bp, Artificial Sequence
  Description of Artificial Sequence: Synthetic oligonucleotide
gctgcatccagtttgctaggt

SEQ ID NO: 11208 - protein, 7 aa, Artificial Sequence
  Description of Artificial Sequence: Synthetic peptide
AASSLLG

SEQ ID NO: 11209 - DNA, 21 bp, Artificial Sequence
  Description of Artificial Sequence: Synthetic oligonucleotide
tgggcatctacccgggaatcc

SEQ ID NO: 11210 - protein, 7 aa, Artificial Sequence
  Description of Artificial Sequence: Synthetic peptide
WASTRES

SEQ ID NO: 11211 - DNA, 21 bp, Artificial Sequence
  Description of Artificial Sequence: Synthetic oligonucleotide
tgggcttctacccgggaatcc

SEQ ID NO: 11212 - protein, 7 aa, Artificial Sequence
  Description of Artificial Sequence: Synthetic peptide
WASTRES

SEQ ID NO: 11213 - DNA, 21 bp, Artificial Sequence
  Description of Artificial Sequence: Synthetic oligonucleotide
tggacatctacccgggaatcc

SEQ ID NO: 11214 - protein, 7 aa, Artificial Sequence
  Description of Artificial Sequence: Synthetic peptide
WTSTRES

SEQ ID NO: 11215 - DNA, 21 bp, Artificial Sequence
  Description of Artificial Sequence: Synthetic oligonucleotide
tgggcatctacccgggaatcc

SEQ ID NO: 11216 - protein, 7 aa, Artificial Sequence
  Description of Artificial Sequence: Synthetic peptide
WASTRES

SEQ ID NO: 11217 - DNA, 21 bp, Artificial Sequence
  Description of Artificial Sequence: Synthetic oligonucleotide
gaagtttccatccggttctct

SEQ ID NO: 11218 - protein, 7 aa, Artificial Sequence
  Description of Artificial Sequence: Synthetic peptide
EVSIRFS

SEQ ID NO: 11219 - DNA, 21 bp, Artificial Sequence
  Description of Artificial Sequence: Synthetic oligonucleotide
gaagtttccaaccggttctct

SEQ ID NO: 11220 - protein, 7 aa, Artificial Sequence
  Description of Artificial Sequence: Synthetic peptide
EVSNRFS

SEQ ID NO: 11221 - DNA, 21 bp, Artificial Sequence
  Description of Artificial Sequence: Synthetic oligonucleotide
gctgcatccagtttgcaaagt

SEQ ID NO: 11222 - protein, 7 aa, Artificial Sequence
  Description of Artificial Sequence: Synthetic peptide
AASSLQS

SEQ ID NO: 11223 - DNA, 21 bp, Artificial Sequence
  Description of Artificial Sequence: Synthetic oligonucleotide
tgggcatctacccgggaatcc

SEQ ID NO: 11224 - protein, 7 aa, Artificial Sequence
  Description of Artificial Sequence: Synthetic peptide
WASTRES

SEQ ID NO: 11225 - DNA, 21 bp, Artificial Sequence
  Description of Artificial Sequence: Synthetic oligonucleotide
tgggcttctacccgggaatcc

SEQ ID NO: 11226 - protein, 7 aa, Artificial Sequence
  Description of Artificial Sequence: Synthetic peptide
WASTRES

SEQ ID NO: 11227 - DNA, 21 bp, Artificial Sequence
  Description of Artificial Sequence: Synthetic oligonucleotide
gaagtttccaaccggttctct

SEQ ID NO: 11228 - protein, 7 aa, Artificial Sequence
  Description of Artificial Sequence: Synthetic peptide
EVSNRFS

SEQ ID NO: 11229 - DNA, 21 bp, Artificial Sequence
  Description of Artificial Sequence: Synthetic oligonucleotide
gctgcctccagtttgcaaagt

SEQ ID NO: 11230 - protein, 7 aa, Artificial Sequence
  Description of Artificial Sequence: Synthetic peptide
AASSLQS

SEQ ID NO: 11231 - DNA, 21 bp, Artificial Sequence
  Description of Artificial Sequence: Synthetic oligonucleotide
gaaatttccaaccggttctct

SEQ ID NO: 11232 - protein, 7 aa, Artificial Sequence
  Description of Artificial Sequence: Synthetic peptide
EISNRFS

SEQ ID NO: 11233 - DNA, 21 bp, Artificial Sequence
  Description of Artificial Sequence: Synthetic oligonucleotide
gctgcatccagtttgcaaagt

SEQ ID NO: 11234 - protein, 7 aa, Artificial Sequence
  Description of Artificial Sequence: Synthetic peptide
AASSLQS

SEQ ID NO: 11235 - DNA, 21 bp, Artificial Sequence
  Description of Artificial Sequence: Synthetic oligonucleotide
gaaatttccaaccggttctct

SEQ ID NO: 11236 - protein, 7 aa, Artificial Sequence
  Description of Artificial Sequence: Synthetic peptide
EISNRFS

SEQ ID NO: 11237 - DNA, 21 bp, Artificial Sequence
  Description of Artificial Sequence: Synthetic oligonucleotide
gaagtttccaaccggttctct

SEQ ID NO: 11238 - protein, 7 aa, Artificial Sequence
  Description of Artificial Sequence: Synthetic peptide
EVSNRFS

SEQ ID NO: 11239 - DNA, 21 bp, Artificial Sequence
  Description of Artificial Sequence: Synthetic oligonucleotide
gaaatttccaaccggttctct

SEQ ID NO: 11240 - protein, 7 aa, Artificial Sequence
  Description of Artificial Sequence: Synthetic peptide
EISNRFS

SEQ ID NO: 11241 - DNA, 21 bp, Artificial Sequence
  Description of Artificial Sequence: Synthetic oligonucleotide
tgggcatctacccgggaatcc

SEQ ID NO: 11242 - protein, 7 aa, Artificial Sequence
  Description of Artificial Sequence: Synthetic peptide
WASTRES

SEQ ID NO: 11243 - DNA, 21 bp, Artificial Sequence
  Description of Artificial Sequence: Synthetic oligonucleotide
gaaatttccaaccggttctct

SEQ ID NO: 11244 - protein, 7 aa, Artificial Sequence
  Description of Artificial Sequence: Synthetic peptide
EISNRFS

SEQ ID NO: 11245 - DNA, 21 bp, Artificial Sequence
  Description of Artificial Sequence: Synthetic oligonucleotide
gctgcatccagtttgcaaagt

SEQ ID NO: 11246 - protein, 7 aa, Artificial Sequence
  Description of Artificial Sequence: Synthetic peptide
AASSLQS

SEQ ID NO: 11247 - DNA, 21 bp, Artificial Sequence
  Description of Artificial Sequence: Synthetic oligonucleotide
tgggcatctacccggaaatcc

SEQ ID NO: 11248 - protein, 7 aa, Artificial Sequence
  Description of Artificial Sequence: Synthetic peptide
WASTRKS

SEQ ID NO: 11249 - DNA, 21 bp, Artificial Sequence
  Description of Artificial Sequence: Synthetic oligonucleotide
gaaatttccaaccggttctct

SEQ ID NO: 11250 - protein, 7 aa, Artificial Sequence
  Description of Artificial Sequence: Synthetic peptide
EISNRFS

SEQ ID NO: 11251 - DNA, 21 bp, Artificial Sequence
  Description of Artificial Sequence: Synthetic oligonucleotide
gaaatttccaaccggttctct

SEQ ID NO: 11252 - protein, 7 aa, Artificial Sequence
  Description of Artificial Sequence: Synthetic peptide
EISNRFS

SEQ ID NO: 11253 - DNA, 21 bp, Artificial Sequence
  Description of Artificial Sequence: Synthetic oligonucleotide
gaaatttccaaccggttctct

SEQ ID NO: 11254 - protein, 7 aa, Artificial Sequence
  Description of Artificial Sequence: Synthetic peptide
EISNRFS

SEQ ID NO: 11255 - DNA, 21 bp, Artificial Sequence
  Description of Artificial Sequence: Synthetic oligonucleotide
gctgcatccagtttgcaaagt

SEQ ID NO: 11256 - protein, 7 aa, Artificial Sequence
  Description of Artificial Sequence: Synthetic peptide
AASSLQS

SEQ ID NO: 11257 - DNA, 21 bp, Artificial Sequence
  Description of Artificial Sequence: Synthetic oligonucleotide
gctgcatccagtttgcaaagt

SEQ ID NO: 11258 - protein, 7 aa, Artificial Sequence
  Description of Artificial Sequence: Synthetic peptide
AASSLQS

SEQ ID NO: 11259 - DNA, 21 bp, Artificial Sequence
  Description of Artificial Sequence: Synthetic oligonucleotide
gctgcatccagtttgcaaagt

SEQ ID NO: 11260 - protein, 7 aa, Artificial Sequence
  Description of Artificial Sequence: Synthetic peptide
AASSLQS

SEQ ID NO: 11261 - DNA, 21 bp, Artificial Sequence
  Description of Artificial Sequence: Synthetic oligonucleotide
tgggcatctacccgggaatcc

SEQ ID NO: 11262 - protein, 7 aa, Artificial Sequence
  Description of Artificial Sequence: Synthetic peptide
WASTRES

SEQ ID NO: 11263 - DNA, 21 bp, Artificial Sequence
  Description of Artificial Sequence: Synthetic oligonucleotide
tgggcatctacccgggaatcc

SEQ ID NO: 11264 - protein, 7 aa, Artificial Sequence
  Description of Artificial Sequence: Synthetic peptide
WASTRES

SEQ ID NO: 11265 - DNA, 21 bp, Artificial Sequence
  Description of Artificial Sequence: Synthetic oligonucleotide
gaaatttccaaccggttctct

SEQ ID NO: 11266 - protein, 7 aa, Artificial Sequence
  Description of Artificial Sequence: Synthetic peptide
EISNRFS

SEQ ID NO: 11267 - DNA, 21 bp, Artificial Sequence
  Description of Artificial Sequence: Synthetic oligonucleotide
tggggatctacccgggaatcc

SEQ ID NO: 11268 - protein, 7 aa, Artificial Sequence
  Description of Artificial Sequence: Synthetic peptide
WGSTRES

SEQ ID NO: 11269 - DNA, 21 bp, Artificial Sequence
  Description of Artificial Sequence: Synthetic oligonucleotide
tgggcatctacccgggaatcc

SEQ ID NO: 11270 - protein, 7 aa, Artificial Sequence
  Description of Artificial Sequence: Synthetic peptide
WASTRES

SEQ ID NO: 11271 - DNA, 21 bp, Artificial Sequence
  Description of Artificial Sequence: Synthetic oligonucleotide
ttgggttctaatcgggcctcc

SEQ ID NO: 11272 - protein, 7 aa, Artificial Sequence
  Description of Artificial Sequence: Synthetic peptide
LGSNRAS

SEQ ID NO: 11273 - DNA, 21 bp, Artificial Sequence
  Description of Artificial Sequence: Synthetic oligonucleotide
gctgcatccagtttgcaaagt

SEQ ID NO: 11274 - protein, 7 aa, Artificial Sequence
  Description of Artificial Sequence: Synthetic peptide
AASSLQS

SEQ ID NO: 11275 - DNA, 21 bp, Artificial Sequence
  Description of Artificial Sequence: Synthetic oligonucleotide
caagatagcaagcggccctca

SEQ ID NO: 11276 - protein, 7 aa, Artificial Sequence
  Description of Artificial Sequence: Synthetic peptide
QDSKRPS

SEQ ID NO: 11277 - DNA, 21 bp, Artificial Sequence
  Description of Artificial Sequence: Synthetic oligonucleotide
caagatagcaagcggccctca

SEQ ID NO: 11278 - protein, 7 aa, Artificial Sequence
  Description of Artificial Sequence: Synthetic peptide
QDSKRPS

SEQ ID NO: 11279 - DNA, 21 bp, Artificial Sequence
  Description of Artificial Sequence: Synthetic oligonucleotide
caagatagcaagcggccctca

SEQ ID NO: 11280 - protein, 7 aa, Artificial Sequence
  Description of Artificial Sequence: Synthetic peptide
QDSKRPS

SEQ ID NO: 11281 - DNA, 21 bp, Artificial Sequence
  Description of Artificial Sequence: Synthetic oligonucleotide
agtaataatcagcggccctca

SEQ ID NO: 11282 - protein, 7 aa, Artificial Sequence
  Description of Artificial Sequence: Synthetic peptide
SNNQRPS

SEQ ID NO: 11283 - DNA, 21 bp, Artificial Sequence
  Description of Artificial Sequence: Synthetic oligonucleotide
caagataggaagcggccctca

SEQ ID NO: 11284 - protein, 7 aa, Artificial Sequence
  Description of Artificial Sequence: Synthetic peptide
QDRKRPS

SEQ ID NO: 11285 - DNA, 21 bp, Artificial Sequence
  Description of Artificial Sequence: Synthetic oligonucleotide
caagatagcaagcgcccctca

SEQ ID NO: 11286 - protein, 7 aa, Artificial Sequence
  Description of Artificial Sequence: Synthetic peptide
QDSKRPS

SEQ ID NO: 11287 - DNA, 21 bp, Artificial Sequence
  Description of Artificial Sequence: Synthetic oligonucleotide
caagataggaagcggccctca

SEQ ID NO: 11288 - protein, 7 aa, Artificial Sequence
  Description of Artificial Sequence: Synthetic peptide
QDRKRPS

SEQ ID NO: 11289 - DNA, 21 bp, Artificial Sequence
  Description of Artificial Sequence: Synthetic oligonucleotide
caagataggaagcggccctca

SEQ ID NO: 11290 - protein, 7 aa, Artificial Sequence
  Description of Artificial Sequence: Synthetic peptide
QDRKRPS

SEQ ID NO: 11291 - DNA, 21 bp, Artificial Sequence
  Description of Artificial Sequence: Synthetic oligonucleotide
caagatagcaagcggccctca

SEQ ID NO: 11292 - protein, 7 aa, Artificial Sequence
  Description of Artificial Sequence: Synthetic peptide
QDSKRPS

SEQ ID NO: 11293 - DNA, 21 bp, Artificial Sequence
  Description of Artificial Sequence: Synthetic oligonucleotide
caagatagcaagcggccctca

SEQ ID NO: 11294 - protein, 7 aa, Artificial Sequence
  Description of Artificial Sequence: Synthetic peptide
QDSKRPS

SEQ ID NO: 11295 - DNA, 21 bp, Artificial Sequence
  Description of Artificial Sequence: Synthetic oligonucleotide
caagataggaagcggccctca

SEQ ID NO: 11296 - protein, 7 aa, Artificial Sequence
  Description of Artificial Sequence: Synthetic peptide
QDRKRPS

SEQ ID NO: 11297 - DNA, 21 bp, Artificial Sequence
  Description of Artificial Sequence: Synthetic oligonucleotide
caagatagcaagcggccctca

SEQ ID NO: 11298 - protein, 7 aa, Artificial Sequence
  Description of Artificial Sequence: Synthetic peptide
QDSKRPS

SEQ ID NO: 11299 - DNA, 21 bp, Artificial Sequence
  Description of Artificial Sequence: Synthetic oligonucleotide
caagatagcaagcggccctca

SEQ ID NO: 11300 - protein, 7 aa, Artificial Sequence
  Description of Artificial Sequence: Synthetic peptide
QDSKRPS

SEQ ID NO: 11301 - DNA, 21 bp, Artificial Sequence
  Description of Artificial Sequence: Synthetic oligonucleotide
agtaataatcaccggccctca

SEQ ID NO: 11302 - protein, 7 aa, Artificial Sequence
  Description of Artificial Sequence: Synthetic peptide
SNNHRPS

SEQ ID NO: 11303 - DNA, 21 bp, Artificial Sequence
  Description of Artificial Sequence: Synthetic oligonucleotide
agtaatgatcagcggccctca

SEQ ID NO: 11304 - protein, 7 aa, Artificial Sequence
  Description of Artificial Sequence: Synthetic peptide
SNDQRPS

SEQ ID NO: 11305 - DNA, 21 bp, Artificial Sequence
  Description of Artificial Sequence: Synthetic oligonucleotide
agtaataatcagcggccctca

SEQ ID NO: 11306 - protein, 7 aa, Artificial Sequence
  Description of Artificial Sequence: Synthetic peptide
SNNQRPS

SEQ ID NO: 11307 - DNA, 21 bp, Artificial Sequence
  Description of Artificial Sequence: Synthetic oligonucleotide
caagatagcaagcggccctca

SEQ ID NO: 11308 - protein, 7 aa, Artificial Sequence
  Description of Artificial Sequence: Synthetic peptide
QDSKRPS

SEQ ID NO: 11309 - DNA, 21 bp, Artificial Sequence
  Description of Artificial Sequence: Synthetic oligonucleotide
caagataggaagcggccctca

SEQ ID NO: 11310 - protein, 7 aa, Artificial Sequence
  Description of Artificial Sequence: Synthetic peptide
QDRKRPS

SEQ ID NO: 11311 - DNA, 21 bp, Artificial Sequence
  Description of Artificial Sequence: Synthetic oligonucleotide
caagatagcaagcggccctca

SEQ ID NO: 11312 - protein, 7 aa, Artificial Sequence
  Description of Artificial Sequence: Synthetic peptide
QDSKRPS

SEQ ID NO: 11313 - DNA, 21 bp, Artificial Sequence
  Description of Artificial Sequence: Synthetic oligonucleotide
caagatagcaagcggccctca

SEQ ID NO: 11314 - protein, 7 aa, Artificial Sequence
  Description of Artificial Sequence: Synthetic peptide
QDSKRPS

SEQ ID NO: 11315 - DNA, 21 bp, Artificial Sequence
  Description of Artificial Sequence: Synthetic oligonucleotide
agtaataatcagcggccctca

SEQ ID NO: 11316 - protein, 7 aa, Artificial Sequence
  Description of Artificial Sequence: Synthetic peptide
SNNQRPS

SEQ ID NO: 11317 - DNA, 21 bp, Artificial Sequence
  Description of Artificial Sequence: Synthetic oligonucleotide
caaaataaccagcggccctca

SEQ ID NO: 11318 - protein, 7 aa, Artificial Sequence
  Description of Artificial Sequence: Synthetic peptide
QNNQRPS

SEQ ID NO: 11319 - DNA, 21 bp, Artificial Sequence
  Description of Artificial Sequence: Synthetic oligonucleotide
caagatagcaagcggccctca

SEQ ID NO: 11320 - protein, 7 aa, Artificial Sequence
  Description of Artificial Sequence: Synthetic peptide
QDSKRPS

SEQ ID NO: 11321 - DNA, 33 bp, Artificial Sequence
  Description of Artificial Sequence: Synthetic oligonucleotide
tacacatcagactcagataaacaccagggctct

SEQ ID NO: 11322 - protein, 11 aa, Artificial Sequence
  Description of Artificial Sequence: Synthetic peptide
YTSDSDKHQGS

SEQ ID NO: 11323 - DNA, 21 bp, Artificial Sequence
  Description of Artificial Sequence: Synthetic oligonucleotide
caagataacaagcggccctca

SEQ ID NO: 11324 - protein, 7 aa, Artificial Sequence
  Description of Artificial Sequence: Synthetic peptide
QDNKRPS

SEQ ID NO: 11325 - DNA, 21 bp, Artificial Sequence
  Description of Artificial Sequence: Synthetic oligonucleotide
caagatagcaggcggccctca

SEQ ID NO: 11326 - protein, 7 aa, Artificial Sequence
  Description of Artificial Sequence: Synthetic peptide
QDSRRPS

SEQ ID NO: 11327 - DNA, 21 bp, Artificial Sequence
  Description of Artificial Sequence: Synthetic oligonucleotide
caagataacaagcggccctca

SEQ ID NO: 11328 - protein, 7 aa, Artificial Sequence
  Description of Artificial Sequence: Synthetic peptide
QDNKRPS

SEQ ID NO: 11329 - DNA, 21 bp, Artificial Sequence
  Description of Artificial Sequence: Synthetic oligonucleotide
caagatagcaagcggccctca

SEQ ID NO: 11330 - protein, 7 aa, Artificial Sequence
  Description of Artificial Sequence: Synthetic peptide
QDSKRPS

SEQ ID NO: 11331 - DNA, 21 bp, Artificial Sequence
  Description of Artificial Sequence: Synthetic oligonucleotide
agtaatagtcagcggccctca

SEQ ID NO: 11332 - protein, 7 aa, Artificial Sequence
  Description of Artificial Sequence: Synthetic peptide
SNSQRPS

SEQ ID NO: 11333 - DNA, 21 bp, Artificial Sequence
  Description of Artificial Sequence: Synthetic oligonucleotide
caagatagcaagcggccctca

SEQ ID NO: 11334 - protein, 7 aa, Artificial Sequence
  Description of Artificial Sequence: Synthetic peptide
QDSKRPS

SEQ ID NO: 11335 - DNA, 21 bp, Artificial Sequence
  Description of Artificial Sequence: Synthetic oligonucleotide
caagatcgcaagcggccctca

SEQ ID NO: 11336 - protein, 7 aa, Artificial Sequence
  Description of Artificial Sequence: Synthetic peptide
QDRKRPS

SEQ ID NO: 11337 - DNA, 21 bp, Artificial Sequence
  Description of Artificial Sequence: Synthetic oligonucleotide
caagatagcaagcggccctca

SEQ ID NO: 11338 - protein, 7 aa, Artificial Sequence
  Description of Artificial Sequence: Synthetic peptide
QDSKRPS

SEQ ID NO: 11339 - DNA, 21 bp, Artificial Sequence
  Description of Artificial Sequence: Synthetic oligonucleotide
caagataccaagcggccctca

SEQ ID NO: 11340 - protein, 7 aa, Artificial Sequence
  Description of Artificial Sequence: Synthetic peptide
QDTKRPS

SEQ ID NO: 11341 - DNA, 21 bp, Artificial Sequence
  Description of Artificial Sequence: Synthetic oligonucleotide
caagatagcaagcggccctca

SEQ ID NO: 11342 - protein, 7 aa, Artificial Sequence
  Description of Artificial Sequence: Synthetic peptide
QDSKRPS

SEQ ID NO: 11343 - DNA, 21 bp, Artificial Sequence
  Description of Artificial Sequence: Synthetic oligonucleotide
caagatagcaagcggccctca

SEQ ID NO: 11344 - protein, 7 aa, Artificial Sequence
  Description of Artificial Sequence: Synthetic peptide
QDSKRPS

SEQ ID NO: 11345 - DNA, 21 bp, Artificial Sequence
  Description of Artificial Sequence: Synthetic oligonucleotide
caagattccaagcggccctca

SEQ ID NO: 11346 - protein, 7 aa, Artificial Sequence
  Description of Artificial Sequence: Synthetic peptide
QDSKRPS

SEQ ID NO: 11347 - DNA, 21 bp, Artificial Sequence
  Description of Artificial Sequence: Synthetic oligonucleotide
caagatagcaagcggccctca

SEQ ID NO: 11348 - protein, 7 aa, Artificial Sequence
  Description of Artificial Sequence: Synthetic peptide
QDSKRPS

SEQ ID NO: 11349 - DNA, 21 bp, Artificial Sequence
  Description of Artificial Sequence: Synthetic oligonucleotide
caagatagcaagcggccctca

SEQ ID NO: 11350 - protein, 7 aa, Artificial Sequence
  Description of Artificial Sequence: Synthetic peptide
QDSKRPS

SEQ ID NO: 11351 - DNA, 21 bp, Artificial Sequence
  Description of Artificial Sequence: Synthetic oligonucleotide
caagataccaagcggccctca

SEQ ID NO: 11352 - protein, 7 aa, Artificial Sequence
  Description of Artificial Sequence: Synthetic peptide
QDTKRPS

SEQ ID NO: 11353 - DNA, 21 bp, Artificial Sequence
  Description of Artificial Sequence: Synthetic oligonucleotide
caagataccaagcggccctca

SEQ ID NO: 11354 - protein, 7 aa, Artificial Sequence
  Description of Artificial Sequence: Synthetic peptide
QDTKRPS

SEQ ID NO: 11355 - DNA, 21 bp, Artificial Sequence
  Description of Artificial Sequence: Synthetic oligonucleotide
caagataacaagcggccctca

SEQ ID NO: 11356 - protein, 7 aa, Artificial Sequence
  Description of Artificial Sequence: Synthetic peptide
QDNKRPS

SEQ ID NO: 11357 - DNA, 21 bp, Artificial Sequence
  Description of Artificial Sequence: Synthetic oligonucleotide
caagataggaagcggccctca

SEQ ID NO: 11358 - protein, 7 aa, Artificial Sequence
  Description of Artificial Sequence: Synthetic peptide
QDRKRPS

SEQ ID NO: 11359 - DNA, 21 bp, Artificial Sequence
  Description of Artificial Sequence: Synthetic oligonucleotide
caagataggaagcggccctca

SEQ ID NO: 11360 - protein, 7 aa, Artificial Sequence
  Description of Artificial Sequence: Synthetic peptide
QDRKRPS

SEQ ID NO: 11361 - DNA, 21 bp, Artificial Sequence
  Description of Artificial Sequence: Synthetic oligonucleotide
caagatagcaagcggccctca

SEQ ID NO: 11362 - protein, 7 aa, Artificial Sequence
  Description of Artificial Sequence: Synthetic peptide
QDSKRPS

SEQ ID NO: 11363 - DNA, 21 bp, Artificial Sequence
  Description of Artificial Sequence: Synthetic oligonucleotide
aaagatagtaagcggccctca

SEQ ID NO: 11364 - protein, 7 aa, Artificial Sequence
  Description of Artificial Sequence: Synthetic peptide
KDSKRPS

SEQ ID NO: 11365 - DNA, 21 bp, Artificial Sequence
  Description of Artificial Sequence: Synthetic oligonucleotide
caagatagcaagcggccctca

SEQ ID NO: 11366 - protein, 7 aa, Artificial Sequence
  Description of Artificial Sequence: Synthetic peptide
QDSKRPS

SEQ ID NO: 11367 - DNA, 21 bp, Artificial Sequence
  Description of Artificial Sequence: Synthetic oligonucleotide
caagataagaagcggccctca

SEQ ID NO: 11368 - protein, 7 aa, Artificial Sequence
  Description of Artificial Sequence: Synthetic peptide
QDKKRPS

SEQ ID NO: 11369 - DNA, 21 bp, Artificial Sequence
  Description of Artificial Sequence: Synthetic oligonucleotide
agtaatgatcaccggccctca

SEQ ID NO: 11370 - protein, 7 aa, Artificial Sequence
  Description of Artificial Sequence: Synthetic peptide
SNDHRPS

SEQ ID NO: 11371 - DNA, 21 bp, Artificial Sequence
  Description of Artificial Sequence: Synthetic oligonucleotide
ggtaacagcaatcggccctca

SEQ ID NO: 11372 - protein, 7 aa, Artificial Sequence
  Description of Artificial Sequence: Synthetic peptide
GNSNRPS

SEQ ID NO: 11373 - DNA, 21 bp, Artificial Sequence
  Description of Artificial Sequence: Synthetic oligonucleotide
caagatagtaagcggccctca

SEQ ID NO: 11374 - protein, 7 aa, Artificial Sequence
  Description of Artificial Sequence: Synthetic peptide
QDSKRPS

SEQ ID NO: 11375 - DNA, 21 bp, Artificial Sequence
  Description of Artificial Sequence: Synthetic oligonucleotide
caagatagaaagcggccctca

SEQ ID NO: 11376 - protein, 7 aa, Artificial Sequence
  Description of Artificial Sequence: Synthetic peptide
QDRKRPS

SEQ ID NO: 11377 - DNA, 21 bp, Artificial Sequence
  Description of Artificial Sequence: Synthetic oligonucleotide
caagatagcaagcggccctca

SEQ ID NO: 11378 - protein, 7 aa, Artificial Sequence
  Description of Artificial Sequence: Synthetic peptide
QDSKRPS

SEQ ID NO: 11379 - DNA, 21 bp, Artificial Sequence
  Description of Artificial Sequence: Synthetic oligonucleotide
caagataggaagcggccctca

SEQ ID NO: 11380 - protein, 7 aa, Artificial Sequence
  Description of Artificial Sequence: Synthetic peptide
QDRKRPS

SEQ ID NO: 11381 - DNA, 21 bp, Artificial Sequence
  Description of Artificial Sequence: Synthetic oligonucleotide
agtagtaatcagcggccctca

SEQ ID NO: 11382 - protein, 7 aa, Artificial Sequence
  Description of Artificial Sequence: Synthetic peptide
SSNQRPS

SEQ ID NO: 11383 - DNA, 21 bp, Artificial Sequence
  Description of Artificial Sequence: Synthetic oligonucleotide
caagatagtaagcggccctca

SEQ ID NO: 11384 - protein, 7 aa, Artificial Sequence
  Description of Artificial Sequence: Synthetic peptide
QDSKRPS

SEQ ID NO: 11385 - DNA, 21 bp, Artificial Sequence
  Description of Artificial Sequence: Synthetic oligonucleotide
caagatcgcaagcggccctca

SEQ ID NO: 11386 - protein, 7 aa, Artificial Sequence
  Description of Artificial Sequence: Synthetic peptide
QDRKRPS

SEQ ID NO: 11387 - DNA, 21 bp, Artificial Sequence
  Description of Artificial Sequence: Synthetic oligonucleotide
caagataggaagcggccctca

SEQ ID NO: 11388 - protein, 7 aa, Artificial Sequence
  Description of Artificial Sequence: Synthetic peptide
QDRKRPS

SEQ ID NO: 11389 - DNA, 21 bp, Artificial Sequence
  Description of Artificial Sequence: Synthetic oligonucleotide
caagatagcaagcggccctca

SEQ ID NO: 11390 - protein, 7 aa, Artificial Sequence
  Description of Artificial Sequence: Synthetic peptide
QDSKRPS

SEQ ID NO: 11391 - DNA, 21 bp, Artificial Sequence
  Description of Artificial Sequence: Synthetic oligonucleotide
caagataacaagcggccctca

SEQ ID NO: 11392 - protein, 7 aa, Artificial Sequence
  Description of Artificial Sequence: Synthetic peptide
QDNKRPS

SEQ ID NO: 11393 - DNA, 21 bp, Artificial Sequence
  Description of Artificial Sequence: Synthetic oligonucleotide
caagatagcaagcggccctca

SEQ ID NO: 11394 - protein, 7 aa, Artificial Sequence
  Description of Artificial Sequence: Synthetic peptide
QDSKRPS

SEQ ID NO: 11395 - DNA, 21 bp, Artificial Sequence
  Description of Artificial Sequence: Synthetic oligonucleotide
caagataccaagcggccctca

SEQ ID NO: 11396 - protein, 7 aa, Artificial Sequence
  Description of Artificial Sequence: Synthetic peptide
QDTKRPS

SEQ ID NO: 11397 - DNA, 21 bp, Artificial Sequence
  Description of Artificial Sequence: Synthetic oligonucleotide
caagatagcaagcggccctca

SEQ ID NO: 11398 - protein, 7 aa, Artificial Sequence
  Description of Artificial Sequence: Synthetic peptide
QDSKRPS

SEQ ID NO: 11399 - DNA, 21 bp, Artificial Sequence
  Description of Artificial Sequence: Synthetic oligonucleotide
caagatagcaagcggccctca

SEQ ID NO: 11400 - protein, 7 aa, Artificial Sequence
  Description of Artificial Sequence: Synthetic peptide
QDSKRPS

SEQ ID NO: 11401 - DNA, 21 bp, Artificial Sequence
  Description of Artificial Sequence: Synthetic oligonucleotide
aaagatatcaagcggccctca

SEQ ID NO: 11402 - protein, 7 aa, Artificial Sequence
  Description of Artificial Sequence: Synthetic peptide
KDIKRPS

SEQ ID NO: 11403 - DNA, 21 bp, Artificial Sequence
  Description of Artificial Sequence: Synthetic oligonucleotide
caggattacaagcggccctca

SEQ ID NO: 11404 - protein, 7 aa, Artificial Sequence
  Description of Artificial Sequence: Synthetic peptide
QDYKRPS

SEQ ID NO: 11405 - DNA, 21 bp, Artificial Sequence
  Description of Artificial Sequence: Synthetic oligonucleotide
caagataggaagcggccctca

SEQ ID NO: 11406 - protein, 7 aa, Artificial Sequence
  Description of Artificial Sequence: Synthetic peptide
QDRKRPS

SEQ ID NO: 11407 - DNA, 21 bp, Artificial Sequence
  Description of Artificial Sequence: Synthetic oligonucleotide
caagatagtaagcggccctca

SEQ ID NO: 11408 - protein, 7 aa, Artificial Sequence
  Description of Artificial Sequence: Synthetic peptide
QDSKRPS

SEQ ID NO: 11409 - DNA, 21 bp, Artificial Sequence
  Description of Artificial Sequence: Synthetic oligonucleotide
gaggataaaaaaagaccctct

SEQ ID NO: 11410 - protein, 7 aa, Artificial Sequence
  Description of Artificial Sequence: Synthetic peptide
EDKKRPS

SEQ ID NO: 11411 - DNA, 21 bp, Artificial Sequence
  Description of Artificial Sequence: Synthetic oligonucleotide
caagatagtaagcggccctca

SEQ ID NO: 11412 - protein, 7 aa, Artificial Sequence
  Description of Artificial Sequence: Synthetic peptide
QDSKRPS

SEQ ID NO: 11413 - DNA, 21 bp, Artificial Sequence
  Description of Artificial Sequence: Synthetic oligonucleotide
caagattacaagcggccctca

SEQ ID NO: 11414 - protein, 7 aa, Artificial Sequence
  Description of Artificial Sequence: Synthetic peptide
QDYKRPS

SEQ ID NO: 11415 - DNA, 21 bp, Artificial Sequence
  Description of Artificial Sequence: Synthetic oligonucleotide
caagataggaagcggccctca

SEQ ID NO: 11416 - protein, 7 aa, Artificial Sequence
  Description of Artificial Sequence: Synthetic peptide
QDRKRPS

SEQ ID NO: 11417 - DNA, 21 bp, Artificial Sequence
  Description of Artificial Sequence: Synthetic oligonucleotide
gctaaaaacaaccggccctca

SEQ ID NO: 11418 - protein, 7 aa, Artificial Sequence
  Description of Artificial Sequence: Synthetic peptide
AKNNRPS

SEQ ID NO: 11419 - DNA, 21 bp, Artificial Sequence
  Description of Artificial Sequence: Synthetic oligonucleotide
caagatcgcaagcggccctca

SEQ ID NO: 11420 - protein, 7 aa, Artificial Sequence
  Description of Artificial Sequence: Synthetic peptide
QDRKRPS

SEQ ID NO: 11421 - DNA, 21 bp, Artificial Sequence
  Description of Artificial Sequence: Synthetic oligonucleotide
actaaaaacagccggccctca

SEQ ID NO: 11422 - protein, 7 aa, Artificial Sequence
  Description of Artificial Sequence: Synthetic peptide
TKNSRPS

SEQ ID NO: 11423 - DNA, 21 bp, Artificial Sequence
  Description of Artificial Sequence: Synthetic oligonucleotide
actaaaaacagccggccctca

SEQ ID NO: 11424 - protein, 7 aa, Artificial Sequence
  Description of Artificial Sequence: Synthetic peptide
TKNSRPS

SEQ ID NO: 11425 - DNA, 21 bp, Artificial Sequence
  Description of Artificial Sequence: Synthetic oligonucleotide
caagatagcaggcggccctca

SEQ ID NO: 11426 - protein, 7 aa, Artificial Sequence
  Description of Artificial Sequence: Synthetic peptide
QDSRRPS

SEQ ID NO: 11427 - DNA, 21 bp, Artificial Sequence
  Description of Artificial Sequence: Synthetic oligonucleotide
gaggtcagtaagcggccctca

SEQ ID NO: 11428 - protein, 7 aa, Artificial Sequence
  Description of Artificial Sequence: Synthetic peptide
EVSKRPS

SEQ ID NO: 11429 - DNA, 21 bp, Artificial Sequence
  Description of Artificial Sequence: Synthetic oligonucleotide
caagattacaagcggccctca

SEQ ID NO: 11430 - protein, 7 aa, Artificial Sequence
  Description of Artificial Sequence: Synthetic peptide
QDYKRPS

SEQ ID NO: 11431 - DNA, 21 bp, Artificial Sequence
  Description of Artificial Sequence: Synthetic oligonucleotide
gaagtcagtaagcggccctca

SEQ ID NO: 11432 - protein, 7 aa, Artificial Sequence
  Description of Artificial Sequence: Synthetic peptide
EVSKRPS

SEQ ID NO: 11433 - DNA, 21 bp, Artificial Sequence
  Description of Artificial Sequence: Synthetic oligonucleotide
ggtaaaaacaaccggccctca

SEQ ID NO: 11434 - protein, 7 aa, Artificial Sequence
  Description of Artificial Sequence: Synthetic peptide
GKNNRPS

SEQ ID NO: 11435 - DNA, 21 bp, Artificial Sequence
  Description of Artificial Sequence: Synthetic oligonucleotide
caggatagtaagcggccctca

SEQ ID NO: 11436 - protein, 7 aa, Artificial Sequence
  Description of Artificial Sequence: Synthetic peptide
QDSKRPS

SEQ ID NO: 11437 - DNA, 21 bp, Artificial Sequence
  Description of Artificial Sequence: Synthetic oligonucleotide
ggtcacagcaaccggccctca

SEQ ID NO: 11438 - protein, 7 aa, Artificial Sequence
  Description of Artificial Sequence: Synthetic peptide
GHSNRPS

SEQ ID NO: 11439 - DNA, 21 bp, Artificial Sequence
  Description of Artificial Sequence: Synthetic oligonucleotide
gaagataggaagcggccctca

SEQ ID NO: 11440 - protein, 7 aa, Artificial Sequence
  Description of Artificial Sequence: Synthetic peptide
EDRKRPS

SEQ ID NO: 11441 - DNA, 21 bp, Artificial Sequence
  Description of Artificial Sequence: Synthetic oligonucleotide
caagatagaaagcggccctca

SEQ ID NO: 11442 - protein, 7 aa, Artificial Sequence
  Description of Artificial Sequence: Synthetic peptide
QDRKRPS

SEQ ID NO: 11443 - DNA, 21 bp, Artificial Sequence
  Description of Artificial Sequence: Synthetic oligonucleotide
caagatagcaagcggccctca

SEQ ID NO: 11444 - protein, 7 aa, Artificial Sequence
  Description of Artificial Sequence: Synthetic peptide
QDSKRPS

SEQ ID NO: 11445 - DNA, 21 bp, Artificial Sequence
  Description of Artificial Sequence: Synthetic oligonucleotide
gaagataggaagcggccctca

SEQ ID NO: 11446 - protein, 7 aa, Artificial Sequence
  Description of Artificial Sequence: Synthetic peptide
EDRKRPS

SEQ ID NO: 11447 - DNA, 21 bp, Artificial Sequence
  Description of Artificial Sequence: Synthetic oligonucleotide
agtaatgatcagcggccctca

SEQ ID NO: 11448 - protein, 7 aa, Artificial Sequence
  Description of Artificial Sequence: Synthetic peptide
SNDQRPS

SEQ ID NO: 11449 - DNA, 21 bp, Artificial Sequence
  Description of Artificial Sequence: Synthetic oligonucleotide
ggtaacagcaatcggccctca

SEQ ID NO: 11450 - protein, 7 aa, Artificial Sequence
  Description of Artificial Sequence: Synthetic peptide
GNSNRPS

SEQ ID NO: 11451 - DNA, 21 bp, Artificial Sequence
  Description of Artificial Sequence: Synthetic oligonucleotide
agtaatgatcagcggccctca

SEQ ID NO: 11452 - protein, 7 aa, Artificial Sequence
  Description of Artificial Sequence: Synthetic peptide
SNDQRPS

SEQ ID NO: 11453 - DNA, 21 bp, Artificial Sequence
  Description of Artificial Sequence: Synthetic oligonucleotide
caagatagaaagcggccctca

SEQ ID NO: 11454 - protein, 7 aa, Artificial Sequence
  Description of Artificial Sequence: Synthetic peptide
QDRKRPS

SEQ ID NO: 11455 - DNA, 21 bp, Artificial Sequence
  Description of Artificial Sequence: Synthetic oligonucleotide
gaggtcagtaatcggccctca

SEQ ID NO: 11456 - protein, 7 aa, Artificial Sequence
  Description of Artificial Sequence: Synthetic peptide
EVSNRPS

SEQ ID NO: 11457 - DNA, 21 bp, Artificial Sequence
  Description of Artificial Sequence: Synthetic oligonucleotide
caagatacaatgcggccctca

SEQ ID NO: 11458 - protein, 7 aa, Artificial Sequence
  Description of Artificial Sequence: Synthetic peptide
QDTMRPS

SEQ ID NO: 11459 - DNA, 21 bp, Artificial Sequence
  Description of Artificial Sequence: Synthetic oligonucleotide
gttaatgatcagcggccctca

SEQ ID NO: 11460 - protein, 7 aa, Artificial Sequence
  Description of Artificial Sequence: Synthetic peptide
VNDQRPS

SEQ ID NO: 11461 - DNA, 21 bp, Artificial Sequence
  Description of Artificial Sequence: Synthetic oligonucleotide
agtaatgatcagcggccctca

SEQ ID NO: 11462 - protein, 7 aa, Artificial Sequence
  Description of Artificial Sequence: Synthetic peptide
SNDQRPS

SEQ ID NO: 11463 - DNA, 21 bp, Artificial Sequence
  Description of Artificial Sequence: Synthetic oligonucleotide
agtaataatcagcggccctca

SEQ ID NO: 11464 - protein, 7 aa, Artificial Sequence
  Description of Artificial Sequence: Synthetic peptide
SNNQRPS

SEQ ID NO: 11465 - DNA, 21 bp, Artificial Sequence
  Description of Artificial Sequence: Synthetic oligonucleotide
caagataggaagcggccctca

SEQ ID NO: 11466 - protein, 7 aa, Artificial Sequence
  Description of Artificial Sequence: Synthetic peptide
QDRKRPS

SEQ ID NO: 11467 - DNA, 21 bp, Artificial Sequence
  Description of Artificial Sequence: Synthetic oligonucleotide
caagatagcaagcggccctca

SEQ ID NO: 11468 - protein, 7 aa, Artificial Sequence
  Description of Artificial Sequence: Synthetic peptide
QDSKRPS

SEQ ID NO: 11469 - DNA, 21 bp, Artificial Sequence
  Description of Artificial Sequence: Synthetic oligonucleotide
caagataggaagcggccctca

SEQ ID NO: 11470 - protein, 7 aa, Artificial Sequence
  Description of Artificial Sequence: Synthetic peptide
QDRKRPS

SEQ ID NO: 11471 - DNA, 21 bp, Artificial Sequence
  Description of Artificial Sequence: Synthetic oligonucleotide
caagataggaagcggccctca

SEQ ID NO: 11472 - protein, 7 aa, Artificial Sequence
  Description of Artificial Sequence: Synthetic peptide
QDRKRPS

SEQ ID NO: 11473 - DNA, 21 bp, Artificial Sequence
  Description of Artificial Sequence: Synthetic oligonucleotide
gacaataataagcgaccctca

SEQ ID NO: 11474 - protein, 7 aa, Artificial Sequence
  Description of Artificial Sequence: Synthetic peptide
DNNKRPS

SEQ ID NO: 11475 - DNA, 21 bp, Artificial Sequence
  Description of Artificial Sequence: Synthetic oligonucleotide
caagataacaagcggccctca

SEQ ID NO: 11476 - protein, 7 aa, Artificial Sequence
  Description of Artificial Sequence: Synthetic peptide
QDNKRPS

SEQ ID NO: 11477 - DNA, 21 bp, Artificial Sequence
  Description of Artificial Sequence: Synthetic oligonucleotide
caagataggaagcggccctca

SEQ ID NO: 11478 - protein, 7 aa, Artificial Sequence
  Description of Artificial Sequence: Synthetic peptide
QDRKRPS

SEQ ID NO: 11479 - DNA, 21 bp, Artificial Sequence
  Description of Artificial Sequence: Synthetic oligonucleotide
caagatagcaagcggccctca

SEQ ID NO: 11480 - protein, 7 aa, Artificial Sequence
  Description of Artificial Sequence: Synthetic peptide
QDSKRPS

SEQ ID NO: 11481 - DNA, 21 bp, Artificial Sequence
  Description of Artificial Sequence: Synthetic oligonucleotide
caagataacaagcggccctca

SEQ ID NO: 11482 - protein, 7 aa, Artificial Sequence
  Description of Artificial Sequence: Synthetic peptide
QDNKRPS

SEQ ID NO: 11483 - DNA, 21 bp, Artificial Sequence
  Description of Artificial Sequence: Synthetic oligonucleotide
caagataacaagcggccctca

SEQ ID NO: 11484 - protein, 7 aa, Artificial Sequence
  Description of Artificial Sequence: Synthetic peptide
QDNKRPS

SEQ ID NO: 11485 - DNA, 21 bp, Artificial Sequence
  Description of Artificial Sequence: Synthetic oligonucleotide
caagatagcaagcggccctca

SEQ ID NO: 11486 - protein, 7 aa, Artificial Sequence
  Description of Artificial Sequence: Synthetic peptide
QDSKRPS

SEQ ID NO: 11487 - DNA, 21 bp, Artificial Sequence
  Description of Artificial Sequence: Synthetic oligonucleotide
caagataggaagcggccctca

SEQ ID NO: 11488 - protein, 7 aa, Artificial Sequence
  Description of Artificial Sequence: Synthetic peptide
QDRKRPS

SEQ ID NO: 11489 - DNA, 21 bp, Artificial Sequence
  Description of Artificial Sequence: Synthetic oligonucleotide
caagataacaagcggccctca

SEQ ID NO: 11490 - protein, 7 aa, Artificial Sequence
  Description of Artificial Sequence: Synthetic peptide
QDNKRPS

SEQ ID NO: 11491 - DNA, 21 bp, Artificial Sequence
  Description of Artificial Sequence: Synthetic oligonucleotide
caagataggaagcggccctca

SEQ ID NO: 11492 - protein, 7 aa, Artificial Sequence
  Description of Artificial Sequence: Synthetic peptide
QDRKRPS

SEQ ID NO: 11493 - DNA, 21 bp, Artificial Sequence
  Description of Artificial Sequence: Synthetic oligonucleotide
caagatagcaagcggccctca

SEQ ID NO: 11494 - protein, 7 aa, Artificial Sequence
  Description of Artificial Sequence: Synthetic peptide
QDSKRPS

SEQ ID NO: 11495 - DNA, 21 bp, Artificial Sequence
  Description of Artificial Sequence: Synthetic oligonucleotide
caagataggaagcggccctca

SEQ ID NO: 11496 - protein, 7 aa, Artificial Sequence
  Description of Artificial Sequence: Synthetic peptide
QDRKRPS

SEQ ID NO: 11497 - DNA, 21 bp, Artificial Sequence
  Description of Artificial Sequence: Synthetic oligonucleotide
caggataggaagcggccctca

SEQ ID NO: 11498 - protein, 7 aa, Artificial Sequence
  Description of Artificial Sequence: Synthetic peptide
QDRKRPS

SEQ ID NO: 11499 - DNA, 21 bp, Artificial Sequence
  Description of Artificial Sequence: Synthetic oligonucleotide
caagataggaagcggccctca

SEQ ID NO: 11500 - protein, 7 aa, Artificial Sequence
  Description of Artificial Sequence: Synthetic peptide
QDRKRPS

SEQ ID NO: 11501 - DNA, 21 bp, Artificial Sequence
  Description of Artificial Sequence: Synthetic oligonucleotide
caagataggaagcggccctca

SEQ ID NO: 11502 - protein, 7 aa, Artificial Sequence
  Description of Artificial Sequence: Synthetic peptide
QDRKRPS

SEQ ID NO: 11503 - DNA, 21 bp, Artificial Sequence
  Description of Artificial Sequence: Synthetic oligonucleotide
caagataggaagcggccctca

SEQ ID NO: 11504 - protein, 7 aa, Artificial Sequence
  Description of Artificial Sequence: Synthetic peptide
QDRKRPS

SEQ ID NO: 11505 - DNA, 21 bp, Artificial Sequence
  Description of Artificial Sequence: Synthetic oligonucleotide
gaggatagccgaagaccctct

SEQ ID NO: 11506 - protein, 7 aa, Artificial Sequence
  Description of Artificial Sequence: Synthetic peptide
EDSRRPS

SEQ ID NO: 11507 - DNA, 21 bp, Artificial Sequence
  Description of Artificial Sequence: Synthetic oligonucleotide
gaggataaaagaagaccctca

SEQ ID NO: 11508 - protein, 7 aa, Artificial Sequence
  Description of Artificial Sequence: Synthetic peptide
EDKRRPS

SEQ ID NO: 11509 - DNA, 21 bp, Artificial Sequence
  Description of Artificial Sequence: Synthetic oligonucleotide
caagatagaaagcggccctca

SEQ ID NO: 11510 - protein, 7 aa, Artificial Sequence
  Description of Artificial Sequence: Synthetic peptide
QDRKRPS

SEQ ID NO: 11511 - DNA, 21 bp, Artificial Sequence
  Description of Artificial Sequence: Synthetic oligonucleotide
caagataggaagcggccctca

SEQ ID NO: 11512 - protein, 7 aa, Artificial Sequence
  Description of Artificial Sequence: Synthetic peptide
QDRKRPS

SEQ ID NO: 11513 - DNA, 21 bp, Artificial Sequence
  Description of Artificial Sequence: Synthetic oligonucleotide
gaagataggaagcggccctca

SEQ ID NO: 11514 - protein, 7 aa, Artificial Sequence
  Description of Artificial Sequence: Synthetic peptide
EDRKRPS

SEQ ID NO: 11515 - DNA, 21 bp, Artificial Sequence
  Description of Artificial Sequence: Synthetic oligonucleotide
caagatagcaagcggccctca

SEQ ID NO: 11516 - protein, 7 aa, Artificial Sequence
  Description of Artificial Sequence: Synthetic peptide
QDSKRPS

SEQ ID NO: 11517 - DNA, 21 bp, Artificial Sequence
  Description of Artificial Sequence: Synthetic oligonucleotide
caagatagaaagcggccctca

SEQ ID NO: 11518 - protein, 7 aa, Artificial Sequence
  Description of Artificial Sequence: Synthetic peptide
QDRKRPS

SEQ ID NO: 11519 - DNA, 21 bp, Artificial Sequence
  Description of Artificial Sequence: Synthetic oligonucleotide
gaagataggaagcggccctca

SEQ ID NO: 11520 - protein, 7 aa, Artificial Sequence
  Description of Artificial Sequence: Synthetic peptide
EDRKRPS

SEQ ID NO: 11521 - DNA, 21 bp, Artificial Sequence
  Description of Artificial Sequence: Synthetic oligonucleotide
caagataggaagcggccctca

SEQ ID NO: 11522 - protein, 7 aa, Artificial Sequence
  Description of Artificial Sequence: Synthetic peptide
QDRKRPS

SEQ ID NO: 11523 - DNA, 21 bp, Artificial Sequence
  Description of Artificial Sequence: Synthetic oligonucleotide
gaagataggaagcggccctca

SEQ ID NO: 11524 - protein, 7 aa, Artificial Sequence
  Description of Artificial Sequence: Synthetic peptide
EDRKRPS

SEQ ID NO: 11525 - DNA, 21 bp, Artificial Sequence
  Description of Artificial Sequence: Synthetic oligonucleotide
caagataggaagcggccctca

SEQ ID NO: 11526 - protein, 7 aa, Artificial Sequence
  Description of Artificial Sequence: Synthetic peptide
QDRKRPS

SEQ ID NO: 11527 - DNA, 21 bp, Artificial Sequence
  Description of Artificial Sequence: Synthetic oligonucleotide
aacacaaacactcgctcttct

SEQ ID NO: 11528 - protein, 7 aa, Artificial Sequence
  Description of Artificial Sequence: Synthetic peptide
NTNTRSS

SEQ ID NO: 11529 - DNA, 21 bp, Artificial Sequence
  Description of Artificial Sequence: Synthetic oligonucleotide
caagatatgaagcggccctca

SEQ ID NO: 11530 - protein, 7 aa, Artificial Sequence
  Description of Artificial Sequence: Synthetic peptide
QDMKRPS

SEQ ID NO: 11531 - DNA, 21 bp, Artificial Sequence
  Description of Artificial Sequence: Synthetic oligonucleotide
caagatagcaagcggccctca

SEQ ID NO: 11532 - protein, 7 aa, Artificial Sequence
  Description of Artificial Sequence: Synthetic peptide
QDSKRPS

SEQ ID NO: 11533 - DNA, 21 bp, Artificial Sequence
  Description of Artificial Sequence: Synthetic oligonucleotide
caagataacaggcggccctca

SEQ ID NO: 11534 - protein, 7 aa, Artificial Sequence
  Description of Artificial Sequence: Synthetic peptide
QDNRRPS

SEQ ID NO: 11535 - DNA, 21 bp, Artificial Sequence
  Description of Artificial Sequence: Synthetic oligonucleotide
caagataggaagcggccctca

SEQ ID NO: 11536 - protein, 7 aa, Artificial Sequence
  Description of Artificial Sequence: Synthetic peptide
QDRKRPS

SEQ ID NO: 11537 - DNA, 21 bp, Artificial Sequence
  Description of Artificial Sequence: Synthetic oligonucleotide
agtacaagcaacaaacactcc

SEQ ID NO: 11538 - protein, 7 aa, Artificial Sequence
  Description of Artificial Sequence: Synthetic peptide
STSNKHS

SEQ ID NO: 11539 - DNA, 21 bp, Artificial Sequence
  Description of Artificial Sequence: Synthetic oligonucleotide
caagataacaggcggccgtca

SEQ ID NO: 11540 - protein, 7 aa, Artificial Sequence
  Description of Artificial Sequence: Synthetic peptide
QDNRRPS

SEQ ID NO: 11541 - DNA, 21 bp, Artificial Sequence
  Description of Artificial Sequence: Synthetic oligonucleotide
caagatagcaagcggccctca

SEQ ID NO: 11542 - protein, 7 aa, Artificial Sequence
  Description of Artificial Sequence: Synthetic peptide
QDSKRPS

SEQ ID NO: 11543 - DNA, 21 bp, Artificial Sequence
  Description of Artificial Sequence: Synthetic oligonucleotide
agtacagacaacaaacactcc

SEQ ID NO: 11544 - protein, 7 aa, Artificial Sequence
  Description of Artificial Sequence: Synthetic peptide
STDNKHS

SEQ ID NO: 11545 - DNA, 21 bp, Artificial Sequence
  Description of Artificial Sequence: Synthetic oligonucleotide
caagataacaggcggccctca

SEQ ID NO: 11546 - protein, 7 aa, Artificial Sequence
  Description of Artificial Sequence: Synthetic peptide
QDNRRPS

SEQ ID NO: 11547 - DNA, 21 bp, Artificial Sequence
  Description of Artificial Sequence: Synthetic oligonucleotide
caagataacaggcggccctca

SEQ ID NO: 11548 - protein, 7 aa, Artificial Sequence
  Description of Artificial Sequence: Synthetic peptide
QDNRRPS

SEQ ID NO: 11549 - DNA, 21 bp, Artificial Sequence
  Description of Artificial Sequence: Synthetic oligonucleotide
caagatagcaagcggccctca

SEQ ID NO: 11550 - protein, 7 aa, Artificial Sequence
  Description of Artificial Sequence: Synthetic peptide
QDSKRPS

SEQ ID NO: 11551 - DNA, 21 bp, Artificial Sequence
  Description of Artificial Sequence: Synthetic oligonucleotide
caagataacaggcggccgtca

SEQ ID NO: 11552 - protein, 7 aa, Artificial Sequence
  Description of Artificial Sequence: Synthetic peptide
QDNRRPS

SEQ ID NO: 11553 - DNA, 21 bp, Artificial Sequence
  Description of Artificial Sequence: Synthetic oligonucleotide
caagatagcaagcggccctca

SEQ ID NO: 11554 - protein, 7 aa, Artificial Sequence
  Description of Artificial Sequence: Synthetic peptide
QDSKRPS

SEQ ID NO: 11555 - DNA, 21 bp, Artificial Sequence
  Description of Artificial Sequence: Synthetic oligonucleotide
caagataggaagcggccctca

SEQ ID NO: 11556 - protein, 7 aa, Artificial Sequence
  Description of Artificial Sequence: Synthetic peptide
QDRKRPS

SEQ ID NO: 11557 - DNA, 21 bp, Artificial Sequence
  Description of Artificial Sequence: Synthetic oligonucleotide
caagataagaagcggccctca

SEQ ID NO: 11558 - protein, 7 aa, Artificial Sequence
  Description of Artificial Sequence: Synthetic peptide
QDKKRPS

SEQ ID NO: 11559 - DNA, 21 bp, Artificial Sequence
  Description of Artificial Sequence: Synthetic oligonucleotide
caagatagaaagcggccctca

SEQ ID NO: 11560 - protein, 7 aa, Artificial Sequence
  Description of Artificial Sequence: Synthetic peptide
QDRKRPS

SEQ ID NO: 11561 - DNA, 21 bp, Artificial Sequence
  Description of Artificial Sequence: Synthetic oligonucleotide
caagataagaaacggccctca

SEQ ID NO: 11562 - protein, 7 aa, Artificial Sequence
  Description of Artificial Sequence: Synthetic peptide
QDKKRPS

SEQ ID NO: 11563 - DNA, 21 bp, Artificial Sequence
  Description of Artificial Sequence: Synthetic oligonucleotide
aacacaaacactcgctcttct

SEQ ID NO: 11564 - protein, 7 aa, Artificial Sequence
  Description of Artificial Sequence: Synthetic peptide
NTNTRSS

SEQ ID NO: 11565 - DNA, 21 bp, Artificial Sequence
  Description of Artificial Sequence: Synthetic oligonucleotide
gaagataggaagcggccctca

SEQ ID NO: 11566 - protein, 7 aa, Artificial Sequence
  Description of Artificial Sequence: Synthetic peptide
EDRKRPS

SEQ ID NO: 11567 - DNA, 21 bp, Artificial Sequence
  Description of Artificial Sequence: Synthetic oligonucleotide
gaagataggaagcggccctca

SEQ ID NO: 11568 - protein, 7 aa, Artificial Sequence
  Description of Artificial Sequence: Synthetic peptide
EDRKRPS

SEQ ID NO: 11569 - DNA, 21 bp, Artificial Sequence
  Description of Artificial Sequence: Synthetic oligonucleotide
caagatcgcaagcggccctca

SEQ ID NO: 11570 - protein, 7 aa, Artificial Sequence
  Description of Artificial Sequence: Synthetic peptide
QDRKRPS

SEQ ID NO: 11571 - DNA, 21 bp, Artificial Sequence
  Description of Artificial Sequence: Synthetic oligonucleotide
caagatagaaagcggccctca

SEQ ID NO: 11572 - protein, 7 aa, Artificial Sequence
  Description of Artificial Sequence: Synthetic peptide
QDRKRPS

SEQ ID NO: 11573 - DNA, 21 bp, Artificial Sequence
  Description of Artificial Sequence: Synthetic oligonucleotide
agtacaagtaacaaacactcc

SEQ ID NO: 11574 - protein, 7 aa, Artificial Sequence
  Description of Artificial Sequence: Synthetic peptide
STSNKHS

SEQ ID NO: 11575 - DNA, 21 bp, Artificial Sequence
  Description of Artificial Sequence: Synthetic oligonucleotide
gacaataataagcgaccctca

SEQ ID NO: 11576 - protein, 7 aa, Artificial Sequence
  Description of Artificial Sequence: Synthetic peptide
DNNKRPS

SEQ ID NO: 11577 - DNA, 21 bp, Artificial Sequence
  Description of Artificial Sequence: Synthetic oligonucleotide
caagatagcaagcggccctca

SEQ ID NO: 11578 - protein, 7 aa, Artificial Sequence
  Description of Artificial Sequence: Synthetic peptide
QDSKRPS

SEQ ID NO: 11579 - DNA, 21 bp, Artificial Sequence
  Description of Artificial Sequence: Synthetic oligonucleotide
ggaaaaaacaaccggccctca

SEQ ID NO: 11580 - protein, 7 aa, Artificial Sequence
  Description of Artificial Sequence: Synthetic peptide
GKNNRPS

SEQ ID NO: 11581 - DNA, 21 bp, Artificial Sequence
  Description of Artificial Sequence: Synthetic oligonucleotide
gacagtaataagcgaccctca

SEQ ID NO: 11582 - protein, 7 aa, Artificial Sequence
  Description of Artificial Sequence: Synthetic peptide
DSNKRPS

SEQ ID NO: 11583 - DNA, 21 bp, Artificial Sequence
  Description of Artificial Sequence: Synthetic oligonucleotide
gacaataataagcgaccctca

SEQ ID NO: 11584 - protein, 7 aa, Artificial Sequence
  Description of Artificial Sequence: Synthetic peptide
DNNKRPS

SEQ ID NO: 11585 - DNA, 21 bp, Artificial Sequence
  Description of Artificial Sequence: Synthetic oligonucleotide
ggtaaaaacaaccggccctca

SEQ ID NO: 11586 - protein, 7 aa, Artificial Sequence
  Description of Artificial Sequence: Synthetic peptide
GKNNRPS

SEQ ID NO: 11587 - DNA, 21 bp, Artificial Sequence
  Description of Artificial Sequence: Synthetic oligonucleotide
gacaataataagcgaccctca

SEQ ID NO: 11588 - protein, 7 aa, Artificial Sequence
  Description of Artificial Sequence: Synthetic peptide
DNNKRPS

SEQ ID NO: 11589 - DNA, 21 bp, Artificial Sequence
  Description of Artificial Sequence: Synthetic oligonucleotide
gacaataataagcgaccctca

SEQ ID NO: 11590 - protein, 7 aa, Artificial Sequence
  Description of Artificial Sequence: Synthetic peptide
DNNKRPS

SEQ ID NO: 11591 - DNA, 21 bp, Artificial Sequence
  Description of Artificial Sequence: Synthetic oligonucleotide
gacagtagtaagcgaccctca

SEQ ID NO: 11592 - protein, 7 aa, Artificial Sequence
  Description of Artificial Sequence: Synthetic peptide
DSSKRPS

SEQ ID NO: 11593 - DNA, 21 bp, Artificial Sequence
  Description of Artificial Sequence: Synthetic oligonucleotide
caagataacaagcggccctca

SEQ ID NO: 11594 - protein, 7 aa, Artificial Sequence
  Description of Artificial Sequence: Synthetic peptide
QDNKRPS

SEQ ID NO: 11595 - DNA, 21 bp, Artificial Sequence
  Description of Artificial Sequence: Synthetic oligonucleotide
ggtaaaaacaaccggccctca

SEQ ID NO: 11596 - protein, 7 aa, Artificial Sequence
  Description of Artificial Sequence: Synthetic peptide
GKNNRPS

SEQ ID NO: 11597 - DNA, 21 bp, Artificial Sequence
  Description of Artificial Sequence: Synthetic oligonucleotide
gacaataataagcgaccctca

SEQ ID NO: 11598 - protein, 7 aa, Artificial Sequence
  Description of Artificial Sequence: Synthetic peptide
DNNKRPS

SEQ ID NO: 11599 - DNA, 21 bp, Artificial Sequence
  Description of Artificial Sequence: Synthetic oligonucleotide
agtacaagcaacaaacactcc

SEQ ID NO: 11600 - protein, 7 aa, Artificial Sequence
  Description of Artificial Sequence: Synthetic peptide
STSNKHS

SEQ ID NO: 11601 - DNA, 21 bp, Artificial Sequence
  Description of Artificial Sequence: Synthetic oligonucleotide
gacaattataagcgaccctca

SEQ ID NO: 11602 - protein, 7 aa, Artificial Sequence
  Description of Artificial Sequence: Synthetic peptide
DNYKRPS

SEQ ID NO: 11603 - DNA, 21 bp, Artificial Sequence
  Description of Artificial Sequence: Synthetic oligonucleotide
agtacaagcaacaaacactcc

SEQ ID NO: 11604 - protein, 7 aa, Artificial Sequence
  Description of Artificial Sequence: Synthetic peptide
STSNKHS

SEQ ID NO: 11605 - DNA, 21 bp, Artificial Sequence
  Description of Artificial Sequence: Synthetic oligonucleotide
ggtaaaaacaaccggccctca

SEQ ID NO: 11606 - protein, 7 aa, Artificial Sequence
  Description of Artificial Sequence: Synthetic peptide
GKNNRPS

SEQ ID NO: 11607 - DNA, 21 bp, Artificial Sequence
  Description of Artificial Sequence: Synthetic oligonucleotide
ggtaaaaacaaccggccctca

SEQ ID NO: 11608 - protein, 7 aa, Artificial Sequence
  Description of Artificial Sequence: Synthetic peptide
GKNNRPS

SEQ ID NO: 11609 - DNA, 21 bp, Artificial Sequence
  Description of Artificial Sequence: Synthetic oligonucleotide
gacaataaaaagcgaccctca

SEQ ID NO: 11610 - protein, 7 aa, Artificial Sequence
  Description of Artificial Sequence: Synthetic peptide
DNKKRPS

SEQ ID NO: 11611 - DNA, 33 bp, Artificial Sequence
  Description of Artificial Sequence: Synthetic oligonucleotide
tacaaatcagactcagataagcagcagggctct

SEQ ID NO: 11612 - protein, 11 aa, Artificial Sequence
  Description of Artificial Sequence: Synthetic peptide
YKSDSDKQQGS

SEQ ID NO: 11613 - DNA, 21 bp, Artificial Sequence
  Description of Artificial Sequence: Synthetic oligonucleotide
agtacaaacaacaaacactcc

SEQ ID NO: 11614 - protein, 7 aa, Artificial Sequence
  Description of Artificial Sequence: Synthetic peptide
STNNKHS

SEQ ID NO: 11615 - DNA, 21 bp, Artificial Sequence
  Description of Artificial Sequence: Synthetic oligonucleotide
gacaataataagcgaccctca

SEQ ID NO: 11616 - protein, 7 aa, Artificial Sequence
  Description of Artificial Sequence: Synthetic peptide
DNNKRPS

SEQ ID NO: 11617 - DNA, 21 bp, Artificial Sequence
  Description of Artificial Sequence: Synthetic oligonucleotide
agtacaaacaacaaacactcc

SEQ ID NO: 11618 - protein, 7 aa, Artificial Sequence
  Description of Artificial Sequence: Synthetic peptide
STNNKHS

SEQ ID NO: 11619 - DNA, 21 bp, Artificial Sequence
  Description of Artificial Sequence: Synthetic oligonucleotide
ggtaataagcagcggccctca

SEQ ID NO: 11620 - protein, 7 aa, Artificial Sequence
  Description of Artificial Sequence: Synthetic peptide
GNKQRPS

SEQ ID NO: 11621 - DNA, 21 bp, Artificial Sequence
  Description of Artificial Sequence: Synthetic oligonucleotide
agtacaaccaacagacattcc

SEQ ID NO: 11622 - protein, 7 aa, Artificial Sequence
  Description of Artificial Sequence: Synthetic peptide
STTNRHS

SEQ ID NO: 11623 - DNA, 21 bp, Artificial Sequence
  Description of Artificial Sequence: Synthetic oligonucleotide
aatacaagcaacagacactcc

SEQ ID NO: 11624 - protein, 7 aa, Artificial Sequence
  Description of Artificial Sequence: Synthetic peptide
NTSNRHS

SEQ ID NO: 11625 - DNA, 21 bp, Artificial Sequence
  Description of Artificial Sequence: Synthetic oligonucleotide
gctaagaacaaccggccctca

SEQ ID NO: 11626 - protein, 7 aa, Artificial Sequence
  Description of Artificial Sequence: Synthetic peptide
AKNNRPS

SEQ ID NO: 11627 - DNA, 21 bp, Artificial Sequence
  Description of Artificial Sequence: Synthetic oligonucleotide
caagatagcaagcggccctca

SEQ ID NO: 11628 - protein, 7 aa, Artificial Sequence
  Description of Artificial Sequence: Synthetic peptide
QDSKRPS

SEQ ID NO: 11629 - DNA, 21 bp, Artificial Sequence
  Description of Artificial Sequence: Synthetic oligonucleotide
gacaataataagcgaccctca

SEQ ID NO: 11630 - protein, 7 aa, Artificial Sequence
  Description of Artificial Sequence: Synthetic peptide
DNNKRPS

SEQ ID NO: 11631 - DNA, 21 bp, Artificial Sequence
  Description of Artificial Sequence: Synthetic oligonucleotide
agtacaagcaacaaacactcc

SEQ ID NO: 11632 - protein, 7 aa, Artificial Sequence
  Description of Artificial Sequence: Synthetic peptide
STSNKHS

SEQ ID NO: 11633 - DNA, 21 bp, Artificial Sequence
  Description of Artificial Sequence: Synthetic oligonucleotide
gacaataataagcgaccctca

SEQ ID NO: 11634 - protein, 7 aa, Artificial Sequence
  Description of Artificial Sequence: Synthetic peptide
DNNKRPS

SEQ ID NO: 11635 - DNA, 21 bp, Artificial Sequence
  Description of Artificial Sequence: Synthetic oligonucleotide
agtacaagcaacagacactcc

SEQ ID NO: 11636 - protein, 7 aa, Artificial Sequence
  Description of Artificial Sequence: Synthetic peptide
STSNRHS

SEQ ID NO: 11637 - DNA, 21 bp, Artificial Sequence
  Description of Artificial Sequence: Synthetic oligonucleotide
gacaataataagcgaccctca

SEQ ID NO: 11638 - protein, 7 aa, Artificial Sequence
  Description of Artificial Sequence: Synthetic peptide
DNNKRPS

SEQ ID NO: 11639 - DNA, 21 bp, Artificial Sequence
  Description of Artificial Sequence: Synthetic oligonucleotide
gaagatagcaagcgaccctca

SEQ ID NO: 11640 - protein, 7 aa, Artificial Sequence
  Description of Artificial Sequence: Synthetic peptide
EDSKRPS

SEQ ID NO: 11641 - DNA, 21 bp, Artificial Sequence
  Description of Artificial Sequence: Synthetic oligonucleotide
aataattatcagcggccctca

SEQ ID NO: 11642 - protein, 7 aa, Artificial Sequence
  Description of Artificial Sequence: Synthetic peptide
NNYQRPS

SEQ ID NO: 11643 - DNA, 21 bp, Artificial Sequence
  Description of Artificial Sequence: Synthetic oligonucleotide
caagataggaagcggccctca

SEQ ID NO: 11644 - protein, 7 aa, Artificial Sequence
  Description of Artificial Sequence: Synthetic peptide
QDRKRPS

SEQ ID NO: 11645 - DNA, 21 bp, Artificial Sequence
  Description of Artificial Sequence: Synthetic oligonucleotide
gacaataataagcgaccctca

SEQ ID NO: 11646 - protein, 7 aa, Artificial Sequence
  Description of Artificial Sequence: Synthetic peptide
DNNKRPS

SEQ ID NO: 11647 - DNA, 21 bp, Artificial Sequence
  Description of Artificial Sequence: Synthetic oligonucleotide
agtacaaacaacaaacactcc

SEQ ID NO: 11648 - protein, 7 aa, Artificial Sequence
  Description of Artificial Sequence: Synthetic peptide
STNNKHS

SEQ ID NO: 11649 - DNA, 21 bp, Artificial Sequence
  Description of Artificial Sequence: Synthetic oligonucleotide
gacaataataagcgaccctca

SEQ ID NO: 11650 - protein, 7 aa, Artificial Sequence
  Description of Artificial Sequence: Synthetic peptide
DNNKRPS

SEQ ID NO: 11651 - DNA, 21 bp, Artificial Sequence
  Description of Artificial Sequence: Synthetic oligonucleotide
agtaataatcagcggccctca

SEQ ID NO: 11652 - protein, 7 aa, Artificial Sequence
  Description of Artificial Sequence: Synthetic peptide
SNNQRPS

SEQ ID NO: 11653 - DNA, 21 bp, Artificial Sequence
  Description of Artificial Sequence: Synthetic oligonucleotide
agtacaaacaacaaacactcc

SEQ ID NO: 11654 - protein, 7 aa, Artificial Sequence
  Description of Artificial Sequence: Synthetic peptide
STNNKHS

SEQ ID NO: 11655 - DNA, 21 bp, Artificial Sequence
  Description of Artificial Sequence: Synthetic oligonucleotide
agtacaagcaacaaacactcc

SEQ ID NO: 11656 - protein, 7 aa, Artificial Sequence
  Description of Artificial Sequence: Synthetic peptide
STSNKHS

SEQ ID NO: 11657 - DNA, 21 bp, Artificial Sequence
  Description of Artificial Sequence: Synthetic oligonucleotide
gacaataaaaagcgaccctca

SEQ ID NO: 11658 - protein, 7 aa, Artificial Sequence
  Description of Artificial Sequence: Synthetic peptide
DNKKRPS

SEQ ID NO: 11659 - DNA, 21 bp, Artificial Sequence
  Description of Artificial Sequence: Synthetic oligonucleotide
agtacaagcaacaaacattcc

SEQ ID NO: 11660 - protein, 7 aa, Artificial Sequence
  Description of Artificial Sequence: Synthetic peptide
STSNKHS

SEQ ID NO: 11661 - DNA, 21 bp, Artificial Sequence
  Description of Artificial Sequence: Synthetic oligonucleotide
gacaataataagcgcccctca

SEQ ID NO: 11662 - protein, 7 aa, Artificial Sequence
  Description of Artificial Sequence: Synthetic peptide
DNNKRPS

SEQ ID NO: 11663 - DNA, 21 bp, Artificial Sequence
  Description of Artificial Sequence: Synthetic oligonucleotide
agtaataatcagcggccctca

SEQ ID NO: 11664 - protein, 7 aa, Artificial Sequence
  Description of Artificial Sequence: Synthetic peptide
SNNQRPS

SEQ ID NO: 11665 - DNA, 21 bp, Artificial Sequence
  Description of Artificial Sequence: Synthetic oligonucleotide
catacaaacaacaaacactcc

SEQ ID NO: 11666 - protein, 7 aa, Artificial Sequence
  Description of Artificial Sequence: Synthetic peptide
HTNNKHS

SEQ ID NO: 11667 - DNA, 21 bp, Artificial Sequence
  Description of Artificial Sequence: Synthetic oligonucleotide
gacaattataagcgaccctca

SEQ ID NO: 11668 - protein, 7 aa, Artificial Sequence
  Description of Artificial Sequence: Synthetic peptide
DNYKRPS

SEQ ID NO: 11669 - DNA, 21 bp, Artificial Sequence
  Description of Artificial Sequence: Synthetic oligonucleotide
catacagacaacaaacactcc

SEQ ID NO: 11670 - protein, 7 aa, Artificial Sequence
  Description of Artificial Sequence: Synthetic peptide
HTDNKHS

SEQ ID NO: 11671 - DNA, 21 bp, Artificial Sequence
  Description of Artificial Sequence: Synthetic oligonucleotide
agtacaaacaacaaacactcc

SEQ ID NO: 11672 - protein, 7 aa, Artificial Sequence
  Description of Artificial Sequence: Synthetic peptide
STNNKHS

SEQ ID NO: 11673 - DNA, 21 bp, Artificial Sequence
  Description of Artificial Sequence: Synthetic oligonucleotide
caagatagcaagcggccctca

SEQ ID NO: 11674 - protein, 7 aa, Artificial Sequence
  Description of Artificial Sequence: Synthetic peptide
QDSKRPS

SEQ ID NO: 11675 - DNA, 21 bp, Artificial Sequence
  Description of Artificial Sequence: Synthetic oligonucleotide
agggatagcgaccggccctct

SEQ ID NO: 11676 - protein, 7 aa, Artificial Sequence
  Description of Artificial Sequence: Synthetic peptide
RDSDRPS

SEQ ID NO: 11677 - DNA, 21 bp, Artificial Sequence
  Description of Artificial Sequence: Synthetic oligonucleotide
caagataacaagcggccctca

SEQ ID NO: 11678 - protein, 7 aa, Artificial Sequence
  Description of Artificial Sequence: Synthetic peptide
QDNKRPS

SEQ ID NO: 11679 - DNA, 21 bp, Artificial Sequence
  Description of Artificial Sequence: Synthetic oligonucleotide
agggatagcgaccggccctct

SEQ ID NO: 11680 - protein, 7 aa, Artificial Sequence
  Description of Artificial Sequence: Synthetic peptide
RDSDRPS

SEQ ID NO: 11681 - DNA, 21 bp, Artificial Sequence
  Description of Artificial Sequence: Synthetic oligonucleotide
agggatagctaccgatcttct

SEQ ID NO: 11682 - protein, 7 aa, Artificial Sequence
  Description of Artificial Sequence: Synthetic peptide
RDSYRSS

SEQ ID NO: 11683 - DNA, 21 bp, Artificial Sequence
  Description of Artificial Sequence: Synthetic oligonucleotide
gacaataataagcgaccctca

SEQ ID NO: 11684 - protein, 7 aa, Artificial Sequence
  Description of Artificial Sequence: Synthetic peptide
DNNKRPS

SEQ ID NO: 11685 - DNA, 21 bp, Artificial Sequence
  Description of Artificial Sequence: Synthetic oligonucleotide
agggatagctaccggtcttct

SEQ ID NO: 11686 - protein, 7 aa, Artificial Sequence
  Description of Artificial Sequence: Synthetic peptide
RDSYRSS

SEQ ID NO: 11687 - DNA, 21 bp, Artificial Sequence
  Description of Artificial Sequence: Synthetic oligonucleotide
agtacaagcaacaaacactcc

SEQ ID NO: 11688 - protein, 7 aa, Artificial Sequence
  Description of Artificial Sequence: Synthetic peptide
STSNKHS

SEQ ID NO: 11689 - DNA, 21 bp, Artificial Sequence
  Description of Artificial Sequence: Synthetic oligonucleotide
gaggtcaggaatcggccctca

SEQ ID NO: 11690 - protein, 7 aa, Artificial Sequence
  Description of Artificial Sequence: Synthetic peptide
EVRNRPS

SEQ ID NO: 11691 - DNA, 21 bp, Artificial Sequence
  Description of Artificial Sequence: Synthetic oligonucleotide
gaggtcagtaatcggccctca

SEQ ID NO: 11692 - protein, 7 aa, Artificial Sequence
  Description of Artificial Sequence: Synthetic peptide
EVSNRPS

SEQ ID NO: 11693 - DNA, 21 bp, Artificial Sequence
  Description of Artificial Sequence: Synthetic oligonucleotide
gaggtcagtaatcggccctca

SEQ ID NO: 11694 - protein, 7 aa, Artificial Sequence
  Description of Artificial Sequence: Synthetic peptide
EVSNRPS

SEQ ID NO: 11695 - DNA, 21 bp, Artificial Sequence
  Description of Artificial Sequence: Synthetic oligonucleotide
gaggtcagtaatcggccctca

SEQ ID NO: 11696 - protein, 7 aa, Artificial Sequence
  Description of Artificial Sequence: Synthetic peptide
EVSNRPS

SEQ ID NO: 11697 - DNA, 21 bp, Artificial Sequence
  Description of Artificial Sequence: Synthetic oligonucleotide
agagatcgcgaccggccctct

SEQ ID NO: 11698 - protein, 7 aa, Artificial Sequence
  Description of Artificial Sequence: Synthetic peptide
RDRDRPS

SEQ ID NO: 11699 - DNA, 21 bp, Artificial Sequence
  Description of Artificial Sequence: Synthetic oligonucleotide
aaagacagtgcgaggccctca

SEQ ID NO: 11700 - protein, 7 aa, Artificial Sequence
  Description of Artificial Sequence: Synthetic peptide
KDSARPS

SEQ ID NO: 11701 - DNA, 21 bp, Artificial Sequence
  Description of Artificial Sequence: Synthetic oligonucleotide
gaggtcagtaatcggccctca

SEQ ID NO: 11702 - protein, 7 aa, Artificial Sequence
  Description of Artificial Sequence: Synthetic peptide
EVSNRPS

SEQ ID NO: 11703 - DNA, 21 bp, Artificial Sequence
  Description of Artificial Sequence: Synthetic oligonucleotide
agtacaagcaacagacactcc

SEQ ID NO: 11704 - protein, 7 aa, Artificial Sequence
  Description of Artificial Sequence: Synthetic peptide
STSNRHS

SEQ ID NO: 11705 - DNA, 21 bp, Artificial Sequence
  Description of Artificial Sequence: Synthetic oligonucleotide
agtacaaacaacaagcactcc

SEQ ID NO: 11706 - protein, 7 aa, Artificial Sequence
  Description of Artificial Sequence: Synthetic peptide
STNNKHS

SEQ ID NO: 11707 - DNA, 21 bp, Artificial Sequence
  Description of Artificial Sequence: Synthetic oligonucleotide
agtacaatcaacaaacactcc

SEQ ID NO: 11708 - protein, 7 aa, Artificial Sequence
  Description of Artificial Sequence: Synthetic peptide
STINKHS

SEQ ID NO: 11709 - DNA, 21 bp, Artificial Sequence
  Description of Artificial Sequence: Synthetic oligonucleotide
gaggtcagaaatcggccctca

SEQ ID NO: 11710 - protein, 7 aa, Artificial Sequence
  Description of Artificial Sequence: Synthetic peptide
EVRNRPS

SEQ ID NO: 11711 - DNA, 21 bp, Artificial Sequence
  Description of Artificial Sequence: Synthetic oligonucleotide
gaggtcagtaatcggccctca

SEQ ID NO: 11712 - protein, 7 aa, Artificial Sequence
  Description of Artificial Sequence: Synthetic peptide
EVSNRPS

SEQ ID NO: 11713 - DNA, 21 bp, Artificial Sequence
  Description of Artificial Sequence: Synthetic oligonucleotide
gaggtcagtaatcggccctca

SEQ ID NO: 11714 - protein, 7 aa, Artificial Sequence
  Description of Artificial Sequence: Synthetic peptide
EVSNRPS

SEQ ID NO: 11715 - DNA, 21 bp, Artificial Sequence
  Description of Artificial Sequence: Synthetic oligonucleotide
gaggtcagtaatcggccctca

SEQ ID NO: 11716 - protein, 7 aa, Artificial Sequence
  Description of Artificial Sequence: Synthetic peptide
EVSNRPS

SEQ ID NO: 11717 - DNA, 21 bp, Artificial Sequence
  Description of Artificial Sequence: Synthetic oligonucleotide
agtacaaacaacaaacactcc

SEQ ID NO: 11718 - protein, 7 aa, Artificial Sequence
  Description of Artificial Sequence: Synthetic peptide
STNNKHS

SEQ ID NO: 11719 - DNA, 21 bp, Artificial Sequence
  Description of Artificial Sequence: Synthetic oligonucleotide
agtacaagcaacaaacactcc

SEQ ID NO: 11720 - protein, 7 aa, Artificial Sequence
  Description of Artificial Sequence: Synthetic peptide
STSNKHS

SEQ ID NO: 11721 - DNA, 21 bp, Artificial Sequence
  Description of Artificial Sequence: Synthetic oligonucleotide
gaggtcaggaatcggccctca

SEQ ID NO: 11722 - protein, 7 aa, Artificial Sequence
  Description of Artificial Sequence: Synthetic peptide
EVRNRPS

SEQ ID NO: 11723 - DNA, 21 bp, Artificial Sequence
  Description of Artificial Sequence: Synthetic oligonucleotide
gaggtccgtaatcggccctca

SEQ ID NO: 11724 - protein, 7 aa, Artificial Sequence
  Description of Artificial Sequence: Synthetic peptide
EVRNRPS

SEQ ID NO: 11725 - DNA, 21 bp, Artificial Sequence
  Description of Artificial Sequence: Synthetic oligonucleotide
agtacaaacaacaagcactcc

SEQ ID NO: 11726 - protein, 7 aa, Artificial Sequence
  Description of Artificial Sequence: Synthetic peptide
STNNKHS

SEQ ID NO: 11727 - DNA, 21 bp, Artificial Sequence
  Description of Artificial Sequence: Synthetic oligonucleotide
gaggtcaggaatcggccctca

SEQ ID NO: 11728 - protein, 7 aa, Artificial Sequence
  Description of Artificial Sequence: Synthetic peptide
EVRNRPS

SEQ ID NO: 11729 - DNA, 21 bp, Artificial Sequence
  Description of Artificial Sequence: Synthetic oligonucleotide
agtacaagcaacaaacactcc

SEQ ID NO: 11730 - protein, 7 aa, Artificial Sequence
  Description of Artificial Sequence: Synthetic peptide
STSNKHS

SEQ ID NO: 11731 - DNA, 21 bp, Artificial Sequence
  Description of Artificial Sequence: Synthetic oligonucleotide
gacaataataagcgaccctca

SEQ ID NO: 11732 - protein, 7 aa, Artificial Sequence
  Description of Artificial Sequence: Synthetic peptide
DNNKRPS

SEQ ID NO: 11733 - DNA, 21 bp, Artificial Sequence
  Description of Artificial Sequence: Synthetic oligonucleotide
agtacaagcaataaacactcc

SEQ ID NO: 11734 - protein, 7 aa, Artificial Sequence
  Description of Artificial Sequence: Synthetic peptide
STSNKHS

SEQ ID NO: 11735 - DNA, 21 bp, Artificial Sequence
  Description of Artificial Sequence: Synthetic oligonucleotide
agtacaagcaacaaacactcc

SEQ ID NO: 11736 - protein, 7 aa, Artificial Sequence
  Description of Artificial Sequence: Synthetic peptide
STSNKHS

SEQ ID NO: 11737 - DNA, 21 bp, Artificial Sequence
  Description of Artificial Sequence: Synthetic oligonucleotide
caagatagcaagcggccctca

SEQ ID NO: 11738 - protein, 7 aa, Artificial Sequence
  Description of Artificial Sequence: Synthetic peptide
QDSKRPS

SEQ ID NO: 11739 - DNA, 21 bp, Artificial Sequence
  Description of Artificial Sequence: Synthetic oligonucleotide
gaggtcagtaatcggccctca

SEQ ID NO: 11740 - protein, 7 aa, Artificial Sequence
  Description of Artificial Sequence: Synthetic peptide
EVSNRPS

SEQ ID NO: 11741 - DNA, 21 bp, Artificial Sequence
  Description of Artificial Sequence: Synthetic oligonucleotide
agtacaaacaacaaacactcc

SEQ ID NO: 11742 - protein, 7 aa, Artificial Sequence
  Description of Artificial Sequence: Synthetic peptide
STNNKHS

SEQ ID NO: 11743 - DNA, 21 bp, Artificial Sequence
  Description of Artificial Sequence: Synthetic oligonucleotide
gaggtcagtaatcggccctca

SEQ ID NO: 11744 - protein, 7 aa, Artificial Sequence
  Description of Artificial Sequence: Synthetic peptide
EVSNRPS

SEQ ID NO: 11745 - DNA, 21 bp, Artificial Sequence
  Description of Artificial Sequence: Synthetic oligonucleotide
agtacaaacaacaaacactcc

SEQ ID NO: 11746 - protein, 7 aa, Artificial Sequence
  Description of Artificial Sequence: Synthetic peptide
STNNKHS

SEQ ID NO: 11747 - DNA, 21 bp, Artificial Sequence
  Description of Artificial Sequence: Synthetic oligonucleotide
agtacaagcaataaacactcc

SEQ ID NO: 11748 - protein, 7 aa, Artificial Sequence
  Description of Artificial Sequence: Synthetic peptide
STSNKHS

SEQ ID NO: 11749 - DNA, 21 bp, Artificial Sequence
  Description of Artificial Sequence: Synthetic oligonucleotide
agggatagcaaccggccctct

SEQ ID NO: 11750 - protein, 7 aa, Artificial Sequence
  Description of Artificial Sequence: Synthetic peptide
RDSNRPS

SEQ ID NO: 11751 - DNA, 21 bp, Artificial Sequence
  Description of Artificial Sequence: Synthetic oligonucleotide
gaggtcagtaatcggccctca

SEQ ID NO: 11752 - protein, 7 aa, Artificial Sequence
  Description of Artificial Sequence: Synthetic peptide
EVSNRPS

SEQ ID NO: 11753 - DNA, 21 bp, Artificial Sequence
  Description of Artificial Sequence: Synthetic oligonucleotide
aaagacagtgagaggccctca

SEQ ID NO: 11754 - protein, 7 aa, Artificial Sequence
  Description of Artificial Sequence: Synthetic peptide
KDSERPS

SEQ ID NO: 11755 - DNA, 21 bp, Artificial Sequence
  Description of Artificial Sequence: Synthetic oligonucleotide
aaagacagtgagaggccctca

SEQ ID NO: 11756 - protein, 7 aa, Artificial Sequence
  Description of Artificial Sequence: Synthetic peptide
KDSERPS

SEQ ID NO: 11757 - DNA, 21 bp, Artificial Sequence
  Description of Artificial Sequence: Synthetic oligonucleotide
gacagtaataagcgaccctca

SEQ ID NO: 11758 - protein, 7 aa, Artificial Sequence
  Description of Artificial Sequence: Synthetic peptide
DSNKRPS

SEQ ID NO: 11759 - DNA, 21 bp, Artificial Sequence
  Description of Artificial Sequence: Synthetic oligonucleotide
aaagacagtgagaggccctca

SEQ ID NO: 11760 - protein, 7 aa, Artificial Sequence
  Description of Artificial Sequence: Synthetic peptide
KDSERPS

SEQ ID NO: 11761 - DNA, 21 bp, Artificial Sequence
  Description of Artificial Sequence: Synthetic oligonucleotide
gaggtcagaaatcggccctca

SEQ ID NO: 11762 - protein, 7 aa, Artificial Sequence
  Description of Artificial Sequence: Synthetic peptide
EVRNRPS

SEQ ID NO: 11763 - DNA, 21 bp, Artificial Sequence
  Description of Artificial Sequence: Synthetic oligonucleotide
gaggtcaggaatcggccctca

SEQ ID NO: 11764 - protein, 7 aa, Artificial Sequence
  Description of Artificial Sequence: Synthetic peptide
EVRNRPS

SEQ ID NO: 11765 - DNA, 21 bp, Artificial Sequence
  Description of Artificial Sequence: Synthetic oligonucleotide
gaggtcaggaatcggccctca

SEQ ID NO: 11766 - protein, 7 aa, Artificial Sequence
  Description of Artificial Sequence: Synthetic peptide
EVRNRPS

SEQ ID NO: 11767 - DNA, 21 bp, Artificial Sequence
  Description of Artificial Sequence: Synthetic oligonucleotide
caagatagcaagcggccctca

SEQ ID NO: 11768 - protein, 7 aa, Artificial Sequence
  Description of Artificial Sequence: Synthetic peptide
QDSKRPS

SEQ ID NO: 11769 - DNA, 21 bp, Artificial Sequence
  Description of Artificial Sequence: Synthetic oligonucleotide
ggtaacagcaatcggccctca

SEQ ID NO: 11770 - protein, 7 aa, Artificial Sequence
  Description of Artificial Sequence: Synthetic peptide
GNSNRPS

SEQ ID NO: 11771 - DNA, 21 bp, Artificial Sequence
  Description of Artificial Sequence: Synthetic oligonucleotide
caagatagcaagcggccctca

SEQ ID NO: 11772 - protein, 7 aa, Artificial Sequence
  Description of Artificial Sequence: Synthetic peptide
QDSKRPS

SEQ ID NO: 11773 - DNA, 21 bp, Artificial Sequence
  Description of Artificial Sequence: Synthetic oligonucleotide
caagatcgcaagcggccctca

SEQ ID NO: 11774 - protein, 7 aa, Artificial Sequence
  Description of Artificial Sequence: Synthetic peptide
QDRKRPS

SEQ ID NO: 11775 - DNA, 21 bp, Artificial Sequence
  Description of Artificial Sequence: Synthetic oligonucleotide
caagatcgcaagcggccctca

SEQ ID NO: 11776 - protein, 7 aa, Artificial Sequence
  Description of Artificial Sequence: Synthetic peptide
QDRKRPS

SEQ ID NO: 11777 - DNA, 21 bp, Artificial Sequence
  Description of Artificial Sequence: Synthetic oligonucleotide
aaagacagtgagaggccctca

SEQ ID NO: 11778 - protein, 7 aa, Artificial Sequence
  Description of Artificial Sequence: Synthetic peptide
KDSERPS

SEQ ID NO: 11779 - DNA, 21 bp, Artificial Sequence
  Description of Artificial Sequence: Synthetic oligonucleotide
ggtaacagcaatcggccctca

SEQ ID NO: 11780 - protein, 7 aa, Artificial Sequence
  Description of Artificial Sequence: Synthetic peptide
GNSNRPS

SEQ ID NO: 11781 - DNA, 21 bp, Artificial Sequence
  Description of Artificial Sequence: Synthetic oligonucleotide
caagatcgcaagcggccctca

SEQ ID NO: 11782 - protein, 7 aa, Artificial Sequence
  Description of Artificial Sequence: Synthetic peptide
QDRKRPS

SEQ ID NO: 11783 - DNA, 21 bp, Artificial Sequence
  Description of Artificial Sequence: Synthetic oligonucleotide
ggtaacagcaatcggccctca

SEQ ID NO: 11784 - protein, 7 aa, Artificial Sequence
  Description of Artificial Sequence: Synthetic peptide
GNSNRPS

SEQ ID NO: 11785 - DNA, 21 bp, Artificial Sequence
  Description of Artificial Sequence: Synthetic oligonucleotide
caagataggaagcggccctca

SEQ ID NO: 11786 - protein, 7 aa, Artificial Sequence
  Description of Artificial Sequence: Synthetic peptide
QDRKRPS

SEQ ID NO: 11787 - DNA, 21 bp, Artificial Sequence
  Description of Artificial Sequence: Synthetic oligonucleotide
ggtaacagcaatcggccctca

SEQ ID NO: 11788 - protein, 7 aa, Artificial Sequence
  Description of Artificial Sequence: Synthetic peptide
GNSNRPS

SEQ ID NO: 11789 - DNA, 21 bp, Artificial Sequence
  Description of Artificial Sequence: Synthetic oligonucleotide
caagatagcaagcggccctca

SEQ ID NO: 11790 - protein, 7 aa, Artificial Sequence
  Description of Artificial Sequence: Synthetic peptide
QDSKRPS

SEQ ID NO: 11791 - DNA, 21 bp, Artificial Sequence
  Description of Artificial Sequence: Synthetic oligonucleotide
gaggacagcaaacgaccctcc

SEQ ID NO: 11792 - protein, 7 aa, Artificial Sequence
  Description of Artificial Sequence: Synthetic peptide
EDSKRPS

SEQ ID NO: 11793 - DNA, 21 bp, Artificial Sequence
  Description of Artificial Sequence: Synthetic oligonucleotide
gctgcatccagtttgcgaagt

SEQ ID NO: 11794 - protein, 7 aa, Artificial Sequence
  Description of Artificial Sequence: Synthetic peptide
AASSLRS

SEQ ID NO: 11795 - DNA, 21 bp, Artificial Sequence
  Description of Artificial Sequence: Synthetic oligonucleotide
ggtgcatccagtttgcaaagt

SEQ ID NO: 11796 - protein, 7 aa, Artificial Sequence
  Description of Artificial Sequence: Synthetic peptide
GASSLQS

SEQ ID NO: 11797 - DNA, 21 bp, Artificial Sequence
  Description of Artificial Sequence: Synthetic oligonucleotide
gctgcatccggtttgcaaagt

SEQ ID NO: 11798 - protein, 7 aa, Artificial Sequence
  Description of Artificial Sequence: Synthetic peptide
AASGLQS

SEQ ID NO: 11799 - DNA, 21 bp, Artificial Sequence
  Description of Artificial Sequence: Synthetic oligonucleotide
gaggtttctaactgggactct

SEQ ID NO: 11800 - protein, 7 aa, Artificial Sequence
  Description of Artificial Sequence: Synthetic peptide
EVSNWDS

SEQ ID NO: 11801 - DNA, 21 bp, Artificial Sequence
  Description of Artificial Sequence: Synthetic oligonucleotide
ggtgcatccaccagggccact

SEQ ID NO: 11802 - protein, 7 aa, Artificial Sequence
  Description of Artificial Sequence: Synthetic peptide
GASTRAT

SEQ ID NO: 11803 - DNA, 21 bp, Artificial Sequence
  Description of Artificial Sequence: Synthetic oligonucleotide
actgcatccagtttgcaaagt

SEQ ID NO: 11804 - protein, 7 aa, Artificial Sequence
  Description of Artificial Sequence: Synthetic peptide
TASSLQS

SEQ ID NO: 11805 - DNA, 21 bp, Artificial Sequence
  Description of Artificial Sequence: Synthetic oligonucleotide
gctgcatccagtttgcaaagt

SEQ ID NO: 11806 - protein, 7 aa, Artificial Sequence
  Description of Artificial Sequence: Synthetic peptide
AASSLQS

SEQ ID NO: 11807 - DNA, 21 bp, Artificial Sequence
  Description of Artificial Sequence: Synthetic oligonucleotide
gctgcatccagtttgcaaagt

SEQ ID NO: 11808 - protein, 7 aa, Artificial Sequence
  Description of Artificial Sequence: Synthetic peptide
AASSLQS

SEQ ID NO: 11809 - DNA, 21 bp, Artificial Sequence
  Description of Artificial Sequence: Synthetic oligonucleotide
ttgggttctaatcgggcctcc

SEQ ID NO: 11810 - protein, 7 aa, Artificial Sequence
  Description of Artificial Sequence: Synthetic peptide
LGSNRAS

SEQ ID NO: 11811 - DNA, 21 bp, Artificial Sequence
  Description of Artificial Sequence: Synthetic oligonucleotide
aaggtttctaactgggactct

SEQ ID NO: 11812 - protein, 7 aa, Artificial Sequence
  Description of Artificial Sequence: Synthetic peptide
KVSNWDS

SEQ ID NO: 11813 - DNA, 21 bp, Artificial Sequence
  Description of Artificial Sequence: Synthetic oligonucleotide
aaggtttctaactgggactct

SEQ ID NO: 11814 - protein, 7 aa, Artificial Sequence
  Description of Artificial Sequence: Synthetic peptide
KVSNWDS

SEQ ID NO: 11815 - DNA, 21 bp, Artificial Sequence
  Description of Artificial Sequence: Synthetic oligonucleotide
aaggtttctaactgggactct

SEQ ID NO: 11816 - protein, 7 aa, Artificial Sequence
  Description of Artificial Sequence: Synthetic peptide
KVSNWDS

SEQ ID NO: 11817 - DNA, 21 bp, Artificial Sequence
  Description of Artificial Sequence: Synthetic oligonucleotide
aaggtttctaactgggactat

SEQ ID NO: 11818 - protein, 7 aa, Artificial Sequence
  Description of Artificial Sequence: Synthetic peptide
KVSNWDY

SEQ ID NO: 11819 - DNA, 21 bp, Artificial Sequence
  Description of Artificial Sequence: Synthetic oligonucleotide
gctgcatccagtttgcaaagt

SEQ ID NO: 11820 - protein, 7 aa, Artificial Sequence
  Description of Artificial Sequence: Synthetic peptide
AASSLQS

SEQ ID NO: 11821 - DNA, 21 bp, Artificial Sequence
  Description of Artificial Sequence: Synthetic oligonucleotide
gctgcatccagtttgcaaagt

SEQ ID NO: 11822 - protein, 7 aa, Artificial Sequence
  Description of Artificial Sequence: Synthetic peptide
AASSLQS

SEQ ID NO: 11823 - DNA, 21 bp, Artificial Sequence
  Description of Artificial Sequence: Synthetic oligonucleotide
gttgcatccggtttgcaaagt

SEQ ID NO: 11824 - protein, 7 aa, Artificial Sequence
  Description of Artificial Sequence: Synthetic peptide
VASGLQS

SEQ ID NO: 11825 - DNA, 21 bp, Artificial Sequence
  Description of Artificial Sequence: Synthetic oligonucleotide
tctgcatccagtttgcaaagt

SEQ ID NO: 11826 - protein, 7 aa, Artificial Sequence
  Description of Artificial Sequence: Synthetic peptide
SASSLQS

SEQ ID NO: 11827 - DNA, 21 bp, Artificial Sequence
  Description of Artificial Sequence: Synthetic oligonucleotide
tctgcatccagtttgcaaagt

SEQ ID NO: 11828 - protein, 7 aa, Artificial Sequence
  Description of Artificial Sequence: Synthetic peptide
SASSLQS

SEQ ID NO: 11829 - DNA, 21 bp, Artificial Sequence
  Description of Artificial Sequence: Synthetic oligonucleotide
aaggtttctaactgggactct

SEQ ID NO: 11830 - protein, 7 aa, Artificial Sequence
  Description of Artificial Sequence: Synthetic peptide
KVSNWDS

SEQ ID NO: 11831 - DNA, 21 bp, Artificial Sequence
  Description of Artificial Sequence: Synthetic oligonucleotide
tctgcatccagtttgcaaagt

SEQ ID NO: 11832 - protein, 7 aa, Artificial Sequence
  Description of Artificial Sequence: Synthetic peptide
SASSLQS

SEQ ID NO: 11833 - DNA, 21 bp, Artificial Sequence
  Description of Artificial Sequence: Synthetic oligonucleotide
gctgcatccagtttgcaaagt

SEQ ID NO: 11834 - protein, 7 aa, Artificial Sequence
  Description of Artificial Sequence: Synthetic peptide
AASSLQS

SEQ ID NO: 11835 - DNA, 21 bp, Artificial Sequence
  Description of Artificial Sequence: Synthetic oligonucleotide
agagcatccagtttgcaaagt

SEQ ID NO: 11836 - protein, 7 aa, Artificial Sequence
  Description of Artificial Sequence: Synthetic peptide
RASSLQS

SEQ ID NO: 11837 - DNA, 21 bp, Artificial Sequence
  Description of Artificial Sequence: Synthetic oligonucleotide
actgcatccagtttgcaaagt

SEQ ID NO: 11838 - protein, 7 aa, Artificial Sequence
  Description of Artificial Sequence: Synthetic peptide
TASSLQS

SEQ ID NO: 11839 - DNA, 21 bp, Artificial Sequence
  Description of Artificial Sequence: Synthetic oligonucleotide
gctgcatccagtttgcaaagt

SEQ ID NO: 11840 - protein, 7 aa, Artificial Sequence
  Description of Artificial Sequence: Synthetic peptide
AASSLQS

SEQ ID NO: 11841 - DNA, 21 bp, Artificial Sequence
  Description of Artificial Sequence: Synthetic oligonucleotide
gctgcatccagttcgcaaagt

SEQ ID NO: 11842 - protein, 7 aa, Artificial Sequence
  Description of Artificial Sequence: Synthetic peptide
AASSSQS

SEQ ID NO: 11843 - DNA, 21 bp, Artificial Sequence
  Description of Artificial Sequence: Synthetic oligonucleotide
aaggtttctaactgggactct

SEQ ID NO: 11844 - protein, 7 aa, Artificial Sequence
  Description of Artificial Sequence: Synthetic peptide
KVSNWDS

SEQ ID NO: 11845 - DNA, 21 bp, Artificial Sequence
  Description of Artificial Sequence: Synthetic oligonucleotide
gatgcatccactttggaaaca

SEQ ID NO: 11846 - protein, 7 aa, Artificial Sequence
  Description of Artificial Sequence: Synthetic peptide
DASTLET

SEQ ID NO: 11847 - DNA, 21 bp, Artificial Sequence
  Description of Artificial Sequence: Synthetic oligonucleotide
ttgggttctaatcgggcctcc

SEQ ID NO: 11848 - protein, 7 aa, Artificial Sequence
  Description of Artificial Sequence: Synthetic peptide
LGSNRAS

SEQ ID NO: 11849 - DNA, 21 bp, Artificial Sequence
  Description of Artificial Sequence: Synthetic oligonucleotide
ggtgcatccaccagggccact

SEQ ID NO: 11850 - protein, 7 aa, Artificial Sequence
  Description of Artificial Sequence: Synthetic peptide
GASTRAT

SEQ ID NO: 11851 - DNA, 21 bp, Artificial Sequence
  Description of Artificial Sequence: Synthetic oligonucleotide
ggtgcatccagccgggccact

SEQ ID NO: 11852 - protein, 7 aa, Artificial Sequence
  Description of Artificial Sequence: Synthetic peptide
GASSRAT

SEQ ID NO: 11853 - DNA, 21 bp, Artificial Sequence
  Description of Artificial Sequence: Synthetic oligonucleotide
gctgcatccagtttgcaaagt

SEQ ID NO: 11854 - protein, 7 aa, Artificial Sequence
  Description of Artificial Sequence: Synthetic peptide
AASSLQS

SEQ ID NO: 11855 - DNA, 21 bp, Artificial Sequence
  Description of Artificial Sequence: Synthetic oligonucleotide
ggtgcatccagccggtccact

SEQ ID NO: 11856 - protein, 7 aa, Artificial Sequence
  Description of Artificial Sequence: Synthetic peptide
GASSRST

SEQ ID NO: 11857 - DNA, 21 bp, Artificial Sequence
  Description of Artificial Sequence: Synthetic oligonucleotide
ggtgcatccagccgggccact

SEQ ID NO: 11858 - protein, 7 aa, Artificial Sequence
  Description of Artificial Sequence: Synthetic peptide
GASSRAT

SEQ ID NO: 11859 - DNA, 21 bp, Artificial Sequence
  Description of Artificial Sequence: Synthetic oligonucleotide
ggtgcatccatcagggccact

SEQ ID NO: 11860 - protein, 7 aa, Artificial Sequence
  Description of Artificial Sequence: Synthetic peptide
GASIRAT

SEQ ID NO: 11861 - DNA, 21 bp, Artificial Sequence
  Description of Artificial Sequence: Synthetic oligonucleotide
ggtgcatccagcagggcccct

SEQ ID NO: 11862 - protein, 7 aa, Artificial Sequence
  Description of Artificial Sequence: Synthetic peptide
GASSRAP

SEQ ID NO: 11863 - DNA, 21 bp, Artificial Sequence
  Description of Artificial Sequence: Synthetic oligonucleotide
ggtgcatccagccgggccact

SEQ ID NO: 11864 - protein, 7 aa, Artificial Sequence
  Description of Artificial Sequence: Synthetic peptide
GASSRAT

SEQ ID NO: 11865 - DNA, 21 bp, Artificial Sequence
  Description of Artificial Sequence: Synthetic oligonucleotide
gatgcatccagtttgcaaagt

SEQ ID NO: 11866 - protein, 7 aa, Artificial Sequence
  Description of Artificial Sequence: Synthetic peptide
DASSLQS

SEQ ID NO: 11867 - DNA, 21 bp, Artificial Sequence
  Description of Artificial Sequence: Synthetic oligonucleotide
ggtgcatccagccggtccact

SEQ ID NO: 11868 - protein, 7 aa, Artificial Sequence
  Description of Artificial Sequence: Synthetic peptide
GASSRST

SEQ ID NO: 11869 - DNA, 21 bp, Artificial Sequence
  Description of Artificial Sequence: Synthetic oligonucleotide
tgggcatctacccgggaatcc

SEQ ID NO: 11870 - protein, 7 aa, Artificial Sequence
  Description of Artificial Sequence: Synthetic peptide
WASTRES

SEQ ID NO: 11871 - DNA, 21 bp, Artificial Sequence
  Description of Artificial Sequence: Synthetic oligonucleotide
tgggcatctacccgggaatcc

SEQ ID NO: 11872 - protein, 7 aa, Artificial Sequence
  Description of Artificial Sequence: Synthetic peptide
WASTRES

SEQ ID NO: 11873 - DNA, 21 bp, Artificial Sequence
  Description of Artificial Sequence: Synthetic oligonucleotide
tgggcatctacccgggaatcc

SEQ ID NO: 11874 - protein, 7 aa, Artificial Sequence
  Description of Artificial Sequence: Synthetic peptide
WASTRES

SEQ ID NO: 11875 - DNA, 21 bp, Artificial Sequence
  Description of Artificial Sequence: Synthetic oligonucleotide
ggtgcatccagccgggccact

SEQ ID NO: 11876 - protein, 7 aa, Artificial Sequence
  Description of Artificial Sequence: Synthetic peptide
GASSRAT

SEQ ID NO: 11877 - DNA, 21 bp, Artificial Sequence
  Description of Artificial Sequence: Synthetic oligonucleotide
ttgggttctaatcgggcctcc

SEQ ID NO: 11878 - protein, 7 aa, Artificial Sequence
  Description of Artificial Sequence: Synthetic peptide
LGSNRAS

SEQ ID NO: 11879 - DNA, 21 bp, Artificial Sequence
  Description of Artificial Sequence: Synthetic oligonucleotide
ggtgcatccaccagggccact

SEQ ID NO: 11880 - protein, 7 aa, Artificial Sequence
  Description of Artificial Sequence: Synthetic peptide
GASTRAT

SEQ ID NO: 11881 - DNA, 21 bp, Artificial Sequence
  Description of Artificial Sequence: Synthetic oligonucleotide
tgggcatctactcgggaatcc

SEQ ID NO: 11882 - protein, 7 aa, Artificial Sequence
  Description of Artificial Sequence: Synthetic peptide
WASTRES

SEQ ID NO: 11883 - DNA, 21 bp, Artificial Sequence
  Description of Artificial Sequence: Synthetic oligonucleotide
ggtgcatccagcagggccact

SEQ ID NO: 11884 - protein, 7 aa, Artificial Sequence
  Description of Artificial Sequence: Synthetic peptide
GASSRAT

SEQ ID NO: 11885 - DNA, 21 bp, Artificial Sequence
  Description of Artificial Sequence: Synthetic oligonucleotide
gctgcatccagtttgcaaagt

SEQ ID NO: 11886 - protein, 7 aa, Artificial Sequence
  Description of Artificial Sequence: Synthetic peptide
AASSLQS

SEQ ID NO: 11887 - DNA, 21 bp, Artificial Sequence
  Description of Artificial Sequence: Synthetic oligonucleotide
tgggcatctacccgggaatcc

SEQ ID NO: 11888 - protein, 7 aa, Artificial Sequence
  Description of Artificial Sequence: Synthetic peptide
WASTRES

SEQ ID NO: 11889 - DNA, 21 bp, Artificial Sequence
  Description of Artificial Sequence: Synthetic oligonucleotide
tgggcatctacccgggaatcc

SEQ ID NO: 11890 - protein, 7 aa, Artificial Sequence
  Description of Artificial Sequence: Synthetic peptide
WASTRES

SEQ ID NO: 11891 - DNA, 21 bp, Artificial Sequence
  Description of Artificial Sequence: Synthetic oligonucleotide
tgggcatctacccgggaatcc

SEQ ID NO: 11892 - protein, 7 aa, Artificial Sequence
  Description of Artificial Sequence: Synthetic peptide
WASTRES

SEQ ID NO: 11893 - DNA, 21 bp, Artificial Sequence
  Description of Artificial Sequence: Synthetic oligonucleotide
tgggcatctacccgggaatcc

SEQ ID NO: 11894 - protein, 7 aa, Artificial Sequence
  Description of Artificial Sequence: Synthetic peptide
WASTRES

SEQ ID NO: 11895 - DNA, 21 bp, Artificial Sequence
  Description of Artificial Sequence: Synthetic oligonucleotide
tgggcatctacccgggaatcc

SEQ ID NO: 11896 - protein, 7 aa, Artificial Sequence
  Description of Artificial Sequence: Synthetic peptide
WASTRES

SEQ ID NO: 11897 - DNA, 21 bp, Artificial Sequence
  Description of Artificial Sequence: Synthetic oligonucleotide
tgggcatctacccgggaatcc

SEQ ID NO: 11898 - protein, 7 aa, Artificial Sequence
  Description of Artificial Sequence: Synthetic peptide
WASTRES

SEQ ID NO: 11899 - DNA, 21 bp, Artificial Sequence
  Description of Artificial Sequence: Synthetic oligonucleotide
tgggcatctacccgggaatcc

SEQ ID NO: 11900 - protein, 7 aa, Artificial Sequence
  Description of Artificial Sequence: Synthetic peptide
WASTRES

SEQ ID NO: 11901 - DNA, 21 bp, Artificial Sequence
  Description of Artificial Sequence: Synthetic oligonucleotide
tgggcatctacccgggaatcc

SEQ ID NO: 11902 - protein, 7 aa, Artificial Sequence
  Description of Artificial Sequence: Synthetic peptide
WASTRES

SEQ ID NO: 11903 - DNA, 21 bp, Artificial Sequence
  Description of Artificial Sequence: Synthetic oligonucleotide
tgggcatctacccgggaatcc

SEQ ID NO: 11904 - protein, 7 aa, Artificial Sequence
  Description of Artificial Sequence: Synthetic peptide
WASTRES

SEQ ID NO: 11905 - DNA, 21 bp, Artificial Sequence
  Description of Artificial Sequence: Synthetic oligonucleotide
tgggcatctacccgggaatcc

SEQ ID NO: 11906 - protein, 7 aa, Artificial Sequence
  Description of Artificial Sequence: Synthetic peptide
WASTRES

SEQ ID NO: 11907 - DNA, 21 bp, Artificial Sequence
  Description of Artificial Sequence: Synthetic oligonucleotide
tgggcatctacccgggaatcc

SEQ ID NO: 11908 - protein, 7 aa, Artificial Sequence
  Description of Artificial Sequence: Synthetic peptide
WASTRES

SEQ ID NO: 11909 - DNA, 21 bp, Artificial Sequence
  Description of Artificial Sequence: Synthetic oligonucleotide
tgggcatctacccgggaatcc

SEQ ID NO: 11910 - protein, 7 aa, Artificial Sequence
  Description of Artificial Sequence: Synthetic peptide
WASTRES

SEQ ID NO: 11911 - DNA, 21 bp, Artificial Sequence
  Description of Artificial Sequence: Synthetic oligonucleotide
tgggcatctacccgggaatcc

SEQ ID NO: 11912 - protein, 7 aa, Artificial Sequence
  Description of Artificial Sequence: Synthetic peptide
WASTRES

SEQ ID NO: 11913 - DNA, 21 bp, Artificial Sequence
  Description of Artificial Sequence: Synthetic oligonucleotide
tgggcatctacccgggaatcc

SEQ ID NO: 11914 - protein, 7 aa, Artificial Sequence
  Description of Artificial Sequence: Synthetic peptide
WASTRES

SEQ ID NO: 11915 - DNA, 21 bp, Artificial Sequence
  Description of Artificial Sequence: Synthetic oligonucleotide
tgggcatctacccgggaatcc

SEQ ID NO: 11916 - protein, 7 aa, Artificial Sequence
  Description of Artificial Sequence: Synthetic peptide
WASTRES

SEQ ID NO: 11917 - DNA, 21 bp, Artificial Sequence
  Description of Artificial Sequence: Synthetic oligonucleotide
tgggcatctacccgggaatcc

SEQ ID NO: 11918 - protein, 7 aa, Artificial Sequence
  Description of Artificial Sequence: Synthetic peptide
WASTRES

SEQ ID NO: 11919 - DNA, 21 bp, Artificial Sequence
  Description of Artificial Sequence: Synthetic oligonucleotide
tgggcatctacccgggaatcc

SEQ ID NO: 11920 - protein, 7 aa, Artificial Sequence
  Description of Artificial Sequence: Synthetic peptide
WASTRES

SEQ ID NO: 11921 - DNA, 21 bp, Artificial Sequence
  Description of Artificial Sequence: Synthetic oligonucleotide
tgggcatctacccgggaatcc

SEQ ID NO: 11922 - protein, 7 aa, Artificial Sequence
  Description of Artificial Sequence: Synthetic peptide
WASTRES

SEQ ID NO: 11923 - DNA, 21 bp, Artificial Sequence
  Description of Artificial Sequence: Synthetic oligonucleotide
tgggcatctacccgggaatcc

SEQ ID NO: 11924 - protein, 7 aa, Artificial Sequence
  Description of Artificial Sequence: Synthetic peptide
WASTRES

SEQ ID NO: 11925 - DNA, 21 bp, Artificial Sequence
  Description of Artificial Sequence: Synthetic oligonucleotide
tgggcatctacccgggaatcc

SEQ ID NO: 11926 - protein, 7 aa, Artificial Sequence
  Description of Artificial Sequence: Synthetic peptide
WASTRES

SEQ ID NO: 11927 - DNA, 21 bp, Artificial Sequence
  Description of Artificial Sequence: Synthetic oligonucleotide
tgggcatctacccgggaatcc

SEQ ID NO: 11928 - protein, 7 aa, Artificial Sequence
  Description of Artificial Sequence: Synthetic peptide
WASTRES

SEQ ID NO: 11929 - DNA, 21 bp, Artificial Sequence
  Description of Artificial Sequence: Synthetic oligonucleotide
tgggcatctacccgggaatcc

SEQ ID NO: 11930 - protein, 7 aa, Artificial Sequence
  Description of Artificial Sequence: Synthetic peptide
WASTRES

SEQ ID NO: 11931 - DNA, 21 bp, Artificial Sequence
  Description of Artificial Sequence: Synthetic oligonucleotide
tgggcatctacccgggaatcc

SEQ ID NO: 11932 - protein, 7 aa, Artificial Sequence
  Description of Artificial Sequence: Synthetic peptide
WASTRES

SEQ ID NO: 11933 - DNA, 21 bp, Artificial Sequence
  Description of Artificial Sequence: Synthetic oligonucleotide
tgggcatctacccgggaatcc

SEQ ID NO: 11934 - protein, 7 aa, Artificial Sequence
  Description of Artificial Sequence: Synthetic peptide
WASTRES

SEQ ID NO: 11935 - DNA, 21 bp, Artificial Sequence
  Description of Artificial Sequence: Synthetic oligonucleotide
tgggcatctacccgggaatcc

SEQ ID NO: 11936 - protein, 7 aa, Artificial Sequence
  Description of Artificial Sequence: Synthetic peptide
WASTRES

SEQ ID NO: 11937 - DNA, 21 bp, Artificial Sequence
  Description of Artificial Sequence: Synthetic oligonucleotide
tgggcatctacccgggaatcc

SEQ ID NO: 11938 - protein, 7 aa, Artificial Sequence
  Description of Artificial Sequence: Synthetic peptide
WASTRES

SEQ ID NO: 11939 - DNA, 21 bp, Artificial Sequence
  Description of Artificial Sequence: Synthetic oligonucleotide
tgggcatctacccgggaatcc

SEQ ID NO: 11940 - protein, 7 aa, Artificial Sequence
  Description of Artificial Sequence: Synthetic peptide
WASTRES

SEQ ID NO: 11941 - DNA, 21 bp, Artificial Sequence
  Description of Artificial Sequence: Synthetic oligonucleotide
tgggcatctacccgggaatcc

SEQ ID NO: 11942 - protein, 7 aa, Artificial Sequence
  Description of Artificial Sequence: Synthetic peptide
WASTRES

SEQ ID NO: 11943 - DNA, 21 bp, Artificial Sequence
  Description of Artificial Sequence: Synthetic oligonucleotide
tgggcatctacccgggaatcc

SEQ ID NO: 11944 - protein, 7 aa, Artificial Sequence
  Description of Artificial Sequence: Synthetic peptide
WASTRES

SEQ ID NO: 11945 - DNA, 21 bp, Artificial Sequence
  Description of Artificial Sequence: Synthetic oligonucleotide
tgggcatctacccgggaatcc

SEQ ID NO: 11946 - protein, 7 aa, Artificial Sequence
  Description of Artificial Sequence: Synthetic peptide
WASTRES

SEQ ID NO: 11947 - DNA, 21 bp, Artificial Sequence
  Description of Artificial Sequence: Synthetic oligonucleotide
ggtgcatccagtttgcaaagt

SEQ ID NO: 11948 - protein, 7 aa, Artificial Sequence
  Description of Artificial Sequence: Synthetic peptide
GASSLQS

SEQ ID NO: 11949 - DNA, 21 bp, Artificial Sequence
  Description of Artificial Sequence: Synthetic oligonucleotide
ggtgcatccagtttgcaaagt

SEQ ID NO: 11950 - protein, 7 aa, Artificial Sequence
  Description of Artificial Sequence: Synthetic peptide
GASSLQS

SEQ ID NO: 11951 - DNA, 21 bp, Artificial Sequence
  Description of Artificial Sequence: Synthetic oligonucleotide
ggtgcatccagtttgcaaagt

SEQ ID NO: 11952 - protein, 7 aa, Artificial Sequence
  Description of Artificial Sequence: Synthetic peptide
GASSLQS

SEQ ID NO: 11953 - DNA, 21 bp, Artificial Sequence
  Description of Artificial Sequence: Synthetic oligonucleotide
ggtgcatccagtttgcaaagt

SEQ ID NO: 11954 - protein, 7 aa, Artificial Sequence
  Description of Artificial Sequence: Synthetic peptide
GASSLQS

SEQ ID NO: 11955 - DNA, 21 bp, Artificial Sequence
  Description of Artificial Sequence: Synthetic oligonucleotide
ggtgcatccagtttgcaaagt

SEQ ID NO: 11956 - protein, 7 aa, Artificial Sequence
  Description of Artificial Sequence: Synthetic peptide
GASSLQS

SEQ ID NO: 11957 - DNA, 21 bp, Artificial Sequence
  Description of Artificial Sequence: Synthetic oligonucleotide
ggtgcatccagtttgcaaagt

SEQ ID NO: 11958 - protein, 7 aa, Artificial Sequence
  Description of Artificial Sequence: Synthetic peptide
GASSLQS

SEQ ID NO: 11959 - DNA, 21 bp, Artificial Sequence
  Description of Artificial Sequence: Synthetic oligonucleotide
ggtgcatccagtttgcaaagt

SEQ ID NO: 11960 - protein, 7 aa, Artificial Sequence
  Description of Artificial Sequence: Synthetic peptide
GASSLQS

SEQ ID NO: 11961 - DNA, 21 bp, Artificial Sequence
  Description of Artificial Sequence: Synthetic oligonucleotide
ggtgcatccagtttgcaaagt

SEQ ID NO: 11962 - protein, 7 aa, Artificial Sequence
  Description of Artificial Sequence: Synthetic peptide
GASSLQS

SEQ ID NO: 11963 - DNA, 21 bp, Artificial Sequence
  Description of Artificial Sequence: Synthetic oligonucleotide
gctgcatccagtttgcaaagt

SEQ ID NO: 11964 - protein, 7 aa, Artificial Sequence
  Description of Artificial Sequence: Synthetic peptide
AASSLQS

SEQ ID NO: 11965 - DNA, 21 bp, Artificial Sequence
  Description of Artificial Sequence: Synthetic oligonucleotide
gctgcatccagtttgcaaagt

SEQ ID NO: 11966 - protein, 7 aa, Artificial Sequence
  Description of Artificial Sequence: Synthetic peptide
AASSLQS

SEQ ID NO: 11967 - DNA, 21 bp, Artificial Sequence
  Description of Artificial Sequence: Synthetic oligonucleotide
gctgcatccagtttgcaaagt

SEQ ID NO: 11968 - protein, 7 aa, Artificial Sequence
  Description of Artificial Sequence: Synthetic peptide
AASSLQS

SEQ ID NO: 11969 - DNA, 21 bp, Artificial Sequence
  Description of Artificial Sequence: Synthetic oligonucleotide
gctgcatccagtttgcaaagt

SEQ ID NO: 11970 - protein, 7 aa, Artificial Sequence
  Description of Artificial Sequence: Synthetic peptide
AASSLQS

SEQ ID NO: 11971 - DNA, 21 bp, Artificial Sequence
  Description of Artificial Sequence: Synthetic oligonucleotide
gctgcatccagtttgcaaagt

SEQ ID NO: 11972 - protein, 7 aa, Artificial Sequence
  Description of Artificial Sequence: Synthetic peptide
AASSLQS

SEQ ID NO: 11973 - DNA, 21 bp, Artificial Sequence
  Description of Artificial Sequence: Synthetic oligonucleotide
gctgcatccagtttgcaaagt

SEQ ID NO: 11974 - protein, 7 aa, Artificial Sequence
  Description of Artificial Sequence: Synthetic peptide
AASSLQS

SEQ ID NO: 11975 - DNA, 21 bp, Artificial Sequence
  Description of Artificial Sequence: Synthetic oligonucleotide
gctgcatccagtttgcaaagt

SEQ ID NO: 11976 - protein, 7 aa, Artificial Sequence
  Description of Artificial Sequence: Synthetic peptide
AASSLQS

SEQ ID NO: 11977 - DNA, 21 bp, Artificial Sequence
  Description of Artificial Sequence: Synthetic oligonucleotide
gctgcatccagtttgcaaagt

SEQ ID NO: 11978 - protein, 7 aa, Artificial Sequence
  Description of Artificial Sequence: Synthetic peptide
AASSLQS

SEQ ID NO: 11979 - DNA, 21 bp, Artificial Sequence
  Description of Artificial Sequence: Synthetic oligonucleotide
gctgcatccagtttgcaaagt

SEQ ID NO: 11980 - protein, 7 aa, Artificial Sequence
  Description of Artificial Sequence: Synthetic peptide
AASSLQS

SEQ ID NO: 11981 - DNA, 21 bp, Artificial Sequence
  Description of Artificial Sequence: Synthetic oligonucleotide
gctgcatccagtttgcaaagt

SEQ ID NO: 11982 - protein, 7 aa, Artificial Sequence
  Description of Artificial Sequence: Synthetic peptide
AASSLQS

SEQ ID NO: 11983 - DNA, 21 bp, Artificial Sequence
  Description of Artificial Sequence: Synthetic oligonucleotide
gctgcatccagtttgcaaagt

SEQ ID NO: 11984 - protein, 7 aa, Artificial Sequence
  Description of Artificial Sequence: Synthetic peptide
AASSLQS

SEQ ID NO: 11985 - DNA, 21 bp, Artificial Sequence
  Description of Artificial Sequence: Synthetic oligonucleotide
gctgcatccagtttgcaaagt

SEQ ID NO: 11986 - protein, 7 aa, Artificial Sequence
  Description of Artificial Sequence: Synthetic peptide
AASSLQS

SEQ ID NO: 11987 - DNA, 21 bp, Artificial Sequence
  Description of Artificial Sequence: Synthetic oligonucleotide
gctgcatccagtttgcaaagt

SEQ ID NO: 11988 - protein, 7 aa, Artificial Sequence
  Description of Artificial Sequence: Synthetic peptide
AASSLQS

SEQ ID NO: 11989 - DNA, 21 bp, Artificial Sequence
  Description of Artificial Sequence: Synthetic oligonucleotide
gctgcatccagtttgcaaagt

SEQ ID NO: 11990 - protein, 7 aa, Artificial Sequence
  Description of Artificial Sequence: Synthetic peptide
AASSLQS

SEQ ID NO: 11991 - DNA, 21 bp, Artificial Sequence
  Description of Artificial Sequence: Synthetic oligonucleotide
actgcatccagtttgcaaagt

SEQ ID NO: 11992 - protein, 7 aa, Artificial Sequence
  Description of Artificial Sequence: Synthetic peptide
TASSLQS

SEQ ID NO: 11993 - DNA, 21 bp, Artificial Sequence
  Description of Artificial Sequence: Synthetic oligonucleotide
actgcatccagtttgcaaagt

SEQ ID NO: 11994 - protein, 7 aa, Artificial Sequence
  Description of Artificial Sequence: Synthetic peptide
TASSLQS

SEQ ID NO: 11995 - DNA, 21 bp, Artificial Sequence
  Description of Artificial Sequence: Synthetic oligonucleotide
actgcatccagtttgcaaagt

SEQ ID NO: 11996 - protein, 7 aa, Artificial Sequence
  Description of Artificial Sequence: Synthetic peptide
TASSLQS

SEQ ID NO: 11997 - DNA, 21 bp, Artificial Sequence
  Description of Artificial Sequence: Synthetic oligonucleotide
actgcatccagtttgcaaagt

SEQ ID NO: 11998 - protein, 7 aa, Artificial Sequence
  Description of Artificial Sequence: Synthetic peptide
TASSLQS

SEQ ID NO: 11999 - DNA, 21 bp, Artificial Sequence
  Description of Artificial Sequence: Synthetic oligonucleotide
actgcatccagtttgcaaagt

SEQ ID NO: 12000 - protein, 7 aa, Artificial Sequence
  Description of Artificial Sequence: Synthetic peptide
TASSLQS

SEQ ID NO: 12001 - DNA, 21 bp, Artificial Sequence
  Description of Artificial Sequence: Synthetic oligonucleotide
actgcatccagtttgcaaagt

SEQ ID NO: 12002 - protein, 7 aa, Artificial Sequence
  Description of Artificial Sequence: Synthetic peptide
TASSLQS

SEQ ID NO: 12003 - DNA, 21 bp, Artificial Sequence
  Description of Artificial Sequence: Synthetic oligonucleotide
actgcatccagtttgcaaagt

SEQ ID NO: 12004 - protein, 7 aa, Artificial Sequence
  Description of Artificial Sequence: Synthetic peptide
TASSLQS

SEQ ID NO: 12005 - DNA, 21 bp, Artificial Sequence
  Description of Artificial Sequence: Synthetic oligonucleotide
actgcatccagtttgcaaagt

SEQ ID NO: 12006 - protein, 7 aa, Artificial Sequence
  Description of Artificial Sequence: Synthetic peptide
TASSLQS

SEQ ID NO: 12007 - DNA, 21 bp, Artificial Sequence
  Description of Artificial Sequence: Synthetic oligonucleotide
actgcatccagtttgcaaagt

SEQ ID NO: 12008 - protein, 7 aa, Artificial Sequence
  Description of Artificial Sequence: Synthetic peptide
TASSLQS

SEQ ID NO: 12009 - DNA, 21 bp, Artificial Sequence
  Description of Artificial Sequence: Synthetic oligonucleotide
actgcatccagtttgcaaagt

SEQ ID NO: 12010 - protein, 7 aa, Artificial Sequence
  Description of Artificial Sequence: Synthetic peptide
TASSLQS

SEQ ID NO: 12011 - DNA, 21 bp, Artificial Sequence
  Description of Artificial Sequence: Synthetic oligonucleotide
actgcatccagtttgcaaagt

SEQ ID NO: 12012 - protein, 7 aa, Artificial Sequence
  Description of Artificial Sequence: Synthetic peptide
TASSLQS

SEQ ID NO: 12013 - DNA, 21 bp, Artificial Sequence
  Description of Artificial Sequence: Synthetic oligonucleotide
actgcatccagtttgcaaagt

SEQ ID NO: 12014 - protein, 7 aa, Artificial Sequence
  Description of Artificial Sequence: Synthetic peptide
TASSLQS

SEQ ID NO: 12015 - DNA, 21 bp, Artificial Sequence
  Description of Artificial Sequence: Synthetic oligonucleotide
actgcatccagtttgcaaagt

SEQ ID NO: 12016 - protein, 7 aa, Artificial Sequence
  Description of Artificial Sequence: Synthetic peptide
TASSLQS

SEQ ID NO: 12017 - DNA, 21 bp, Artificial Sequence
  Description of Artificial Sequence: Synthetic oligonucleotide
actgcatccagtttgcaaagt

SEQ ID NO: 12018 - protein, 7 aa, Artificial Sequence
  Description of Artificial Sequence: Synthetic peptide
TASSLQS

SEQ ID NO: 12019 - DNA, 21 bp, Artificial Sequence
  Description of Artificial Sequence: Synthetic oligonucleotide
actgcatccagtttgcaaagt

SEQ ID NO: 12020 - protein, 7 aa, Artificial Sequence
  Description of Artificial Sequence: Synthetic peptide
TASSLQS

SEQ ID NO: 12021 - DNA, 21 bp, Artificial Sequence
  Description of Artificial Sequence: Synthetic oligonucleotide
actgcatccagtttgcaaagt

SEQ ID NO: 12022 - protein, 7 aa, Artificial Sequence
  Description of Artificial Sequence: Synthetic peptide
TASSLQS

SEQ ID NO: 12023 - DNA, 21 bp, Artificial Sequence
  Description of Artificial Sequence: Synthetic oligonucleotide
actgcatccagtttgcaaagt

SEQ ID NO: 12024 - protein, 7 aa, Artificial Sequence
  Description of Artificial Sequence: Synthetic peptide
TASSLQS

SEQ ID NO: 12025 - DNA, 21 bp, Artificial Sequence
  Description of Artificial Sequence: Synthetic oligonucleotide
actgcatccagtttgcaaagt

SEQ ID NO: 12026 - protein, 7 aa, Artificial Sequence
  Description of Artificial Sequence: Synthetic peptide
TASSLQS

SEQ ID NO: 12027 - DNA, 21 bp, Artificial Sequence
  Description of Artificial Sequence: Synthetic oligonucleotide
actgcatccagtttgcaaagt

SEQ ID NO: 12028 - protein, 7 aa, Artificial Sequence
  Description of Artificial Sequence: Synthetic peptide
TASSLQS

SEQ ID NO: 12029 - DNA, 21 bp, Artificial Sequence
  Description of Artificial Sequence: Synthetic oligonucleotide
actgcatccagtttgcaaagt

SEQ ID NO: 12030 - protein, 7 aa, Artificial Sequence
  Description of Artificial Sequence: Synthetic peptide
TASSLQS

SEQ ID NO: 12031 - DNA, 21 bp, Artificial Sequence
  Description of Artificial Sequence: Synthetic oligonucleotide
actgcatccagtttgcaaagt

SEQ ID NO: 12032 - protein, 7 aa, Artificial Sequence
  Description of Artificial Sequence: Synthetic peptide
TASSLQS

SEQ ID NO: 12033 - DNA, 21 bp, Artificial Sequence
  Description of Artificial Sequence: Synthetic oligonucleotide
ggtgtatctagttgggccact

SEQ ID NO: 12034 - protein, 7 aa, Artificial Sequence
  Description of Artificial Sequence: Synthetic peptide
GVSSWAT

SEQ ID NO: 12035 - DNA, 21 bp, Artificial Sequence
  Description of Artificial Sequence: Synthetic oligonucleotide
ggtaacagcaatcggccctca

SEQ ID NO: 12036 - protein, 7 aa, Artificial Sequence
  Description of Artificial Sequence: Synthetic peptide
GNSNRPS

SEQ ID NO: 12037 - DNA, 21 bp, Artificial Sequence
  Description of Artificial Sequence: Synthetic oligonucleotide
aaggtttctaactgggactct

SEQ ID NO: 12038 - protein, 7 aa, Artificial Sequence
  Description of Artificial Sequence: Synthetic peptide
KVSNWDS

SEQ ID NO: 12039 - DNA, 21 bp, Artificial Sequence
  Description of Artificial Sequence: Synthetic oligonucleotide
tgggcatctacccgggaatcc

SEQ ID NO: 12040 - protein, 7 aa, Artificial Sequence
  Description of Artificial Sequence: Synthetic peptide
WASTRES

SEQ ID NO: 12041 - DNA, 21 bp, Artificial Sequence
  Description of Artificial Sequence: Synthetic oligonucleotide
ggtgcatccagtttgcaaagt

SEQ ID NO: 12042 - protein, 7 aa, Artificial Sequence
  Description of Artificial Sequence: Synthetic peptide
GASSLQS

SEQ ID NO: 12043 - DNA, 21 bp, Artificial Sequence
  Description of Artificial Sequence: Synthetic oligonucleotide
actgcatccagtttgcaaagt

SEQ ID NO: 12044 - protein, 7 aa, Artificial Sequence
  Description of Artificial Sequence: Synthetic peptide
TASSLQS

SEQ ID NO: 12045 - DNA, 21 bp, Artificial Sequence
  Description of Artificial Sequence: Synthetic oligonucleotide
tgggcatctacccgggaatcc

SEQ ID NO: 12046 - protein, 7 aa, Artificial Sequence
  Description of Artificial Sequence: Synthetic peptide
WASTRES

SEQ ID NO: 12047 - DNA, 21 bp, Artificial Sequence
  Description of Artificial Sequence: Synthetic oligonucleotide
tggacatctacccgggaatcc

SEQ ID NO: 12048 - protein, 7 aa, Artificial Sequence
  Description of Artificial Sequence: Synthetic peptide
WTSTRES

SEQ ID NO: 12049 - DNA, 21 bp, Artificial Sequence
  Description of Artificial Sequence: Synthetic oligonucleotide
ggtgcatccaccagggccact

SEQ ID NO: 12050 - protein, 7 aa, Artificial Sequence
  Description of Artificial Sequence: Synthetic peptide
GASTRAT

SEQ ID NO: 12051 - DNA, 21 bp, Artificial Sequence
  Description of Artificial Sequence: Synthetic oligonucleotide
actgcatccagtttgcaaagt

SEQ ID NO: 12052 - protein, 7 aa, Artificial Sequence
  Description of Artificial Sequence: Synthetic peptide
TASSLQS

SEQ ID NO: 12053 - DNA, 21 bp, Artificial Sequence
  Description of Artificial Sequence: Synthetic oligonucleotide
caagatagcaagcggccctca

SEQ ID NO: 12054 - protein, 7 aa, Artificial Sequence
  Description of Artificial Sequence: Synthetic peptide
QDSKRPS

SEQ ID NO: 12055 - DNA, 21 bp, Artificial Sequence
  Description of Artificial Sequence: Synthetic oligonucleotide
caagatagtaagcggccctca

SEQ ID NO: 12056 - protein, 7 aa, Artificial Sequence
  Description of Artificial Sequence: Synthetic peptide
QDSKRPS

SEQ ID NO: 12057 - DNA, 21 bp, Artificial Sequence
  Description of Artificial Sequence: Synthetic oligonucleotide
agtaatgatcagcggccctca

SEQ ID NO: 12058 - protein, 7 aa, Artificial Sequence
  Description of Artificial Sequence: Synthetic peptide
SNDQRPS

SEQ ID NO: 12059 - DNA, 21 bp, Artificial Sequence
  Description of Artificial Sequence: Synthetic oligonucleotide
agtaatgatcagcggccctca

SEQ ID NO: 12060 - protein, 7 aa, Artificial Sequence
  Description of Artificial Sequence: Synthetic peptide
SNDQRPS

SEQ ID NO: 12061 - DNA, 21 bp, Artificial Sequence
  Description of Artificial Sequence: Synthetic oligonucleotide
agtaatgatcagcggccctca

SEQ ID NO: 12062 - protein, 7 aa, Artificial Sequence
  Description of Artificial Sequence: Synthetic peptide
SNDQRPS

SEQ ID NO: 12063 - DNA, 21 bp, Artificial Sequence
  Description of Artificial Sequence: Synthetic oligonucleotide
caagataacaggcggccgtca

SEQ ID NO: 12064 - protein, 7 aa, Artificial Sequence
  Description of Artificial Sequence: Synthetic peptide
QDNRRPS

SEQ ID NO: 12065 - DNA, 21 bp, Artificial Sequence
  Description of Artificial Sequence: Synthetic oligonucleotide
caagatcgcaagcggccctca

SEQ ID NO: 12066 - protein, 7 aa, Artificial Sequence
  Description of Artificial Sequence: Synthetic peptide
QDRKRPS

SEQ ID NO: 12067 - DNA, 21 bp, Artificial Sequence
  Description of Artificial Sequence: Synthetic oligonucleotide
gctgcatccagtttgcaaagt

SEQ ID NO: 12068 - protein, 7 aa, Artificial Sequence
  Description of Artificial Sequence: Synthetic peptide
AASSLQS

SEQ ID NO: 12069 - DNA, 21 bp, Artificial Sequence
  Description of Artificial Sequence: Synthetic oligonucleotide
tgggcatctacccgggaatcc

SEQ ID NO: 12070 - protein, 7 aa, Artificial Sequence
  Description of Artificial Sequence: Synthetic peptide
WASTRES

SEQ ID NO: 12071 - DNA, 21 bp, Artificial Sequence
  Description of Artificial Sequence: Synthetic oligonucleotide
ggtgcatccaccagggccact

SEQ ID NO: 12072 - protein, 7 aa, Artificial Sequence
  Description of Artificial Sequence: Synthetic peptide
GASTRAT

SEQ ID NO: 12073 - DNA, 21 bp, Artificial Sequence
  Description of Artificial Sequence: Synthetic oligonucleotide
gctgcatccagtttgcaaagt

SEQ ID NO: 12074 - protein, 7 aa, Artificial Sequence
  Description of Artificial Sequence: Synthetic peptide
AASSLQS

SEQ ID NO: 12075 - DNA, 21 bp, Artificial Sequence
  Description of Artificial Sequence: Synthetic oligonucleotide
ggggcatccagcagggccact

SEQ ID NO: 12076 - protein, 7 aa, Artificial Sequence
  Description of Artificial Sequence: Synthetic peptide
GASSRAT

SEQ ID NO: 12077 - DNA, 21 bp, Artificial Sequence
  Description of Artificial Sequence: Synthetic oligonucleotide
tggacatctacccgggaatcc

SEQ ID NO: 12078 - protein, 7 aa, Artificial Sequence
  Description of Artificial Sequence: Synthetic peptide
WTSTRES

SEQ ID NO: 12079 - DNA, 21 bp, Artificial Sequence
  Description of Artificial Sequence: Synthetic oligonucleotide
tggacatctacccgggaatcc

SEQ ID NO: 12080 - protein, 7 aa, Artificial Sequence
  Description of Artificial Sequence: Synthetic peptide
WTSTRES

SEQ ID NO: 12081 - DNA, 21 bp, Artificial Sequence
  Description of Artificial Sequence: Synthetic oligonucleotide
tgggcatctactcgggaatcc

SEQ ID NO: 12082 - protein, 7 aa, Artificial Sequence
  Description of Artificial Sequence: Synthetic peptide
WASTRES

SEQ ID NO: 12083 - DNA, 21 bp, Artificial Sequence
  Description of Artificial Sequence: Synthetic oligonucleotide
tgggcatctacccgggaatcc

SEQ ID NO: 12084 - protein, 7 aa, Artificial Sequence
  Description of Artificial Sequence: Synthetic peptide
WASTRES

SEQ ID NO: 12085 - DNA, 21 bp, Artificial Sequence
  Description of Artificial Sequence: Synthetic oligonucleotide
tgggcatctacccgggaatcc

SEQ ID NO: 12086 - protein, 7 aa, Artificial Sequence
  Description of Artificial Sequence: Synthetic peptide
WASTRES

SEQ ID NO: 12087 - DNA, 21 bp, Artificial Sequence
  Description of Artificial Sequence: Synthetic oligonucleotide
gctgcatccagtttgcaaagt

SEQ ID NO: 12088 - protein, 7 aa, Artificial Sequence
  Description of Artificial Sequence: Synthetic peptide
AASSLQS

SEQ ID NO: 12089 - DNA, 21 bp, Artificial Sequence
  Description of Artificial Sequence: Synthetic oligonucleotide
gctgcatccagtttgcaaagt

SEQ ID NO: 12090 - protein, 7 aa, Artificial Sequence
  Description of Artificial Sequence: Synthetic peptide
AASSLQS

SEQ ID NO: 12091 - DNA, 21 bp, Artificial Sequence
  Description of Artificial Sequence: Synthetic oligonucleotide
actgcatccagtttgcaaagt

SEQ ID NO: 12092 - protein, 7 aa, Artificial Sequence
  Description of Artificial Sequence: Synthetic peptide
TASSLQS

SEQ ID NO: 12093 - DNA, 21 bp, Artificial Sequence
  Description of Artificial Sequence: Synthetic oligonucleotide
gctgcatccagattgcaaagt

SEQ ID NO: 12094 - protein, 7 aa, Artificial Sequence
  Description of Artificial Sequence: Synthetic peptide
AASRLQS

SEQ ID NO: 12095 - DNA, 21 bp, Artificial Sequence
  Description of Artificial Sequence: Synthetic oligonucleotide
gctgcatccagtttgcaaagt

SEQ ID NO: 12096 - protein, 7 aa, Artificial Sequence
  Description of Artificial Sequence: Synthetic peptide
AASSLQS

SEQ ID NO: 12097 - DNA, 21 bp, Artificial Sequence
  Description of Artificial Sequence: Synthetic oligonucleotide
gctgcatccagtttgcaaagt

SEQ ID NO: 12098 - protein, 7 aa, Artificial Sequence
  Description of Artificial Sequence: Synthetic peptide
AASSLQS

SEQ ID NO: 12099 - DNA, 51 bp, Artificial Sequence
  Description of Artificial Sequence: Synthetic oligonucleotide
gttatatcatatgttggaagtaataaatactatgcagactccgtgaagggc

SEQ ID NO: 12100 - protein, 17 aa, Artificial Sequence
  Description of Artificial Sequence: Synthetic peptide
VISYVGSNKYYADSVKG

SEQ ID NO: 12101 - DNA, 51 bp, Artificial Sequence
  Description of Artificial Sequence: Synthetic oligonucleotide
tggatgacccctaacagtggtaacacaggctatgcacagaagttccagggc

SEQ ID NO: 12102 - protein, 17 aa, Artificial Sequence
  Description of Artificial Sequence: Synthetic peptide
WMTPNSGNTGYAQKFQG

SEQ ID NO: 12103 - DNA, 51 bp, Artificial Sequence
  Description of Artificial Sequence: Synthetic oligonucleotide
tggatgaaccctaacagtggtaacacaggctatgcacagaagttccagggc

SEQ ID NO: 12104 - protein, 17 aa, Artificial Sequence
  Description of Artificial Sequence: Synthetic peptide
WMNPNSGNTGYAQKFQG

SEQ ID NO: 12105 - DNA, 51 bp, Artificial Sequence
  Description of Artificial Sequence: Synthetic oligonucleotide
gttatatcatatgatggaagtaatgaatactatgcagactccgtgaagggc

SEQ ID NO: 12106 - protein, 17 aa, Artificial Sequence
  Description of Artificial Sequence: Synthetic peptide
VISYDGSNEYYADSVKG

SEQ ID NO: 12107 - DNA, 51 bp, Artificial Sequence
  Description of Artificial Sequence: Synthetic oligonucleotide
tggatcagcgcttacaatggtaacacaaactatgcacagaagctccagggc

SEQ ID NO: 12108 - protein, 17 aa, Artificial Sequence
  Description of Artificial Sequence: Synthetic peptide
WISAYNGNTNYAQKLQG

SEQ ID NO: 12109 - DNA, 51 bp, Artificial Sequence
  Description of Artificial Sequence: Synthetic oligonucleotide
gttatatggtttgatggcagtaataaatactatgtagactccgtgaaggac

SEQ ID NO: 12110 - protein, 17 aa, Artificial Sequence
  Description of Artificial Sequence: Synthetic peptide
VIWFDGSNKYYVDSVKD

SEQ ID NO: 12111 - DNA, 51 bp, Artificial Sequence
  Description of Artificial Sequence: Synthetic oligonucleotide
tggatcaaccctaacaatggtggcacaagctatgcacagaagtttcaggac

SEQ ID NO: 12112 - protein, 17 aa, Artificial Sequence
  Description of Artificial Sequence: Synthetic peptide
WINPNNGGTSYAQKFQD

SEQ ID NO: 12113 - DNA, 48 bp, Artificial Sequence
  Description of Artificial Sequence: Synthetic oligonucleotide
cgtatctataccagtgggagcaccgactacaacccctccctcaagagt

SEQ ID NO: 12114 - protein, 16 aa, Artificial Sequence
  Description of Artificial Sequence: Synthetic peptide
RIYTSGSTDYNPSLKS

SEQ ID NO: 12115 - DNA, 51 bp, Artificial Sequence
  Description of Artificial Sequence: Synthetic oligonucleotide
tggatcaaccctaatagaaatggcacaaactatgcacagaagtttcagggc

SEQ ID NO: 12116 - protein, 17 aa, Artificial Sequence
  Description of Artificial Sequence: Synthetic peptide
WINPNRNGTNYAQKFQG

SEQ ID NO: 12117 - DNA, 51 bp, Artificial Sequence
  Description of Artificial Sequence: Synthetic oligonucleotide
tggatcaaccctaacagaaatggcacaaactatgcacagaattttcagggc

SEQ ID NO: 12118 - protein, 17 aa, Artificial Sequence
  Description of Artificial Sequence: Synthetic peptide
WINPNRNGTNYAQNFQG

SEQ ID NO: 12119 - DNA, 48 bp, Artificial Sequence
  Description of Artificial Sequence: Synthetic oligonucleotide
gaaatcaattatagtggaaggaccaacttcaacccgtccctcaagagt

SEQ ID NO: 12120 - protein, 16 aa, Artificial Sequence
  Description of Artificial Sequence: Synthetic peptide
EINYSGRTNFNPSLKS

SEQ ID NO: 12121 - DNA, 51 bp, Artificial Sequence
  Description of Artificial Sequence: Synthetic oligonucleotide
gttatatggtatgatggaagtaataaatactatacagactccgttaagggc

SEQ ID NO: 12122 - protein, 17 aa, Artificial Sequence
  Description of Artificial Sequence: Synthetic peptide
VIWYDGSNKYYTDSVKG

SEQ ID NO: 12123 - DNA, 51 bp, Artificial Sequence
  Description of Artificial Sequence: Synthetic oligonucleotide
gttatatggtatgatggaagtaataaatactatgcagactccgtgaagggc

SEQ ID NO: 12124 - protein, 17 aa, Artificial Sequence
  Description of Artificial Sequence: Synthetic peptide
VIWYDGSNKYYADSVKG

SEQ ID NO: 12125 - DNA, 51 bp, Artificial Sequence
  Description of Artificial Sequence: Synthetic oligonucleotide
gttatatggtatgatggaagtaatgactactatgcagactccgtgaagggc

SEQ ID NO: 12126 - protein, 17 aa, Artificial Sequence
  Description of Artificial Sequence: Synthetic peptide
VIWYDGSNDYYADSVKG

SEQ ID NO: 12127 - DNA, 51 bp, Artificial Sequence
  Description of Artificial Sequence: Synthetic oligonucleotide
attatatggtatgatggaagtaataaatactatgcagactccgtgaagggc

SEQ ID NO: 12128 - protein, 17 aa, Artificial Sequence
  Description of Artificial Sequence: Synthetic peptide
IIWYDGSNKYYADSVKG

SEQ ID NO: 12129 - DNA, 51 bp, Artificial Sequence
  Description of Artificial Sequence: Synthetic oligonucleotide
gttatatggtatgatgtaagtaataaatactatggagactccgtgaagggc

SEQ ID NO: 12130 - protein, 17 aa, Artificial Sequence
  Description of Artificial Sequence: Synthetic peptide
VIWYDVSNKYYGDSVKG

SEQ ID NO: 12131 - DNA, 51 bp, Artificial Sequence
  Description of Artificial Sequence: Synthetic oligonucleotide
tggatgaaccctaaaaggggtaacacaggctatgcacagaagttccagggc

SEQ ID NO: 12132 - protein, 17 aa, Artificial Sequence
  Description of Artificial Sequence: Synthetic peptide
WMNPKRGNTGYAQKFQG

SEQ ID NO: 12133 - DNA, 51 bp, Artificial Sequence
  Description of Artificial Sequence: Synthetic oligonucleotide
gttatatggtatgatggaagtaataaatactatgtagactccgtgaagggc

SEQ ID NO: 12134 - protein, 17 aa, Artificial Sequence
  Description of Artificial Sequence: Synthetic peptide
VIWYDGSNKYYVDSVKG

SEQ ID NO: 12135 - DNA, 51 bp, Artificial Sequence
  Description of Artificial Sequence: Synthetic oligonucleotide
gctatatggtatgatggaagcaataaatactatgcagactccgtgaagggc

SEQ ID NO: 12136 - protein, 17 aa, Artificial Sequence
  Description of Artificial Sequence: Synthetic peptide
AIWYDGSNKYYADSVKG

SEQ ID NO: 12137 - DNA, 51 bp, Artificial Sequence
  Description of Artificial Sequence: Synthetic oligonucleotide
tggatcaaccctaatagtggtggcacaaactttgcacagaagtttcagggc

SEQ ID NO: 12138 - protein, 17 aa, Artificial Sequence
  Description of Artificial Sequence: Synthetic peptide
WINPNSGGTNFAQKFQG

SEQ ID NO: 12139 - DNA, 48 bp, Artificial Sequence; identical to SEQ ID NO: 12119
  Description of Artificial Sequence: Synthetic oligonucleotide

SEQ ID NO: 12140 - protein, 16 aa, Artificial Sequence
  Description of Artificial Sequence: Synthetic peptide
EINYSGRTNFNPSLKS

SEQ ID NO: 12141 - DNA, 48 bp, Artificial Sequence; identical to SEQ ID NO: 12119
  Description of Artificial Sequence: Synthetic oligonucleotide

SEQ ID NO: 12142 - protein, 16 aa, Artificial Sequence
  Description of Artificial Sequence: Synthetic peptide
EINYSGRTNFNPSLKS

SEQ ID NO: 12143 - DNA, 51 bp, Artificial Sequence
  Description of Artificial Sequence: Synthetic oligonucleotide
gttatatcatatgatggaggttataaaaactatgcagactccgtgaagggc

SEQ ID NO: 12144 - protein, 17 aa, Artificial Sequence
  Description of Artificial Sequence: Synthetic peptide
VISYDGGYKNYADSVKG

SEQ ID NO: 12145 - DNA, 48 bp, Artificial Sequence; identical to SEQ ID NO: 12119
  Description of Artificial Sequence: Synthetic oligonucleotide

SEQ ID NO: 12146 - protein, 16 aa, Artificial Sequence
  Description of Artificial Sequence: Synthetic peptide
EINYSGRTNFNPSLKS

SEQ ID NO: 12147 - DNA, 48 bp, Artificial Sequence
  Description of Artificial Sequence: Synthetic oligonucleotide
tacatctattacagtgggagcacctactacaacccgtccctcaagagt

SEQ ID NO: 12148 - protein, 16 aa, Artificial Sequence
  Description of Artificial Sequence: Synthetic peptide
YIYYSGSTYYNPSLKS

SEQ ID NO: 12149 - DNA, 48 bp, Artificial Sequence; identical to SEQ ID NO: 12119
  Description of Artificial Sequence: Synthetic oligonucleotide

SEQ ID NO: 12150 - protein, 16 aa, Artificial Sequence
  Description of Artificial Sequence: Synthetic peptide
EINYSGRTNFNPSLKS

SEQ ID NO: 12151 - DNA, 51 bp, Artificial Sequence
  Description of Artificial Sequence: Synthetic oligonucleotide
gctatatggtatgatggaagtaataaatactatgcagactccgtgaagggc

SEQ ID NO: 12152 - protein, 17 aa, Artificial Sequence
  Description of Artificial Sequence: Synthetic peptide
AIWYDGSNKYYADSVKG

SEQ ID NO: 12153 - DNA, 51 bp, Artificial Sequence
  Description of Artificial Sequence: Synthetic oligonucleotide
tccattagtggtagtagtagttacatatactacgcagactcagtgaagggc

SEQ ID NO: 12154 - protein, 17 aa, Artificial Sequence
  Description of Artificial Sequence: Synthetic peptide
SISGSSSYIYYADSVKG

SEQ ID NO: 12155 - DNA, 51 bp, Artificial Sequence
  Description of Artificial Sequence: Synthetic oligonucleotide
tccattagtggtagtagcagttacatatactacgtagactcagtgaagggc

SEQ ID NO: 12156 - protein, 17 aa, Artificial Sequence
  Description of Artificial Sequence: Synthetic peptide
SISGSSSYIYYVDSVKG

SEQ ID NO: 12157 - DNA, 51 bp, Artificial Sequence
  Description of Artificial Sequence: Synthetic oligonucleotide
gttcttagtggtagtggtggtagcacattctacgcagactccgtgaagggc

SEQ ID NO: 12158 - protein, 17 aa, Artificial Sequence
  Description of Artificial Sequence: Synthetic peptide
VLSGSGGSTFYADSVKG

SEQ ID NO: 12159 - DNA, 51 bp, Artificial Sequence
  Description of Artificial Sequence: Synthetic oligonucleotide
tggatgcaccctaacagtggtaacacaggctatgcacagaagttccggggc

SEQ ID NO: 12160 - protein, 17 aa, Artificial Sequence
  Description of Artificial Sequence: Synthetic peptide
WMHPNSGNTGYAQKFRG

SEQ ID NO: 12161 - DNA, 51 bp, Artificial Sequence
  Description of Artificial Sequence: Synthetic oligonucleotide
tggatgcaccctaacagtggtaacacaggctatgcacagaagttccagggc

SEQ ID NO: 12162 - protein, 17 aa, Artificial Sequence
  Description of Artificial Sequence: Synthetic peptide
WMHPNSGNTGYAQKFQG

SEQ ID NO: 12163 - DNA, 51 bp, Artificial Sequence; identical to SEQ ID NO: 12161
  Description of Artificial Sequence: Synthetic oligonucleotide

SEQ ID NO: 12164 - protein, 17 aa, Artificial Sequence
  Description of Artificial Sequence: Synthetic peptide
WMHPNSGNTGYAQKFQG

SEQ ID NO: 12165 - DNA, 48 bp, Artificial Sequence
  Description of Artificial Sequence: Synthetic oligonucleotide
agtatctattatagtgggagcgcctactccaacccgtccctcaagagt

SEQ ID NO: 12166 - protein, 16 aa, Artificial Sequence
  Description of Artificial Sequence: Synthetic peptide
SIYYSGSAYSNPSLKS

SEQ ID NO: 12167 - DNA, 51 bp, Artificial Sequence
  Description of Artificial Sequence: Synthetic oligonucleotide
gttatatggtatgatggaagtaataagtactatgcagactccgtgaagggc

SEQ ID NO: 12168 - protein, 17 aa, Artificial Sequence
  Description of Artificial Sequence: Synthetic peptide
VIWYDGSNKYYADSVKG

SEQ ID NO: 12169 - DNA, 51 bp, Artificial Sequence; identical to SEQ ID NO: 12123
  Description of Artificial Sequence: Synthetic oligonucleotide

SEQ ID NO: 12170 - protein, 17 aa, Artificial Sequence
  Description of Artificial Sequence: Synthetic peptide
VIWYDGSNKYYADSVKG

SEQ ID NO: 12171 - DNA, 51 bp, Artificial Sequence
  Description of Artificial Sequence: Synthetic oligonucleotide
tggatcaaccctaacagaggtggcacaaactatgctcagaagtttcagggc

SEQ ID NO: 12172 - protein, 17 aa, Artificial Sequence
  Description of Artificial Sequence: Synthetic peptide
WINPNRGGTNYAQKFQG

SEQ ID NO: 12173 - DNA, 48 bp, Artificial Sequence
  Description of Artificial Sequence: Synthetic oligonucleotide
ctcatttattggaaagatgatgagcgctacagcccatctctgaagagc

SEQ ID NO: 12174 - protein, 16 aa, Artificial Sequence
  Description of Artificial Sequence: Synthetic peptide
LIYWKDDERYSPSLKS

SEQ ID NO: 12175 - DNA, 51 bp, Artificial Sequence
  Description of Artificial Sequence: Synthetic oligonucleotide
tggatcaacccttacagtggtggcacaaactatgcacagaagtttcagggc

SEQ ID NO: 12176 - protein, 17 aa, Artificial Sequence
  Description of Artificial Sequence: Synthetic peptide
WINPYSGGTNYAQKFQG

SEQ ID NO: 12177 - DNA, 48 bp, Artificial Sequence
  Description of Artificial Sequence: Synthetic oligonucleotide
aatatctattatagtgggagcacctaccacaacccgtccctcaagagt

SEQ ID NO: 12178 - protein, 16 aa, Artificial Sequence
  Description of Artificial Sequence: Synthetic peptide
NIYYSGSTYHNPSLKS

SEQ ID NO: 12179 - DNA, 51 bp, Artificial Sequence; identical to SEQ ID NO: 12161
  Description of Artificial Sequence: Synthetic oligonucleotide

SEQ ID NO: 12180 - protein, 17 aa, Artificial Sequence
  Description of Artificial Sequence: Synthetic peptide
WMHPNSGNTGYAQKFQG

SEQ ID NO: 12181 - DNA, 51 bp, Artificial Sequence
  Description of Artificial Sequence: Synthetic oligonucleotide
tccataagtggtagtagtagttacttatactacccagactcagtgaagggc

SEQ ID NO: 12182 - protein, 17 aa, Artificial Sequence
  Description of Artificial Sequence: Synthetic peptide
SISGSSSYLYYPDSVKG

SEQ ID NO: 12183 - DNA, 51 bp, Artificial Sequence; identical to SEQ ID NO: 12181
  Description of Artificial Sequence: Synthetic oligonucleotide

SEQ ID NO: 12184 - protein, 17 aa, Artificial Sequence
  Description of Artificial Sequence: Synthetic peptide
SISGSSSYLYYPDSVKG

SEQ ID NO: 12185 - DNA, 51 bp, Artificial Sequence
  Description of Artificial Sequence: Synthetic oligonucleotide
gttatatggtatgatggaagtaataaatactatgcagactccgtgaaggtc

SEQ ID NO: 12186 - protein, 17 aa, Artificial Sequence
  Description of Artificial Sequence: Synthetic peptide
VIWYDGSNKYYADSVKV

SEQ ID NO: 12187 - DNA, 51 bp, Artificial Sequence; identical to SEQ ID NO: 12185
  Description of Artificial Sequence: Synthetic oligonucleotide

SEQ ID NO: 12188 - protein, 17 aa, Artificial Sequence
  Description of Artificial Sequence: Synthetic peptide
VIWYDGSNKYYADSVKV

SEQ ID NO: 12189 - DNA, 51 bp, Artificial Sequence
  Description of Artificial Sequence: Synthetic oligonucleotide
tggatccaccctaacagtggtggcacaaactatgcacagaagtttcagggc

SEQ ID NO: 12190 - protein, 17 aa, Artificial Sequence
  Description of Artificial Sequence: Synthetic peptide
WIHPNSGGTNYAQKFQG

SEQ ID NO: 12191 - DNA, 51 bp, Artificial Sequence; identical to SEQ ID NO: 12189
  Description of Artificial Sequence: Synthetic oligonucleotide

SEQ ID NO: 12192 - protein, 17 aa, Artificial Sequence
  Description of Artificial Sequence: Synthetic peptide
WIHPNSGGTNYAQKFQG

SEQ ID NO: 12193 - DNA, 51 bp, Artificial Sequence
  Description of Artificial Sequence: Synthetic oligonucleotide
tggatccaccctaacagtggtggcacaaactttgcacagaagtttcagggc

SEQ ID NO: 12194 - protein, 17 aa, Artificial Sequence
  Description of Artificial Sequence: Synthetic peptide
WIHPNSGGTNFAQKFQG

SEQ ID NO: 12195 - DNA, 51 bp, Artificial Sequence; identical to SEQ ID NO: 12193
  Description of Artificial Sequence: Synthetic oligonucleotide

SEQ ID NO: 12196 - protein, 17 aa, Artificial Sequence
  Description of Artificial Sequence: Synthetic peptide
WIHPNSGGTNFAQKFQG

SEQ ID NO: 12197 - DNA, 51 bp, Artificial Sequence
  Description of Artificial Sequence: Synthetic oligonucleotide
tggatcaaccctaacagtggtggcacaaactatgcacagaagtttcagggc

SEQ ID NO: 12198 - protein, 17 aa, Artificial Sequence
  Description of Artificial Sequence: Synthetic peptide
WINPNSGGTNYAQKFQG

SEQ ID NO: 12199 - DNA, 51 bp, Artificial Sequence; identical to SEQ ID NO: 12197
  Description of Artificial Sequence: Synthetic oligonucleotide

SEQ ID NO: 12200 - protein, 17 aa, Artificial Sequence
  Description of Artificial Sequence: Synthetic peptide
WINPNSGGTNYAQKFQG

SEQ ID NO: 12201 - DNA, 51 bp, Artificial Sequence
  Description of Artificial Sequence: Synthetic oligonucleotide
tcgatctaccgtaacagtggtggcacaaattatgcacagaagtttcagggc

SEQ ID NO: 12202 - protein, 17 aa, Artificial Sequence
  Description of Artificial Sequence: Synthetic peptide
SIYRNSGGTNYAQKFQG

SEQ ID NO: 12203 - DNA, 48 bp, Artificial Sequence
  Description of Artificial Sequence: Synthetic oligonucleotide
ctcatttattggaatgatgataagcgctacagcccatctctgaagagc

SEQ ID NO: 12204 - protein, 16 aa, Artificial Sequence
  Description of Artificial Sequence: Synthetic peptide
LIYWNDDKRYSPSLKS

SEQ ID NO: 12205 - DNA, 48 bp, Artificial Sequence
  Description of Artificial Sequence: Synthetic oligonucleotide
ttcatttattggagtgatgataagcgctacagcccatctctgaagagc

SEQ ID NO: 12206 - protein, 16 aa, Artificial Sequence
  Description of Artificial Sequence: Synthetic peptide
FIYWSDDKRYSPSLKS

SEQ ID NO: 12207 - DNA, 51 bp, Artificial Sequence
  Description of Artificial Sequence: Synthetic oligonucleotide
tggatcaaccctaatagtggtggcacaaactatgcacagaagtttcagggc

SEQ ID NO: 12208 - protein, 17 aa, Artificial Sequence
  Description of Artificial Sequence: Synthetic peptide
WINPNSGGTNYAQKFQG

SEQ ID NO: 12209 - DNA, 48 bp, Artificial Sequence
  Description of Artificial Sequence: Synthetic oligonucleotide
ctcatttattggaatgatgataaggtctacagcccatctctgaagagc

SEQ ID NO: 12210 - protein, 16 aa, Artificial Sequence
  Description of Artificial Sequence: Synthetic peptide
LIYWNDDKVYSPSLKS

SEQ ID NO: 12211 - DNA, 51 bp, Artificial Sequence; identical to SEQ ID NO: 12123
  Description of Artificial Sequence: Synthetic oligonucleotide

SEQ ID NO: 12212 - protein, 17 aa, Artificial Sequence
  Description of Artificial Sequence: Synthetic peptide
VIWYDGSNKYYADSVKG

SEQ ID NO: 12213 - DNA, 48 bp, Artificial Sequence
  Description of Artificial Sequence: Synthetic oligonucleotide
ctcatttattggaatgatgataagcgccacagcccatctctgaagagc

SEQ ID NO: 12214 - protein, 16 aa, Artificial Sequence
  Description of Artificial Sequence: Synthetic peptide
LIYWNDDKRHSPSLKS

SEQ ID NO: 12215 - DNA, 51 bp, Artificial Sequence
  Description of Artificial Sequence: Synthetic oligonucleotide
actattagtgttggtggtggtagcacatactacgcagactccgtgaagggc

SEQ ID NO: 12216 - protein, 17 aa, Artificial Sequence
  Description of Artificial Sequence: Synthetic peptide
TISVGGGSTYYADSVKG

SEQ ID NO: 12217 - DNA, 51 bp, Artificial Sequence; identical to SEQ ID NO: 12197
  Description of Artificial Sequence: Synthetic oligonucleotide

SEQ ID NO: 12218 - protein, 17 aa, Artificial Sequence
  Description of Artificial Sequence: Synthetic peptide
WINPNSGGTNYAQKFQG

SEQ ID NO: 12219 - DNA, 51 bp, Artificial Sequence
  Description of Artificial Sequence: Synthetic oligonucleotide
gtcatatggtatgatggaaataataaatactatgtagactccgtgaagggc

SEQ ID NO: 12220 - protein, 17 aa, Artificial Sequence
  Description of Artificial Sequence: Synthetic peptide
VIWYDGNNKYYVDSVKG

SEQ ID NO: 12221 - DNA, 51 bp, Artificial Sequence
  Description of Artificial Sequence: Synthetic oligonucleotide
tccattagtagtagtagtacttacatatactacgcagactcagtgaagggc

SEQ ID NO: 12222 - protein, 17 aa, Artificial Sequence
  Description of Artificial Sequence: Synthetic peptide
SISSSSTYIYYADSVKG

SEQ ID NO: 12223 - DNA, 48 bp, Artificial Sequence
  Description of Artificial Sequence: Synthetic oligonucleotide
aatatctattatggtgggaacacctactacaacccgtccctcaagagt

SEQ ID NO: 12224 - protein, 16 aa, Artificial Sequence
  Description of Artificial Sequence: Synthetic peptide
NIYYGGNTYYNPSLKS

SEQ ID NO: 12225 - DNA, 51 bp, Artificial Sequence; identical to SEQ ID NO: 12153
  Description of Artificial Sequence: Synthetic oligonucleotide

SEQ ID NO: 12226 - protein, 17 aa, Artificial Sequence
  Description of Artificial Sequence: Synthetic peptide
SISGSSSYIYYADSVKG

SEQ ID NO: 12227 - DNA, 51 bp, Artificial Sequence
  Description of Artificial Sequence: Synthetic oligonucleotide
gttatatggtttgatggaagtaataaatactatgcagactccgtgaagggc

SEQ ID NO: 12228 - protein, 17 aa, Artificial Sequence
  Description of Artificial Sequence: Synthetic peptide
VIWFDGSNKYYADSVKG

SEQ ID NO: 12229 - DNA, 48 bp, Artificial Sequence
  Description of Artificial Sequence: Synthetic oligonucleotide
aatatctattatagtgggactgcctactgtaattcgtccctcaagagt

SEQ ID NO: 12230 - protein, 16 aa, Artificial Sequence
  Description of Artificial Sequence: Synthetic peptide
NIYYSGTAYCNSSLKS

SEQ ID NO: 12231 - DNA, 51 bp, Artificial Sequence
  Description of Artificial Sequence: Synthetic oligonucleotide
gttatttggtatgaagaaaataatcaatactatgcagactccgtgaagggc

SEQ ID NO: 12232 - protein, 17 aa, Artificial Sequence
  Description of Artificial Sequence: Synthetic peptide
VIWYEENNQYYADSVKG

SEQ ID NO: 12233 - DNA, 51 bp, Artificial Sequence
  Description of Artificial Sequence: Synthetic oligonucleotide
tccattagtggtagtagtagtctcatatactacgcagactcagtgaagggc

SEQ ID NO: 12234 - protein, 17 aa, Artificial Sequence
  Description of Artificial Sequence: Synthetic peptide
SISGSSSLIYYADSVKG

SEQ ID NO: 12235 - DNA, 51 bp, Artificial Sequence; identical to SEQ ID NO: 12123
  Description of Artificial Sequence: Synthetic oligonucleotide

SEQ ID NO: 12236 - protein, 17 aa, Artificial Sequence
  Description of Artificial Sequence: Synthetic peptide
VIWYDGSNKYYADSVKG

SEQ ID NO: 12237 - DNA, 54 bp, Artificial Sequence
  Description of Artificial Sequence: Synthetic oligonucleotide
aggacatactacaggtccaagtggtataatgattatgcagtatctgtgaaaagt

SEQ ID NO: 12238 - protein, 18 aa, Artificial Sequence
  Description of Artificial Sequence: Synthetic peptide
RTYYRSKWYNDYAVSVKS

SEQ ID NO: 12239 - DNA, 48 bp, Artificial Sequence
  Description of Artificial Sequence: Synthetic oligonucleotide
aatatctattatagtgggagcacctactacaatccgtccctcaagagt

SEQ ID NO: 12240 - protein, 16 aa, Artificial Sequence
  Description of Artificial Sequence: Synthetic peptide
NIYYSGSTYYNPSLKS

SEQ ID NO: 12241 - DNA, 51 bp, Artificial Sequence
  Description of Artificial Sequence: Synthetic oligonucleotide
gttatatggtatgaggaaaataataaatattatgtagactccgtgaagggc

SEQ ID NO: 12242 - protein, 17 aa, Artificial Sequence
  Description of Artificial Sequence: Synthetic peptide
VIWYEENNKYYVDSVKG

SEQ ID NO: 12243 - DNA, 48 bp, Artificial Sequence
  Description of Artificial Sequence: Synthetic oligonucleotide
aatatctattatagtgggtacacctactacaacccgtccctcaagagt

SEQ ID NO: 12244 - protein, 16 aa, Artificial Sequence
  Description of Artificial Sequence: Synthetic peptide
NIYYSGYTYYNPSLKS

SEQ ID NO: 12245 - DNA, 51 bp, Artificial Sequence; identical to SEQ ID NO: 12231
  Description of Artificial Sequence: Synthetic oligonucleotide

SEQ ID NO: 12246 - protein, 17 aa, Artificial Sequence
  Description of Artificial Sequence: Synthetic peptide
VIWYEENNQYYADSVKG

SEQ ID NO: 12247 - DNA, 51 bp, Artificial Sequence; identical to SEQ ID NO: 12227
  Description of Artificial Sequence: Synthetic oligonucleotide

SEQ ID NO: 12248 - protein, 17 aa, Artificial Sequence
  Description of Artificial Sequence: Synthetic peptide
VIWFDGSNKYYADSVKG

SEQ ID NO: 12249 - DNA, 54 bp, Artificial Sequence; identical to SEQ ID NO: 12237
  Description of Artificial Sequence: Synthetic oligonucleotide

SEQ ID NO: 12250 - protein, 18 aa, Artificial Sequence
  Description of Artificial Sequence: Synthetic peptide
RTYYRSKWYNDYAVSVKS

SEQ ID NO: 12251 - DNA, 51 bp, Artificial Sequence
  Description of Artificial Sequence: Synthetic oligonucleotide
cacattagtagtagtggtagtaccatatattacgcagactctgtgaagggc

SEQ ID NO: 12252 - protein, 17 aa, Artificial Sequence
  Description of Artificial Sequence: Synthetic peptide
HISSSGSTIYYADSVKG

SEQ ID NO: 12253 - DNA, 51 bp, Artificial Sequence
  Description of Artificial Sequence: Synthetic oligonucleotide
gttattagtggtcgtggtggtaacacattctacgcagactccgtgaagggc

SEQ ID NO: 12254 - protein, 17 aa, Artificial Sequence
  Description of Artificial Sequence: Synthetic peptide
VISGRGGNTFYADSVKG

SEQ ID NO: 12255 - DNA, 51 bp, Artificial Sequence; identical to SEQ ID NO: 12231
  Description of Artificial Sequence: Synthetic oligonucleotide

SEQ ID NO: 12256 - protein, 17 aa, Artificial Sequence
  Description of Artificial Sequence: Synthetic peptide
VIWYEENNQYYADSVKG

SEQ ID NO: 12257 - DNA, 48 bp, Artificial Sequence
  Description of Artificial Sequence: Synthetic oligonucleotide
aatatttattatagtgggagcgcctacaacaacccgtccctcaagggt

SEQ ID NO: 12258 - protein, 16 aa, Artificial Sequence
  Description of Artificial Sequence: Synthetic peptide
NIYYSGSAYNNPSLKG

SEQ ID NO: 12259 - DNA, 51 bp, Artificial Sequence; identical to SEQ ID NO: 12231
  Description of Artificial Sequence: Synthetic oligonucleotide

SEQ ID NO: 12260 - protein, 17 aa, Artificial Sequence
  Description of Artificial Sequence: Synthetic peptide
VIWYEENNQYYADSVKG

SEQ ID NO: 12261 - DNA, 51 bp, Artificial Sequence
  Description of Artificial Sequence: Synthetic oligonucleotide
gttatatggtatgacggaagtgataaatactatgcagactccgtgaagggc

SEQ ID NO: 12262 - protein, 17 aa, Artificial Sequence
  Description of Artificial Sequence: Synthetic peptide
VIWYDGSDKYYADSVKG

SEQ ID NO: 12263 - DNA, 51 bp, Artificial Sequence
  Description of Artificial Sequence: Synthetic oligonucleotide
gttatatggcatgatggaagtaataaatactatgcagactccgtgaagggc

SEQ ID NO: 12264 - protein, 17 aa, Artificial Sequence
  Description of Artificial Sequence: Synthetic peptide
VIWHDGSNKYYADSVKG

SEQ ID NO: 12265 - DNA, 51 bp, Artificial Sequence
  Description of Artificial Sequence: Synthetic oligonucleotide
gttatatggtatgaggaaaataataaatactatgtagactccgtgaagggc

SEQ ID NO: 12266 - protein, 17 aa, Artificial Sequence
  Description of Artificial Sequence: Synthetic peptide
VIWYEENNKYYVDSVKG

SEQ ID NO: 12267 - DNA, 51 bp, Artificial Sequence
  Description of Artificial Sequence: Synthetic oligonucleotide
gttattagtggccgtggtggtaacacattctacgcagactccgtgaagggc

SEQ ID NO: 12268 - protein, 17 aa, Artificial Sequence
  Description of Artificial Sequence: Synthetic peptide
VISGRGGNTFYADSVKG

SEQ ID NO: 12269 - DNA, 51 bp, Artificial Sequence
  Description of Artificial Sequence: Synthetic oligonucleotide
gttatatggtatgatgtaactaataaatactatgcagactccgtgaagggc

SEQ ID NO: 12270 - protein, 17 aa, Artificial Sequence
  Description of Artificial Sequence: Synthetic peptide
VIWYDVTNKYYADSVKG

SEQ ID NO: 12271 - DNA, 48 bp, Artificial Sequence
  Description of Artificial Sequence: Synthetic oligonucleotide
aatatctattatagtgggagcacctactacaacccgtccttcaagagt

SEQ ID NO: 12272 - protein, 16 aa, Artificial Sequence
  Description of Artificial Sequence: Synthetic peptide
NIYYSGSTYYNPSFKS

SEQ ID NO: 12273 - DNA, 51 bp, Artificial Sequence
  Description of Artificial Sequence: Synthetic oligonucleotide
gttattagtggtagtggtggtagcacatactacgcagactccgtgaagggc

SEQ ID NO: 12274 - protein, 17 aa, Artificial Sequence
  Description of Artificial Sequence: Synthetic peptide
VISGSGGSTYYADSVKG

SEQ ID NO: 12275 - DNA, 51 bp, Artificial Sequence; identical to SEQ ID NO: 12231
  Description of Artificial Sequence: Synthetic oligonucleotide

SEQ ID NO: 12276 - protein, 17 aa, Artificial Sequence
  Description of Artificial Sequence: Synthetic peptide
VIWYEENNQYYADSVKG

SEQ ID NO: 12277 - DNA, 51 bp, Artificial Sequence
  Description of Artificial Sequence: Synthetic oligonucleotide
tccattagtggtagtagtactgacatatactacgcagactcagtgaagggc

SEQ ID NO: 12278 - protein, 17 aa, Artificial Sequence
  Description of Artificial Sequence: Synthetic peptide
SISGSSTDIYYADSVKG

SEQ ID NO: 12279 - DNA, 51 bp, Artificial Sequence
  Description of Artificial Sequence: Synthetic oligonucleotide
gttatatggtatgatggaaataataaacactatgcagactccgtgaagggc

SEQ ID NO: 12280 - protein, 17 aa, Artificial Sequence
  Description of Artificial Sequence: Synthetic peptide
VIWYDGNNKHYADSVKG

SEQ ID NO: 12281 - DNA, 51 bp, Artificial Sequence; identical to SEQ ID NO: 12227
  Description of Artificial Sequence: Synthetic oligonucleotide

SEQ ID NO: 12282 - protein, 17 aa, Artificial Sequence
  Description of Artificial Sequence: Synthetic peptide
VIWFDGSNKYYADSVKG

SEQ ID NO: 12283 - DNA, 51 bp, Artificial Sequence
  Description of Artificial Sequence: Synthetic oligonucleotide
gttatatggtttgatggaagtaataaatactatgtagactccgtgaagggc

SEQ ID NO: 12284 - protein, 17 aa, Artificial Sequence
  Description of Artificial Sequence: Synthetic peptide
VIWFDGSNKYYVDSVKG

SEQ ID NO: 12285 - DNA, 51 bp, Artificial Sequence
  Description of Artificial Sequence: Synthetic oligonucleotide
tacattagtaggagtagtagtaccatagactacgcagactctgtgaagggc

SEQ ID NO: 12286 - protein, 17 aa, Artificial Sequence
  Description of Artificial Sequence: Synthetic peptide
YISRSSSTIDYADSVKG

SEQ ID NO: 12287 - DNA, 51 bp, Artificial Sequence
  Description of Artificial Sequence: Synthetic oligonucleotide
gttatatggtttgatggaagtgataaatactatgcagactccgtgaagggc

SEQ ID NO: 12288 - protein, 17 aa, Artificial Sequence
  Description of Artificial Sequence: Synthetic peptide
VIWFDGSDKYYADSVKG

SEQ ID NO: 12289 - DNA, 51 bp, Artificial Sequence
  Description of Artificial Sequence: Synthetic oligonucleotide
gttataagtggtagtggtggttacacatacaacgcggactccgtgaagggc

SEQ ID NO: 12290 - protein, 17 aa, Artificial Sequence
  Description of Artificial Sequence: Synthetic peptide
VISGSGGYTYNADSVKG

SEQ ID NO: 12291 - DNA, 51 bp, Artificial Sequence
  Description of Artificial Sequence: Synthetic oligonucleotide
gttatatggtatgagggaagtaataaatattatgtagactccgtgaggggc

SEQ ID NO: 12292 - protein, 17 aa, Artificial Sequence
  Description of Artificial Sequence: Synthetic peptide
VIWYEGSNKYYVDSVRG

SEQ ID NO: 12293 - DNA, 51 bp, Artificial Sequence
  Description of Artificial Sequence: Synthetic oligonucleotide
attattagtggtcgtggtggtaacacattctacgcagactccgtgaagggc

SEQ ID NO: 12294 - protein, 17 aa, Artificial Sequence
  Description of Artificial Sequence: Synthetic peptide
IISGRGGNTFYADSVKG

SEQ ID NO: 12295 - DNA, 51 bp, Artificial Sequence
  Description of Artificial Sequence: Synthetic oligonucleotide
gttattagtggtagaggtggtaacacatactccgcagactccgtgaagggc

SEQ ID NO: 12296 - protein, 17 aa, Artificial Sequence
  Description of Artificial Sequence: Synthetic peptide
VISGRGGNTYSADSVKG

SEQ ID NO: 12297 - DNA, 48 bp, Artificial Sequence
  Description of Artificial Sequence: Synthetic oligonucleotide
aatatctattatagtgggtatacctactacactccgtccctcaagagt

SEQ ID NO: 12298 - protein, 16 aa, Artificial Sequence
  Description of Artificial Sequence: Synthetic peptide
NIYYSGYTYYTPSLKS

SEQ ID NO: 12299 - DNA, 51 bp, Artificial Sequence
  Description of Artificial Sequence: Synthetic oligonucleotide
tacattagtagtagtagtggtaccatatactacgcagactctgtgaagggc

SEQ ID NO: 12300 - protein, 17 aa, Artificial Sequence
  Description of Artificial Sequence: Synthetic peptide
YISSSSGTIYYADSVKG

SEQ ID NO: 12301 - DNA, 51 bp, Artificial Sequence
  Description of Artificial Sequence: Synthetic oligonucleotide
gttatatggtatgatgaaagtaataaatactatgcagactccgtgaagggc

SEQ ID NO: 12302 - protein, 17 aa, Artificial Sequence
  Description of Artificial Sequence: Synthetic peptide
VIWYDESNKYYADSVKG

SEQ ID NO: 12303 - DNA, 51 bp, Artificial Sequence
  Description of Artificial Sequence: Synthetic oligonucleotide
actattagtggtcgtggtggtcacacatactacgcagactccgtgaggggc

SEQ ID NO: 12304 - protein, 17 aa, Artificial Sequence
  Description of Artificial Sequence: Synthetic peptide
TISGRGGHTYYADSVRG

SEQ ID NO: 12305 - DNA, 51 bp, Artificial Sequence
  Description of Artificial Sequence: Synthetic oligonucleotide
gttatatggtatgatgaaagtaataaacactatatagactccgtgaagggc

SEQ ID NO: 12306 - protein, 17 aa, Artificial Sequence
  Description of Artificial Sequence: Synthetic peptide
VIWYDESNKHYIDSVKG

SEQ ID NO: 12307 - DNA, 51 bp, Artificial Sequence
  Description of Artificial Sequence: Synthetic oligonucleotide
tggatgaaccctaacactggtaacacaggctatgcacagaagttccagggc

SEQ ID NO: 12308 - protein, 17 aa, Artificial Sequence
  Description of Artificial Sequence: Synthetic peptide
WMNPNTGNTGYAQKFQG

SEQ ID NO: 12309 - DNA, 51 bp, Artificial Sequence
  Description of Artificial Sequence: Synthetic oligonucleotide
attattagtggtcgtgggggaaacgcattctacgcagactccgtgaagggc

SEQ ID NO: 12310 - protein, 17 aa, Artificial Sequence
  Description of Artificial Sequence: Synthetic peptide
IISGRGGNAFYADSVKG

SEQ ID NO: 12311 - DNA, 51 bp, Artificial Sequence; identical to SEQ ID NO: 12293
  Description of Artificial Sequence: Synthetic oligonucleotide

SEQ ID NO: 12312 - protein, 17 aa, Artificial Sequence
  Description of Artificial Sequence: Synthetic peptide
IISGRGGNTFYADSVKG

SEQ ID NO: 12313 - DNA, 51 bp, Artificial Sequence
  Description of Artificial Sequence: Synthetic oligonucleotide
tccattagtgggagtagtagttacatatactacgcagactcagtgaagggc

SEQ ID NO: 12314 - protein, 17 aa, Artificial Sequence
  Description of Artificial Sequence: Synthetic peptide
SISGSSSYIYYADSVKG

SEQ ID NO: 12315 - DNA, 51 bp, Artificial Sequence
  Description of Artificial Sequence: Synthetic oligonucleotide
cacattagtagtagtggtagtaccatatactacgcagactctgtgaagggc

SEQ ID NO: 12316 - protein, 17 aa, Artificial Sequence
  Description of Artificial Sequence: Synthetic peptide
HISSSGSTIYYADSVKG

SEQ ID NO: 12317 - DNA, 51 bp, Artificial Sequence
  Description of Artificial Sequence: Synthetic oligonucleotide
gttattagtggtagtggtagtaacacatactacgcagactccgtgaagggc

SEQ ID NO: 12318 - protein, 17 aa, Artificial Sequence
  Description of Artificial Sequence: Synthetic peptide
VISGSGSNTYYADSVKG

SEQ ID NO: 12319 - DNA, 51 bp, Artificial Sequence
  Description of Artificial Sequence: Synthetic oligonucleotide
cttatatggtatgatgtaactaataaatactatggagactccgtgaagggc

SEQ ID NO: 12320 - protein, 17 aa, Artificial Sequence
  Description of Artificial Sequence: Synthetic peptide
LIWYDVTNKYYGDSVKG

SEQ ID NO: 12321 - DNA, 51 bp, Artificial Sequence
  Description of Artificial Sequence: Synthetic oligonucleotide
tccattagtggtagtggtagtcacatatcctacgcggactcagtgaagggc

SEQ ID NO: 12322 - protein, 17 aa, Artificial Sequence
  Description of Artificial Sequence: Synthetic peptide
SISGSGSHISYADSVKG

SEQ ID NO: 12323 - DNA, 51 bp, Artificial Sequence; identical to SEQ ID NO: 12273
  Description of Artificial Sequence: Synthetic oligonucleotide

SEQ ID NO: 12324 - protein, 17 aa, Artificial Sequence
  Description of Artificial Sequence: Synthetic peptide
VISGSGGSTYYADSVKG

SEQ ID NO: 12325 - DNA, 51 bp, Artificial Sequence; identical to SEQ ID NO: 12127
  Description of Artificial Sequence: Synthetic oligonucleotide

SEQ ID NO: 12326 - protein, 17 aa, Artificial Sequence
  Description of Artificial Sequence: Synthetic peptide
IIWYDGSNKYYADSVKG

SEQ ID NO: 12327 - DNA, 51 bp, Artificial Sequence; identical to SEQ ID NO: 12269
  Description of Artificial Sequence: Synthetic oligonucleotide

SEQ ID NO: 12328 - protein, 17 aa, Artificial Sequence
  Description of Artificial Sequence: Synthetic peptide
VIWYDVTNKYYADSVKG

SEQ ID NO: 12329 - DNA, 51 bp, Artificial Sequence; identical to SEQ ID NO: 12123
  Description of Artificial Sequence: Synthetic oligonucleotide

SEQ ID NO: 12330 - protein, 17 aa, Artificial Sequence
  Description of Artificial Sequence: Synthetic peptide
VIWYDGSNKYYADSVKG

SEQ ID NO: 12331 - DNA, 51 bp, Artificial Sequence; identical to SEQ ID NO: 12231
  Description of Artificial Sequence: Synthetic oligonucleotide

SEQ ID NO: 12332 - protein, 17 aa, Artificial Sequence
  Description of Artificial Sequence: Synthetic peptide
VIWYEENNQYYADSVKG

SEQ ID NO: 12333 - DNA, 51 bp, Artificial Sequence
  Description of Artificial Sequence: Synthetic oligonucleotide
tccattagtggtagtagtagtttcatatactacgcagactcagtgaagggc

SEQ ID NO: 12334 - protein, 17 aa, Artificial Sequence
  Description of Artificial Sequence: Synthetic peptide
SISGSSSFIYYADSVKG

SEQ ID NO: 12335 - DNA, 51 bp, Artificial Sequence
  Description of Artificial Sequence: Synthetic oligonucleotide
tccattagtagtagtagtagtttcctatactacgcagactcagtgaagggc

SEQ ID NO: 12336 - protein, 17 aa, Artificial Sequence
  Description of Artificial Sequence: Synthetic peptide
SISSSSSFLYYADSVKG

SEQ ID NO: 12337 - DNA, 51 bp, Artificial Sequence; identical to SEQ ID NO: 12227
  Description of Artificial Sequence: Synthetic oligonucleotide

SEQ ID NO: 12338 - protein, 17 aa, Artificial Sequence
  Description of Artificial Sequence: Synthetic peptide
VIWFDGSNKYYADSVKG

SEQ ID NO: 12339 - DNA, 51 bp, Artificial Sequence
  Description of Artificial Sequence: Synthetic oligonucleotide
gttatatcatatgatggaagtaataaatactatgcagactccgtgaagggc

SEQ ID NO: 12340 - protein, 17 aa, Artificial Sequence
  Description of Artificial Sequence: Synthetic peptide
VISYDGSNKYYADSVKG

SEQ ID NO: 12341 - DNA, 51 bp, Artificial Sequence
  Description of Artificial Sequence: Synthetic oligonucleotide
gttatatggtatgatgtaactaatgaatactatgcagactccgtgaagggc

SEQ ID NO: 12342 - protein, 17 aa, Artificial Sequence
  Description of Artificial Sequence: Synthetic peptide
VIWYDVTNEYYADSVKG

SEQ ID NO: 12343 - DNA, 51 bp, Artificial Sequence
  Description of Artificial Sequence: Synthetic oligonucleotide
attattagtggtcgtggtgttaacacattctacgcagactccgtgaagggc

SEQ ID NO: 12344 - protein, 17 aa, Artificial Sequence
  Description of Artificial Sequence: Synthetic peptide
IISGRGVNTFYADSVKG

SEQ ID NO: 12345 - DNA, 51 bp, Artificial Sequence
  Description of Artificial Sequence: Synthetic oligonucleotide
gttattagtcgtagtggtggttacacatactacgcggactccgtgaagggc

SEQ ID NO: 12346 - protein, 17 aa, Artificial Sequence
  Description of Artificial Sequence: Synthetic peptide
VISRSGGYTYYADSVKG

SEQ ID NO: 12347 - DNA, 51 bp, Artificial Sequence
  Description of Artificial Sequence: Synthetic oligonucleotide
gttattagtggtagtggtggtaacacattctacgcagactccgtgaagggc

SEQ ID NO: 12348 - protein, 17 aa, Artificial Sequence
  Description of Artificial Sequence: Synthetic peptide
VISGSGGNTFYADSVKG

SEQ ID NO: 12349 - DNA, 51 bp, Artificial Sequence
  Description of Artificial Sequence: Synthetic oligonucleotide
gttattagtggtagtggtggtaccacatacttcgcagactccgtgaagggc

SEQ ID NO: 12350 - protein, 17 aa, Artificial Sequence
  Description of Artificial Sequence: Synthetic peptide
VISGSGGTTYFADSVKG

SEQ ID NO: 12351 - DNA, 51 bp, Artificial Sequence
  Description of Artificial Sequence: Synthetic oligonucleotide
tccatcagtggcagtggtagtcacatatactacgcggactcagtgaagggc

SEQ ID NO: 12352 - protein, 17 aa, Artificial Sequence
  Description of Artificial Sequence: Synthetic peptide
SISGSGSHIYYADSVKG

SEQ ID NO: 12353 - DNA, 51 bp, Artificial Sequence
  Description of Artificial Sequence: Synthetic oligonucleotide
gttattagtggtagtggtggtaccacatactacgcagactccgtgaagggc

SEQ ID NO: 12354 - protein, 17 aa, Artificial Sequence
  Description of Artificial Sequence: Synthetic peptide
VISGSGGTTYYADSVKG

SEQ ID NO: 12355 - DNA, 51 bp, Artificial Sequence
  Description of Artificial Sequence: Synthetic oligonucleotide
gttatgtggtatgatgaaagtaataaacactatgcagactccgtgaagggc

SEQ ID NO: 12356 - protein, 17 aa, Artificial Sequence
  Description of Artificial Sequence: Synthetic peptide
VMWYDESNKHYADSVKG

SEQ ID NO: 12357 - DNA, 48 bp, Artificial Sequence
  Description of Artificial Sequence: Synthetic oligonucleotide
agcatctattatagtgggagcacctactacaacccgtccctcaagagt

SEQ ID NO: 12358 - protein, 16 aa, Artificial Sequence
  Description of Artificial Sequence: Synthetic peptide
SIYYSGSTYYNPSLKS

SEQ ID NO: 12359 - DNA, 51 bp, Artificial Sequence; identical to SEQ ID NO: 12153
  Description of Artificial Sequence: Synthetic oligonucleotide

SEQ ID NO: 12360 - protein, 17 aa, Artificial Sequence
  Description of Artificial Sequence: Synthetic peptide
SISGSSSYIYYADSVKG

SEQ ID NO: 12361 - DNA, 51 bp, Artificial Sequence
  Description of Artificial Sequence: Synthetic oligonucleotide
tccattagtagtagtagtagttacatatactacgcagactcagtgaagggc

SEQ ID NO: 12362 - protein, 17 aa, Artificial Sequence
  Description of Artificial Sequence: Synthetic peptide
SISSSSSYIYYADSVKG

SEQ ID NO: 12363 - DNA, 51 bp, Artificial Sequence; identical to SEQ ID NO: 12231
  Description of Artificial Sequence: Synthetic oligonucleotide

SEQ ID NO: 12364 - protein, 17 aa, Artificial Sequence
  Description of Artificial Sequence: Synthetic peptide
VIWYEENNQYYADSVKG

SEQ ID NO: 12365 - DNA, 51 bp, Artificial Sequence
  Description of Artificial Sequence: Synthetic oligonucleotide
tccattagtggtagtagtagttacacatactacgcagactcagtgaagggc

SEQ ID NO: 12366 - protein, 17 aa, Artificial Sequence
  Description of Artificial Sequence: Synthetic peptide
SISGSSSYTYYADSVKG

SEQ ID NO: 12367 - DNA, 51 bp, Artificial Sequence
  Description of Artificial Sequence: Synthetic oligonucleotide
gctatgagtggtagtggtggtagcacatattatgtagactccgtgaagggc

SEQ ID NO: 12368 - protein, 17 aa, Artificial Sequence
  Description of Artificial Sequence: Synthetic peptide
AMSGSGGSTYYVDSVKG

SEQ ID NO: 12369 - DNA, 51 bp, Artificial Sequence
  Description of Artificial Sequence: Synthetic oligonucleotide
tggatgcaccctaacagtggtaacacaggctatgcacagaggttccagggc

SEQ ID NO: 12370 - protein, 17 aa, Artificial Sequence
  Description of Artificial Sequence: Synthetic peptide
WMHPNSGNTGYAQRFQG

SEQ ID NO: 12371 - DNA, 51 bp, Artificial Sequence
  Description of Artificial Sequence: Synthetic oligonucleotide
tccattagtggcagtagtagttacatatactacgcagactcagtgaaggcc

SEQ ID NO: 12372 - protein, 17 aa, Artificial Sequence
  Description of Artificial Sequence: Synthetic peptide
SISGSSSYIYYADSVKA

SEQ ID NO: 12373 - DNA, 51 bp, Artificial Sequence; identical to SEQ ID NO: 12283
  Description of Artificial Sequence: Synthetic oligonucleotide

SEQ ID NO: 12374 - protein, 17 aa, Artificial Sequence
  Description of Artificial Sequence: Synthetic peptide
VIWFDGSNKYYVDSVKG

SEQ ID NO: 12375 - DNA, 51 bp, Artificial Sequence
  Description of Artificial Sequence: Synthetic oligonucleotide
tccattagcggtagtagtagttacatctactacgcagactcactgaagggc

SEQ ID NO: 12376 - protein, 17 aa, Artificial Sequence
  Description of Artificial Sequence: Synthetic peptide
SISGSSSYIYYADSLKG

SEQ ID NO: 12377 - DNA, 48 bp, Artificial Sequence
  Description of Artificial Sequence: Synthetic oligonucleotide
aatatttattatagtgggagcacctacgacaacccgtccctcaagagt

SEQ ID NO: 12378 - protein, 16 aa, Artificial Sequence
  Description of Artificial Sequence: Synthetic peptide
NIYYSGSTYDNPSLKS

SEQ ID NO: 12379 - DNA, 51 bp, Artificial Sequence; identical to SEQ ID NO: 12227
  Description of Artificial Sequence: Synthetic oligonucleotide

SEQ ID NO: 12380 - protein, 17 aa, Artificial Sequence
  Description of Artificial Sequence: Synthetic peptide
VIWFDGSNKYYADSVKG

SEQ ID NO: 12381 - DNA, 51 bp, Artificial Sequence; identical to SEQ ID NO: 12263
  Description of Artificial Sequence: Synthetic oligonucleotide

SEQ ID NO: 12382 - protein, 17 aa, Artificial Sequence
  Description of Artificial Sequence: Synthetic peptide
VIWHDGSNKYYADSVKG

SEQ ID NO: 12383 - DNA, 48 bp, Artificial Sequence
  Description of Artificial Sequence: Synthetic oligonucleotide
aatatctattatagtgggaccacctcctacaacccgtccctcaagagt

SEQ ID NO: 12384 - protein, 16 aa, Artificial Sequence
  Description of Artificial Sequence: Synthetic peptide
NIYYSGTTSYNPSLKS

SEQ ID NO: 12385 - DNA, 51 bp, Artificial Sequence
  Description of Artificial Sequence: Synthetic oligonucleotide
gctattagtggtagtggtggtttcacatactacgcagactccgtgaagggc

SEQ ID NO: 12386 - protein, 17 aa, Artificial Sequence
  Description of Artificial Sequence: Synthetic peptide
AISGSGGFTYYADSVKG

SEQ ID NO: 12387 - DNA, 51 bp, Artificial Sequence; identical to SEQ ID NO: 12123
  Description of Artificial Sequence: Synthetic oligonucleotide

SEQ ID NO: 12388 - protein, 17 aa, Artificial Sequence
  Description of Artificial Sequence: Synthetic peptide
VIWYDGSNKYYADSVKG

SEQ ID NO: 12389 - DNA, 51 bp, Artificial Sequence
  Description of Artificial Sequence: Synthetic oligonucleotide
gttattagtggtagtggtggtagcacatattacgcagactccgtgaagggc

SEQ ID NO: 12390 - protein, 17 aa, Artificial Sequence
  Description of Artificial Sequence: Synthetic peptide
VISGSGGSTYYADSVKG

SEQ ID NO: 12391 - DNA, 51 bp, Artificial Sequence
  Description of Artificial Sequence: Synthetic oligonucleotide
gttatatggtatgatgaaaataataaatactatgtagactccgtgaagggc

SEQ ID NO: 12392 - protein, 17 aa, Artificial Sequence
  Description of Artificial Sequence: Synthetic peptide
VIWYDENNKYYVDSVKG

SEQ ID NO: 12393 - DNA, 51 bp, Artificial Sequence; identical to SEQ ID NO: 12253
  Description of Artificial Sequence: Synthetic oligonucleotide

SEQ ID NO: 12394 - protein, 17 aa, Artificial Sequence
  Description of Artificial Sequence: Synthetic peptide
VISGRGGNTFYADSVKG

SEQ ID NO: 12395 - DNA, 51 bp, Artificial Sequence
  Description of Artificial Sequence: Synthetic oligonucleotide
gttatgtggtatgatggaagtaataaatattatgcagactccgtgaagggc

SEQ ID NO: 12396 - protein, 17 aa, Artificial Sequence
  Description of Artificial Sequence: Synthetic peptide
VMWYDGSNKYYADSVKG

SEQ ID NO: 12397 - DNA, 51 bp, Artificial Sequence
  Description of Artificial Sequence: Synthetic oligonucleotide
attattagtggtcgtggtactaacacattctacgcagactccgtgaagggc

SEQ ID NO: 12398 - protein, 17 aa, Artificial Sequence
  Description of Artificial Sequence: Synthetic peptide
IISGRGTNTFYADSVKG

SEQ ID NO: 12399 - DNA, 51 bp, Artificial Sequence
  Description of Artificial Sequence: Synthetic oligonucleotide
attatatcatatgatggaagtaataaatactatgcagactccgtgaagggc

SEQ ID NO: 12400 - protein, 17 aa, Artificial Sequence
  Description of Artificial Sequence: Synthetic peptide
IISYDGSNKYYADSVKG

SEQ ID NO: 12401 - DNA, 48 bp, Artificial Sequence
  Description of Artificial Sequence: Synthetic oligonucleotide
agtatctattatagtgggagcgcccagtacaacccgtccctcaagagt

SEQ ID NO: 12402 - protein, 16 aa, Artificial Sequence
  Description of Artificial Sequence: Synthetic peptide
SIYYSGSAQYNPSLKS

SEQ ID NO: 12403 - DNA, 48 bp, Artificial Sequence
  Description of Artificial Sequence: Synthetic oligonucleotide
aatatttattatagtgggaccacttacaacaacccgtccctcaagagt

SEQ ID NO: 12404 - protein, 16 aa, Artificial Sequence
  Description of Artificial Sequence: Synthetic peptide
NIYYSGTTYNNPSLKS

SEQ ID NO: 12405 - DNA, 48 bp, Artificial Sequence
  Description of Artificial Sequence: Synthetic oligonucleotide
agtatctattatagtgggagcgccaactacaacccgtccctcaagagt

SEQ ID NO: 12406 - protein, 16 aa, Artificial Sequence
  Description of Artificial Sequence: Synthetic peptide
SIYYSGSANYNPSLKS

SEQ ID NO: 12407 - DNA, 51 bp, Artificial Sequence
  Description of Artificial Sequence: Synthetic oligonucleotide
tacattagtagtagtagtagtaccatatactatgcagactctgtgaagggc

SEQ ID NO: 12408 - protein, 17 aa, Artificial Sequence
  Description of Artificial Sequence: Synthetic peptide
YISSSSSTIYYADSVKG

SEQ ID NO: 12409 - DNA, 48 bp, Artificial Sequence
  Description of Artificial Sequence: Synthetic oligonucleotide
cgtatctataccagtgggatcaccaactacaacccctccctcaagagt

SEQ ID NO: 12410 - protein, 16 aa, Artificial Sequence
  Description of Artificial Sequence: Synthetic peptide
RIYTSGITNYNPSLKS

SEQ ID NO: 12411 - DNA, 51 bp, Artificial Sequence; identical to SEQ ID NO: 12227
  Description of Artificial Sequence: Synthetic oligonucleotide

SEQ ID NO: 12412 - protein, 17 aa, Artificial Sequence
  Description of Artificial Sequence: Synthetic peptide
VIWFDGSNKYYADSVKG

SEQ ID NO: 12413 - DNA, 48 bp, Artificial Sequence
  Description of Artificial Sequence: Synthetic oligonucleotide
aatatctattatagtggggccacctattataattcgtccctcaagagt

SEQ ID NO: 12414 - protein, 16 aa, Artificial Sequence
  Description of Artificial Sequence: Synthetic peptide
NIYYSGATYYNSSLKS

SEQ ID NO: 12415 - DNA, 51 bp, Artificial Sequence; identical to SEQ ID NO: 12133
  Description of Artificial Sequence: Synthetic oligonucleotide

SEQ ID NO: 12416 - protein, 17 aa, Artificial Sequence
  Description of Artificial Sequence: Synthetic peptide
VIWYDGSNKYYVDSVKG

SEQ ID NO: 12417 - DNA, 48 bp, Artificial Sequence
  Description of Artificial Sequence: Synthetic oligonucleotide
aatatctattatagtgggagcacctactacaacccgtccgtcaagagt

SEQ ID NO: 12418 - protein, 16 aa, Artificial Sequence
  Description of Artificial Sequence: Synthetic peptide
NIYYSGSTYYNPSVKS

SEQ ID NO: 12419 - DNA, 51 bp, Artificial Sequence
  Description of Artificial Sequence: Synthetic oligonucleotide
gttattagtggtagtggtggtaccacatataacacagactccgtgaagggc

SEQ ID NO: 12420 - protein, 17 aa, Artificial Sequence
  Description of Artificial Sequence: Synthetic peptide
VISGSGGTTYNTDSVKG

SEQ ID NO: 12421 - DNA, 51 bp, Artificial Sequence
  Description of Artificial Sequence: Synthetic oligonucleotide
gctattagtggtagtggtggtagcacatactacgcagactccgtgaagggc

SEQ ID NO: 12422 - protein, 17 aa, Artificial Sequence
  Description of Artificial Sequence: Synthetic peptide
AISGSGGSTYYADSVKG

SEQ ID NO: 12423 - DNA, 51 bp, Artificial Sequence
  Description of Artificial Sequence: Synthetic oligonucleotide
tccattagtggtagtagtagttacatatggtatgtagactcagtgaagggc

SEQ ID NO: 12424 - protein, 17 aa, Artificial Sequence
  Description of Artificial Sequence: Synthetic peptide
SISGSSSYIWYVDSVKG

SEQ ID NO: 12425 - DNA, 51 bp, Artificial Sequence; identical to SEQ ID NO: 12123
  Description of Artificial Sequence: Synthetic oligonucleotide

SEQ ID NO: 12426 - protein, 17 aa, Artificial Sequence
  Description of Artificial Sequence: Synthetic peptide
VIWYDGSNKYYADSVKG

SEQ ID NO: 12427 - DNA, 51 bp, Artificial Sequence; identical to SEQ ID NO: 12361
  Description of Artificial Sequence: Synthetic oligonucleotide

SEQ ID NO: 12428 - protein, 17 aa, Artificial Sequence
  Description of Artificial Sequence: Synthetic peptide
SISSSSSYIYYADSVKG

SEQ ID NO: 12429 - DNA, 51 bp, Artificial Sequence; identical to SEQ ID NO: 12361
  Description of Artificial Sequence: Synthetic oligonucleotide

SEQ ID NO: 12430 - protein, 17 aa, Artificial Sequence
  Description of Artificial Sequence: Synthetic peptide
SISSSSSYIYYADSVKG

SEQ ID NO: 12431 - DNA, 51 bp, Artificial Sequence; identical to SEQ ID NO: 12293
  Description of Artificial Sequence: Synthetic oligonucleotide

SEQ ID NO: 12432 - protein, 17 aa, Artificial Sequence
  Description of Artificial Sequence: Synthetic peptide
IISGRGGNTFYADSVKG

SEQ ID NO: 12433 - DNA, 51 bp, Artificial Sequence; identical to SEQ ID NO: 12301
  Description of Artificial Sequence: Synthetic oligonucleotide

SEQ ID NO: 12434 - protein, 17 aa, Artificial Sequence
  Description of Artificial Sequence: Synthetic peptide
VIWYDESNKYYADSVKG

SEQ ID NO: 12435 - DNA, 51 bp, Artificial Sequence
  Description of Artificial Sequence: Synthetic oligonucleotide
ggtattagtggtagtggaggtaacacaccctacgcagactccgtgaagggc

SEQ ID NO: 12436 - protein, 17 aa, Artificial Sequence
  Description of Artificial Sequence: Synthetic peptide
GISGSGGNTPYADSVKG

SEQ ID NO: 12437 - DNA, 48 bp, Artificial Sequence
  Description of Artificial Sequence: Synthetic oligonucleotide
aatatttattatagtgggagcacctaccacaacccgtctctcaagagt

SEQ ID NO: 12438 - protein, 16 aa, Artificial Sequence
  Description of Artificial Sequence: Synthetic peptide
NIYYSGSTYHNPSLKS

SEQ ID NO: 12439 - DNA, 51 bp, Artificial Sequence
  Description of Artificial Sequence: Synthetic oligonucleotide
gttatctggtatgatggaaataataaatactatgcagactccgtgaagggc

SEQ ID NO: 12440 - protein, 17 aa, Artificial Sequence
  Description of Artificial Sequence: Synthetic peptide
VIWYDGNNKYYADSVKG

SEQ ID NO: 12441 - DNA, 48 bp, Artificial Sequence; identical to SEQ ID NO: 12147
  Description of Artificial Sequence: Synthetic oligonucleotide

SEQ ID NO: 12442 - protein, 16 aa, Artificial Sequence
  Description of Artificial Sequence: Synthetic peptide
YIYYSGSTYYNPSLKS

SEQ ID NO: 12443 - DNA, 51 bp, Artificial Sequence; identical to SEQ ID NO: 12391
  Description of Artificial Sequence: Synthetic oligonucleotide

SEQ ID NO: 12444 - protein, 17 aa, Artificial Sequence
  Description of Artificial Sequence: Synthetic peptide
VIWYDENNKYYVDSVKG

SEQ ID NO: 12445 - DNA, 51 bp, Artificial Sequence
  Description of Artificial Sequence: Synthetic oligonucleotide
attatatcatatgctggaagtaataaatcctatgcagactccgtgaagggc

SEQ ID NO: 12446 - protein, 17 aa, Artificial Sequence
  Description of Artificial Sequence: Synthetic peptide
IISYAGSNKSYADSVKG

SEQ ID NO: 12447 - DNA, 48 bp, Artificial Sequence
  Description of Artificial Sequence: Synthetic oligonucleotide
agtatctattatagtgggagcgcctcttacaacccgtccctcaagagt

SEQ ID NO: 12448 - protein, 16 aa, Artificial Sequence
  Description of Artificial Sequence: Synthetic peptide
SIYYSGSASYNPSLKS

SEQ ID NO: 12449 - DNA, 51 bp, Artificial Sequence; identical to SEQ ID NO: 12185
  Description of Artificial Sequence: Synthetic oligonucleotide

SEQ ID NO: 12450 - protein, 17 aa, Artificial Sequence
  Description of Artificial Sequence: Synthetic peptide
VIWYDGSNKYYADSVKV

SEQ ID NO: 12451 - DNA, 51 bp, Artificial Sequence; identical to SEQ ID NO: 12157
  Description of Artificial Sequence: Synthetic oligonucleotide

SEQ ID NO: 12452 - protein, 17 aa, Artificial Sequence
  Description of Artificial Sequence: Synthetic peptide
VLSGSGGSTFYADSVKG

SEQ ID NO: 12453 - DNA, 51 bp, Artificial Sequence
  Description of Artificial Sequence: Synthetic oligonucleotide
gttatatggtttgatggaaataataaatactatgtagactccgtgaagggc

SEQ ID NO: 12454 - protein, 17 aa, Artificial Sequence
  Description of Artificial Sequence: Synthetic peptide
VIWFDGNNKYYVDSVKG

SEQ ID NO: 12455 - DNA, 51 bp, Artificial Sequence
  Description of Artificial Sequence: Synthetic oligonucleotide
attattagtggtagtggtggttacacatactacgcggactccgtgaagggc

SEQ ID NO: 12456 - protein, 17 aa, Artificial Sequence
  Description of Artificial Sequence: Synthetic peptide
IISGSGGYTYYADSVKG

SEQ ID NO: 12457 - DNA, 51 bp, Artificial Sequence
  Description of Artificial Sequence: Synthetic oligonucleotide
gttatatggtatgaggaaaataataaagactatgtagactccgtgaagggc

SEQ ID NO: 12458 - protein, 17 aa, Artificial Sequence
  Description of Artificial Sequence: Synthetic peptide
VIWYEENNKDYVDSVKG

SEQ ID NO: 12459 - DNA, 48 bp, Artificial Sequence
  Description of Artificial Sequence: Synthetic oligonucleotide
aatatttattatagtgggagcacctacaacaacccgtccctcaagagt

SEQ ID NO: 12460 - protein, 16 aa, Artificial Sequence
  Description of Artificial Sequence: Synthetic peptide
NIYYSGSTYNNPSLKS

SEQ ID NO: 12461 - DNA, 51 bp, Artificial Sequence; identical to SEQ ID NO: 12123
  Description of Artificial Sequence: Synthetic oligonucleotide

SEQ ID NO: 12462 - protein, 17 aa, Artificial Sequence
  Description of Artificial Sequence: Synthetic peptide
VIWYDGSNKYYADSVKG

SEQ ID NO: 12463 - DNA, 51 bp, Artificial Sequence; identical to SEQ ID NO: 12161
  Description of Artificial Sequence: Synthetic oligonucleotide

SEQ ID NO: 12464 - protein, 17 aa, Artificial Sequence
  Description of Artificial Sequence: Synthetic peptide
WMHPNSGNTGYAQKFQG

SEQ ID NO: 12465 - DNA, 51 bp, Artificial Sequence; identical to SEQ ID NO: 12123
  Description of Artificial Sequence: Synthetic oligonucleotide

SEQ ID NO: 12466 - protein, 17 aa, Artificial Sequence
  Description of Artificial Sequence: Synthetic peptide
VIWYDGSNKYYADSVKG

SEQ ID NO: 12467 - DNA, 51 bp, Artificial Sequence
  Description of Artificial Sequence: Synthetic oligonucleotide
gctattagtggtagtggtggttacacatactacgcagactccgtgaagggc

SEQ ID NO: 12468 - protein, 17 aa, Artificial Sequence
  Description of Artificial Sequence: Synthetic peptide
AISGSGGYTYYADSVKG

SEQ ID NO: 12469 - DNA, 51 bp, Artificial Sequence
  Description of Artificial Sequence: Synthetic oligonucleotide
actattagtggtcgtggtggtcacacatactacgcagactccgtgaagggc

SEQ ID NO: 12470 - protein, 17 aa, Artificial Sequence
  Description of Artificial Sequence: Synthetic peptide
TISGRGGHTYYADSVKG

SEQ ID NO: 12471 - DNA, 51 bp, Artificial Sequence; identical to SEQ ID NO: 12269
  Description of Artificial Sequence: Synthetic oligonucleotide

SEQ ID NO: 12472 - protein, 17 aa, Artificial Sequence
  Description of Artificial Sequence: Synthetic peptide
VIWYDVTNKYYADSVKG

SEQ ID NO: 12473 - DNA, 48 bp, Artificial Sequence
  Description of Artificial Sequence: Synthetic oligonucleotide
aatatctattatagtgggtatagttactacaatccgtccctcaagagt

SEQ ID NO: 12474 - protein, 16 aa, Artificial Sequence
  Description of Artificial Sequence: Synthetic peptide
NIYYSGYSYYNPSLKS

SEQ ID NO: 12475 - DNA, 57 bp, Artificial Sequence
  Description of Artificial Sequence: Synthetic oligonucleotide
cgtattaaaagcaaaactgatggtgggacaacagactacgctgcacccgtgaaaggc

SEQ ID NO: 12476 - protein, 19 aa, Artificial Sequence
  Description of Artificial Sequence: Synthetic peptide
RIKSKTDGGTTDYAAPVKG

SEQ ID NO: 12477 - DNA, 51 bp, Artificial Sequence
  Description of Artificial Sequence: Synthetic oligonucleotide
gttatatggtatgagggaagtaataaatactatgtagactccgtgaggggc

SEQ ID NO: 12478 - protein, 17 aa, Artificial Sequence
  Description of Artificial Sequence: Synthetic peptide
VIWYEGSNKYYVDSVRG

SEQ ID NO: 12479 - DNA, 51 bp, Artificial Sequence; identical to SEQ ID NO: 12253
  Description of Artificial Sequence: Synthetic oligonucleotide

SEQ ID NO: 12480 - protein, 17 aa, Artificial Sequence
  Description of Artificial Sequence: Synthetic peptide
VISGRGGNTFYADSVKG

SEQ ID NO: 12481 - DNA, 48 bp, Artificial Sequence
  Description of Artificial Sequence: Synthetic oligonucleotide
aatatctattatagtgggagcacctactacaacccgtccctcaagagt

SEQ ID NO: 12482 - protein, 16 aa, Artificial Sequence
  Description of Artificial Sequence: Synthetic peptide
NIYYSGSTYYNPSLKS

SEQ ID NO: 12483 - DNA, 51 bp, Artificial Sequence
  Description of Artificial Sequence: Synthetic oligonucleotide
gttatatggtatgatgaaactaataaatactatgcagactccgtgaagggc

SEQ ID NO: 12484 - protein, 17 aa, Artificial Sequence
  Description of Artificial Sequence: Synthetic peptide
VIWYDETNKYYADSVKG

SEQ ID NO: 12485 - DNA, 51 bp, Artificial Sequence
  Description of Artificial Sequence: Synthetic oligonucleotide
gttatatggtatgatgtaactaataaatactatacaggctccgtgaagggc

SEQ ID NO: 12486 - protein, 17 aa, Artificial Sequence
  Description of Artificial Sequence: Synthetic peptide
VIWYDVTNKYYTGSVKG

SEQ ID NO: 12487 - DNA, 51 bp, Artificial Sequence; identical to SEQ ID NO: 12123
  Description of Artificial Sequence: Synthetic oligonucleotide

SEQ ID NO: 12488 - protein, 17 aa, Artificial Sequence
  Description of Artificial Sequence: Synthetic peptide
VIWYDGSNKYYADSVKG

SEQ ID NO: 12489 - DNA, 51 bp, Artificial Sequence
  Description of Artificial Sequence: Synthetic oligonucleotide
tccactagtagtagtgatagttatatatactacgcagactcagtgaagggc

SEQ ID NO: 12490 - protein, 17 aa, Artificial Sequence
  Description of Artificial Sequence: Synthetic peptide
STSSSDSYIYYADSVKG

SEQ ID NO: 12491 - DNA, 51 bp, Artificial Sequence
  Description of Artificial Sequence: Synthetic oligonucleotide
gttatatggtatgatgaaaataataaatactatgcagactccgtgaagggc

SEQ ID NO: 12492 - protein, 17 aa, Artificial Sequence
  Description of Artificial Sequence: Synthetic peptide
VIWYDENNKYYADSVKG

SEQ ID NO: 12493 - DNA, 51 bp, Artificial Sequence
  Description of Artificial Sequence: Synthetic oligonucleotide
gttatatggtatgatgaaagtaataaatactatgcagactccatgaagggc

SEQ ID NO: 12494 - protein, 17 aa, Artificial Sequence
  Description of Artificial Sequence: Synthetic peptide
VIWYDESNKYYADSMKG

SEQ ID NO: 12495 - DNA, 51 bp, Artificial Sequence
  Description of Artificial Sequence: Synthetic oligonucleotide
gttatatggtatgatggaactgataaatactatgtagactccgtgaagggc

SEQ ID NO: 12496 - protein, 17 aa, Artificial Sequence
  Description of Artificial Sequence: Synthetic peptide
VIWYDGTDKYYVDSVKG

SEQ ID NO: 12497 - DNA, 51 bp, Artificial Sequence; identical to SEQ ID NO: 12123
  Description of Artificial Sequence: Synthetic oligonucleotide

SEQ ID NO: 12498 - protein, 17 aa, Artificial Sequence
  Description of Artificial Sequence: Synthetic peptide
VIWYDGSNKYYADSVKG

SEQ ID NO: 12499 - DNA, 51 bp, Artificial Sequence
  Description of Artificial Sequence: Synthetic oligonucleotide
tggatgtaccctaacagtggtaacacaggctatgcacagaaattccagggc

SEQ ID NO: 12500 - protein, 17 aa, Artificial Sequence
  Description of Artificial Sequence: Synthetic peptide
WMYPNSGNTGYAQKFQG

SEQ ID NO: 12501 - DNA, 51 bp, Artificial Sequence
  Description of Artificial Sequence: Synthetic oligonucleotide
attatatggtatgatggaagttataaatactatgcagactccgtgaagggc

SEQ ID NO: 12502 - protein, 17 aa, Artificial Sequence
  Description of Artificial Sequence: Synthetic peptide
IIWYDGSYKYYADSVKG

SEQ ID NO: 12503 - DNA, 51 bp, Artificial Sequence
  Description of Artificial Sequence: Synthetic oligonucleotide
gttatatggtatgatgaaagtaataaatactatggagactccgtgaagggc

SEQ ID NO: 12504 - protein, 17 aa, Artificial Sequence
  Description of Artificial Sequence: Synthetic peptide
VIWYDESNKYYGDSVKG

SEQ ID NO: 12505 - DNA, 51 bp, Artificial Sequence
  Description of Artificial Sequence: Synthetic oligonucleotide
tggatgcaccctgacagtggtaacacaggctatgcacagaagttccagggc

SEQ ID NO: 12506 - protein, 17 aa, Artificial Sequence
  Description of Artificial Sequence: Synthetic peptide
WMHPDSGNTGYAQKFQG

SEQ ID NO: 12507 - DNA, 51 bp, Artificial Sequence; identical to SEQ ID NO: 12123
  Description of Artificial Sequence: Synthetic oligonucleotide

SEQ ID NO: 12508 - protein, 17 aa, Artificial Sequence
  Description of Artificial Sequence: Synthetic peptide
VIWYDGSNKYYADSVKG

SEQ ID NO: 12509 - DNA, 51 bp, Artificial Sequence
  Description of Artificial Sequence: Synthetic oligonucleotide
gttatatggtatgatgaaagtaataactactatgcagactccgtgaagggc

SEQ ID NO: 12510 - protein, 17 aa, Artificial Sequence
  Description of Artificial Sequence: Synthetic peptide
VIWYDESNNYYADSVKG

SEQ ID NO: 12511 - DNA, 51 bp, Artificial Sequence
  Description of Artificial Sequence: Synthetic oligonucleotide
gctattagtggtcgtggtggtagcacattctacgcagactccgtgaagggc

SEQ ID NO: 12512 - protein, 17 aa, Artificial Sequence
  Description of Artificial Sequence: Synthetic peptide
AISGRGGSTFYADSVKG

SEQ ID NO: 12513 - DNA, 51 bp, Artificial Sequence
  Description of Artificial Sequence: Synthetic oligonucleotide
gctattagtggtcgtggtggaagcatattccacgcagactccgtgaagggc

SEQ ID NO: 12514 - protein, 17 aa, Artificial Sequence
  Description of Artificial Sequence: Synthetic peptide
AISGRGGSIFHADSVKG

SEQ ID NO: 12515 - DNA, 51 bp, Artificial Sequence
  Description of Artificial Sequence: Synthetic oligonucleotide
gttatttggtatgatggaaataataaatattatgcagactccgtgaagggc

SEQ ID NO: 12516 - protein, 17 aa, Artificial Sequence
  Description of Artificial Sequence: Synthetic peptide
VIWYDGNNKYYADSVKG

SEQ ID NO: 12517 - DNA, 51 bp, Artificial Sequence
  Description of Artificial Sequence: Synthetic oligonucleotide
tccattagtagtagtagtagtaccatatactacgcagactctgtgaagggc

SEQ ID NO: 12518 - protein, 17 aa, Artificial Sequence
  Description of Artificial Sequence: Synthetic peptide
SISSSSSTIYYADSVKG

SEQ ID NO: 12519 - DNA, 51 bp, Artificial Sequence
  Description of Artificial Sequence: Synthetic oligonucleotide
tccattagtggtagtagtagttacatatactacgcggactcagtgaagggc

SEQ ID NO: 12520 - protein, 17 aa, Artificial Sequence
  Description of Artificial Sequence: Synthetic peptide
SISGSSSYIYYADSVKG

SEQ ID NO: 12521 - DNA, 51 bp, Artificial Sequence
  Description of Artificial Sequence: Synthetic oligonucleotide
gttattagtggtagtggtgttaacacattctacgcagactccgtgaagggc

SEQ ID NO: 12522 - protein, 17 aa, Artificial Sequence
  Description of Artificial Sequence: Synthetic peptide
VISGSGVNTFYADSVKG

SEQ ID NO: 12523 - DNA, 51 bp, Artificial Sequence; identical to SEQ ID NO: 12123
  Description of Artificial Sequence: Synthetic oligonucleotide

SEQ ID NO: 12524 - protein, 17 aa, Artificial Sequence
  Description of Artificial Sequence: Synthetic peptide
VIWYDGSNKYYADSVKG

SEQ ID NO: 12525 - DNA, 51 bp, Artificial Sequence; identical to SEQ ID NO: 12301
  Description of Artificial Sequence: Synthetic oligonucleotide

SEQ ID NO: 12526 - protein, 17 aa, Artificial Sequence
  Description of Artificial Sequence: Synthetic peptide
VIWYDESNKYYADSVKG

SEQ ID NO: 12527 - DNA, 51 bp, Artificial Sequence
  Description of Artificial Sequence: Synthetic oligonucleotide
tggatgcaccctaacagtggtaacacaggctatgcacagaaattccagggc

SEQ ID NO: 12528 - protein, 17 aa, Artificial Sequence
  Description of Artificial Sequence: Synthetic peptide
WMHPNSGNTGYAQKFQG

SEQ ID NO: 12529 - DNA, 51 bp, Artificial Sequence; identical to SEQ ID NO: 12421
  Description of Artificial Sequence: Synthetic oligonucleotide

SEQ ID NO: 12530 - protein, 17 aa, Artificial Sequence
  Description of Artificial Sequence: Synthetic peptide
AISGSGGSTYYADSVKG

SEQ ID NO: 12531 - DNA, 51 bp, Artificial Sequence
  Description of Artificial Sequence: Synthetic oligonucleotide
gctattagtggtcgtggtggtagcacattccacgcagactccgtgaagggc

SEQ ID NO: 12532 - protein, 17 aa, Artificial Sequence
  Description of Artificial Sequence: Synthetic peptide
AISGRGGSTFHADSVKG

SEQ ID NO: 12533 - DNA, 51 bp, Artificial Sequence; identical to SEQ ID NO: 12153
  Description of Artificial Sequence: Synthetic oligonucleotide

SEQ ID NO: 12534 - protein, 17 aa, Artificial Sequence
  Description of Artificial Sequence: Synthetic peptide
SISGSSSYIYYADSVKG

SEQ ID NO: 12535 - DNA, 51 bp, Artificial Sequence
  Description of Artificial Sequence: Synthetic oligonucleotide
gttatatggtatgaggaaagtaataaatactatacagagtccgtgaagggc

SEQ ID NO: 12536 - protein, 17 aa, Artificial Sequence
  Description of Artificial Sequence: Synthetic peptide
VIWYEESNKYYTESVKG

SEQ ID NO: 12537 - DNA, 51 bp, Artificial Sequence
  Description of Artificial Sequence: Synthetic oligonucleotide
gttatatggtatgaaggaagtaataaatactatgtagactccgtgaagggc

SEQ ID NO: 12538 - protein, 17 aa, Artificial Sequence
  Description of Artificial Sequence: Synthetic peptide
VIWYEGSNKYYVDSVKG

SEQ ID NO: 12539 - DNA, 51 bp, Artificial Sequence; identical to SEQ ID NO: 12123
  Description of Artificial Sequence: Synthetic oligonucleotide

SEQ ID NO: 12540 - protein, 17 aa, Artificial Sequence
  Description of Artificial Sequence: Synthetic peptide
VIWYDGSNKYYADSVKG

SEQ ID NO: 12541 - DNA, 51 bp, Artificial Sequence
  Description of Artificial Sequence: Synthetic oligonucleotide
tccattagtggtagtagtagtaacatatactacacagactcagtgaagggc

SEQ ID NO: 12542 - protein, 17 aa, Artificial Sequence
  Description of Artificial Sequence: Synthetic peptide
SISGSSSNIYYTDSVKG

SEQ ID NO: 12543 - DNA, 51 bp, Artificial Sequence
  Description of Artificial Sequence: Synthetic oligonucleotide
gttatatggtatgatgcaaataataaatactatgcagactccgtgaagggc

SEQ ID NO: 12544 - protein, 17 aa, Artificial Sequence
  Description of Artificial Sequence: Synthetic peptide
VIWYDANNKYYADSVKG

SEQ ID NO: 12545 - DNA, 51 bp, Artificial Sequence
  Description of Artificial Sequence: Synthetic oligonucleotide
gttatatggtataatgaaaataataaatactatgcagactccgtgaagggc

SEQ ID NO: 12546 - protein, 17 aa, Artificial Sequence
  Description of Artificial Sequence: Synthetic peptide
VIWYNENNKYYADSVKG

SEQ ID NO: 12547 - DNA, 51 bp, Artificial Sequence; identical to SEQ ID NO: 12531
  Description of Artificial Sequence: Synthetic oligonucleotide

SEQ ID NO: 12548 - protein, 17 aa, Artificial Sequence
  Description of Artificial Sequence: Synthetic peptide
AISGRGGSTFHADSVKG

SEQ ID NO: 12549 - DNA, 51 bp, Artificial Sequence
  Description of Artificial Sequence: Synthetic oligonucleotide
gttattagtggtagtggtggtagctcattctacgcagactccgtgaagggc

SEQ ID NO: 12550 - protein, 17 aa, Artificial Sequence
  Description of Artificial Sequence: Synthetic peptide
VISGSGGSSFYADSVKG

SEQ ID NO: 12551 - DNA, 51 bp, Artificial Sequence; identical to SEQ ID NO: 12531
  Description of Artificial Sequence: Synthetic oligonucleotide

SEQ ID NO: 12552 - protein, 17 aa, Artificial Sequence
  Description of Artificial Sequence: Synthetic peptide
AISGRGGSTFHADSVKG

SEQ ID NO: 12553 - DNA, 51 bp, Artificial Sequence; identical to SEQ ID NO: 12491
  Description of Artificial Sequence: Synthetic oligonucleotide

SEQ ID NO: 12554 - protein, 17 aa, Artificial Sequence
  Description of Artificial Sequence: Synthetic peptide
VIWYDENNKYYADSVKG

SEQ ID NO: 12555 - DNA, 51 bp, Artificial Sequence; identical to SEQ ID NO: 12493
  Description of Artificial Sequence: Synthetic oligonucleotide

SEQ ID NO: 12556 - protein, 17 aa, Artificial Sequence
  Description of Artificial Sequence: Synthetic peptide
VIWYDESNKYYADSMKG

SEQ ID NO: 12557 - DNA, 51 bp, Artificial Sequence
  Description of Artificial Sequence: Synthetic oligonucleotide
tggatgaaccctaacagtggtaacacaggctatgcacagagattccagggc

SEQ ID NO: 12558 - protein, 17 aa, Artificial Sequence
  Description of Artificial Sequence: Synthetic peptide
WMNPNSGNTGYAQRFQG

SEQ ID NO: 12559 - DNA, 51 bp, Artificial Sequence; identical to SEQ ID NO: 12123
  Description of Artificial Sequence: Synthetic oligonucleotide

SEQ ID NO: 12560 - protein, 17 aa, Artificial Sequence
  Description of Artificial Sequence: Synthetic peptide
VIWYDGSNKYYADSVKG

SEQ ID NO: 12561 - DNA, 51 bp, Artificial Sequence
  Description of Artificial Sequence: Synthetic oligonucleotide
gctattagtggtagtggaggtaacacattctacgcagactccgtgaagggc

SEQ ID NO: 12562 - protein, 17 aa, Artificial Sequence
  Description of Artificial Sequence: Synthetic peptide
AISGSGGNTFYADSVKG

SEQ ID NO: 12563 - DNA, 51 bp, Artificial Sequence; identical to SEQ ID NO: 12227
  Description of Artificial Sequence: Synthetic oligonucleotide

SEQ ID NO: 12564 - protein, 17 aa, Artificial Sequence
  Description of Artificial Sequence: Synthetic peptide
VIWFDGSNKYYADSVKG

SEQ ID NO: 12565 - DNA, 51 bp, Artificial Sequence; identical to SEQ ID NO: 12503
  Description of Artificial Sequence: Synthetic oligonucleotide

SEQ ID NO: 12566 - protein, 17 aa, Artificial Sequence
  Description of Artificial Sequence: Synthetic peptide
VIWYDESNKYYGDSVKG

SEQ ID NO: 12567 - DNA, 51 bp, Artificial Sequence
  Description of Artificial Sequence: Synthetic oligonucleotide
gttatatggcatgatggaagtaataaatactatgtagactccgtgaagggc

SEQ ID NO: 12568 - protein, 17 aa, Artificial Sequence
  Description of Artificial Sequence: Synthetic peptide
VIWHDGSNKYYVDSVKG

SEQ ID NO: 12569 - DNA, 51 bp, Artificial Sequence
  Description of Artificial Sequence: Synthetic oligonucleotide
gctattagtggtcgtggtggtagcacattcaacgcagactccgtgaagggc

SEQ ID NO: 12570 - protein, 17 aa, Artificial Sequence
  Description of Artificial Sequence: Synthetic peptide
AISGRGGSTFNADSVKG

SEQ ID NO: 12571 - DNA, 51 bp, Artificial Sequence
  Description of Artificial Sequence: Synthetic oligonucleotide
tcaattagtagtagtagtagttacatatactacgcagactcagtgaagggc

SEQ ID NO: 12572 - protein, 17 aa, Artificial Sequence
  Description of Artificial Sequence: Synthetic peptide
SISSSSSYIYYADSVKG

SEQ ID NO: 12573 - DNA, 51 bp, Artificial Sequence
  Description of Artificial Sequence: Synthetic oligonucleotide
gttattagtggtggtggtggtagcacatactacgcagactccgtgaagggc

SEQ ID NO: 12574 - protein, 17 aa, Artificial Sequence
  Description of Artificial Sequence: Synthetic peptide
VISGGGGSTYYADSVKG

SEQ ID NO: 12575 - DNA, 51 bp, Artificial Sequence
  Description of Artificial Sequence: Synthetic oligonucleotide
gttatatggtatgatggaagtaataaatattatgcagactccgtgaagggc

SEQ ID NO: 12576 - protein, 17 aa, Artificial Sequence
  Description of Artificial Sequence: Synthetic peptide
VIWYDGSNKYYADSVKG

SEQ ID NO: 12577 - DNA, 51 bp, Artificial Sequence
  Description of Artificial Sequence: Synthetic oligonucleotide
gttatatggtatgatggaagtaatgaatactatgcagactccgtgaagggc

SEQ ID NO: 12578 - protein, 17 aa, Artificial Sequence
  Description of Artificial Sequence: Synthetic peptide
VIWYDGSNEYYADSVKG

SEQ ID NO: 12579 - DNA, 51 bp, Artificial Sequence
  Description of Artificial Sequence: Synthetic oligonucleotide
gttactagtggtagtggtggtaccacattctacgcagactccgtgaagggc

SEQ ID NO: 12580 - protein, 17 aa, Artificial Sequence
  Description of Artificial Sequence: Synthetic peptide
VTSGSGGTTFYADSVKG

SEQ ID NO: 12581 - DNA, 51 bp, Artificial Sequence; identical to SEQ ID NO: 12491
  Description of Artificial Sequence: Synthetic oligonucleotide

SEQ ID NO: 12582 - protein, 17 aa, Artificial Sequence
  Description of Artificial Sequence: Synthetic peptide
VIWYDENNKYYADSVKG

SEQ ID NO: 12583 - DNA, 51 bp, Artificial Sequence
  Description of Artificial Sequence: Synthetic oligonucleotide
gttatatcatatggtggaagtaataaattctatgcagtctccgtgaagggc

SEQ ID NO: 12584 - protein, 17 aa, Artificial Sequence
  Description of Artificial Sequence: Synthetic peptide
VISYGGSNKFYAVSVKG

SEQ ID NO: 12585 - DNA, 51 bp, Artificial Sequence; identical to SEQ ID NO: 12153
  Description of Artificial Sequence: Synthetic oligonucleotide

SEQ ID NO: 12586 - protein, 17 aa, Artificial Sequence
  Description of Artificial Sequence: Synthetic peptide
SISGSSSYIYYADSVKG

SEQ ID NO: 12587 - DNA, 51 bp, Artificial Sequence
  Description of Artificial Sequence: Synthetic oligonucleotide
gctattagtggtagtggtggtagctcattctacgcagactccgtgaagggc

SEQ ID NO: 12588 - protein, 17 aa, Artificial Sequence
  Description of Artificial Sequence: Synthetic peptide
AISGSGGSSFYADSVKG

SEQ ID NO: 12589 - DNA, 51 bp, Artificial Sequence
  Description of Artificial Sequence: Synthetic oligonucleotide
gttatatggtatgatgaaaatactaaatactatgcagactccgtgaagggc

SEQ ID NO: 12590 - protein, 17 aa, Artificial Sequence
  Description of Artificial Sequence: Synthetic peptide
VIWYDENTKYYADSVKG

SEQ ID NO: 12591 - DNA, 51 bp, Artificial Sequence
  Description of Artificial Sequence: Synthetic oligonucleotide
gctattagtggtagaggtggtaccacattctacgcagactccgtgaagggc

SEQ ID NO: 12592 - protein, 17 aa, Artificial Sequence
  Description of Artificial Sequence: Synthetic peptide
AISGRGGTTFYADSVKG

SEQ ID NO: 12593 - DNA, 51 bp, Artificial Sequence
  Description of Artificial Sequence: Synthetic oligonucleotide
gttatatggtatgatgaaaataatgaatactatgcagactccgtgaagggc

SEQ ID NO: 12594 - protein, 17 aa, Artificial Sequence
  Description of Artificial Sequence: Synthetic peptide
VIWYDENNEYYADSVKG

SEQ ID NO: 12595 - DNA, 51 bp, Artificial Sequence; identical to SEQ ID NO: 12127
  Description of Artificial Sequence: Synthetic oligonucleotide

SEQ ID NO: 12596 - protein, 17 aa, Artificial Sequence
  Description of Artificial Sequence: Synthetic peptide
IIWYDGSNKYYADSVKG

SEQ ID NO: 12597 - DNA, 51 bp, Artificial Sequence
  Description of Artificial Sequence: Synthetic oligonucleotide
gttatatggtatgatgaaaataataaatactatgtagactccgtgaggggc

SEQ ID NO: 12598 - protein, 17 aa, Artificial Sequence
  Description of Artificial Sequence: Synthetic peptide
VIWYDENNKYYVDSVRG

SEQ ID NO: 12599 - DNA, 51 bp, Artificial Sequence; identical to SEQ ID NO: 12123
  Description of Artificial Sequence: Synthetic oligonucleotide

SEQ ID NO: 12600 - protein, 17 aa, Artificial Sequence
  Description of Artificial Sequence: Synthetic peptide
VIWYDGSNKYYADSVKG

SEQ ID NO: 12601 - DNA, 51 bp, Artificial Sequence
  Description of Artificial Sequence: Synthetic oligonucleotide
gttatatggtttgatggaactaataaatactatgcagactccgtgaagggc

SEQ ID NO: 12602 - protein, 17 aa, Artificial Sequence
  Description of Artificial Sequence: Synthetic peptide
VIWFDGTNKYYADSVKG

SEQ ID NO: 12603 - DNA, 51 bp, Artificial Sequence
  Description of Artificial Sequence: Synthetic oligonucleotide
gctattagtggtcgtggtggtagcacattctacgcagactccgagaagggc

SEQ ID NO: 12604 - protein, 17 aa, Artificial Sequence
  Description of Artificial Sequence: Synthetic peptide
AISGRGGSTFYADSEKG

SEQ ID NO: 12605 - DNA, 51 bp, Artificial Sequence; identical to SEQ ID NO: 12197
  Description of Artificial Sequence: Synthetic oligonucleotide

SEQ ID NO: 12606 - protein, 17 aa, Artificial Sequence
  Description of Artificial Sequence: Synthetic peptide
WINPNSGGTNYAQKFQG

SEQ ID NO: 12607 - DNA, 51 bp, Artificial Sequence
  Description of Artificial Sequence: Synthetic oligonucleotide
tggatcagcgcttacaatggtaacacaacctatgcacagaagctccggggc

SEQ ID NO: 12608 - protein, 17 aa, Artificial Sequence
  Description of Artificial Sequence: Synthetic peptide
WISAYNGNTTYAQKLRG

SEQ ID NO: 12609 - DNA, 51 bp, Artificial Sequence; identical to SEQ ID NO: 12123
  Description of Artificial Sequence: Synthetic oligonucleotide

SEQ ID NO: 12610 - protein, 17 aa, Artificial Sequence
  Description of Artificial Sequence: Synthetic peptide
VIWYDGSNKYYADSVKG

SEQ ID NO: 12611 - DNA, 51 bp, Artificial Sequence
  Description of Artificial Sequence: Synthetic oligonucleotide
gttatatggtatgatgaaaataataaatcctatgcagactccgtgaagggc

SEQ ID NO: 12612 - protein, 17 aa, Artificial Sequence
  Description of Artificial Sequence: Synthetic peptide
VIWYDENNKSYADSVKG

SEQ ID NO: 12613 - DNA, 51 bp, Artificial Sequence; identical to SEQ ID NO: 12607
  Description of Artificial Sequence: Synthetic oligonucleotide

SEQ ID NO: 12614 - protein, 17 aa, Artificial Sequence
  Description of Artificial Sequence: Synthetic peptide
WISAYNGNTTYAQKLRG

SEQ ID NO: 12615 - DNA, 51 bp, Artificial Sequence; identical to SEQ ID NO: 12483
  Description of Artificial Sequence: Synthetic oligonucleotide

SEQ ID NO: 12616 - protein, 17 aa, Artificial Sequence
  Description of Artificial Sequence: Synthetic peptide
VIWYDETNKYYADSVKG

SEQ ID NO: 12617 - DNA, 51 bp, Artificial Sequence
  Description of Artificial Sequence: Synthetic oligonucleotide
gttatatggtatgatgtaagtaataaatactatgcagactccgtgaagggc

SEQ ID NO: 12618 - protein, 17 aa, Artificial Sequence
  Description of Artificial Sequence: Synthetic peptide
VIWYDVSNKYYADSVKG

SEQ ID NO: 12619 - DNA, 51 bp, Artificial Sequence
  Description of Artificial Sequence: Synthetic oligonucleotide
gctattagtggtcgtggtggtaacacattctacgcagactccgtgaagggc

SEQ ID NO: 12620 - protein, 17 aa, Artificial Sequence
  Description of Artificial Sequence: Synthetic peptide
AISGRGGNTFYADSVKG

SEQ ID NO: 12621 - DNA, 51 bp, Artificial Sequence
  Description of Artificial Sequence: Synthetic oligonucleotide
tctattagtggtcgtggtggtagcacattccacgcagactccgtgaagggc

SEQ ID NO: 12622 - protein, 17 aa, Artificial Sequence
  Description of Artificial Sequence: Synthetic peptide
SISGRGGSTFHADSVKG

SEQ ID NO: 12623 - DNA, 51 bp, Artificial Sequence
  Description of Artificial Sequence: Synthetic oligonucleotide
attatatcatatggtggaagtaataacttctatgcagactccgtgaagggc

SEQ ID NO: 12624 - protein, 17 aa, Artificial Sequence
  Description of Artificial Sequence: Synthetic peptide
IISYGGSNNFYADSVKG

SEQ ID NO: 12625 - DNA, 51 bp, Artificial Sequence; identical to SEQ ID NO: 12103
  Description of Artificial Sequence: Synthetic oligonucleotide

SEQ ID NO: 12626 - protein, 17 aa, Artificial Sequence
  Description of Artificial Sequence: Synthetic peptide
WMNPNSGNTGYAQKFQG

SEQ ID NO: 12627 - DNA, 51 bp, Artificial Sequence; identical to SEQ ID NO: 12567
  Description of Artificial Sequence: Synthetic oligonucleotide

SEQ ID NO: 12628 - protein, 17 aa, Artificial Sequence
  Description of Artificial Sequence: Synthetic peptide
VIWHDGSNKYYVDSVKG

SEQ ID NO: 12629 - DNA, 51 bp, Artificial Sequence; identical to SEQ ID NO: 12531
  Description of Artificial Sequence: Synthetic oligonucleotide

SEQ ID NO: 12630 - protein, 17 aa, Artificial Sequence
  Description of Artificial Sequence: Synthetic peptide
AISGRGGSTFHADSVKG

SEQ ID NO: 12631 - DNA, 51 bp, Artificial Sequence; identical to SEQ ID NO: 12531
  Description of Artificial Sequence: Synthetic oligonucleotide

SEQ ID NO: 12632 - protein, 17 aa, Artificial Sequence
  Description of Artificial Sequence: Synthetic peptide
AISGRGGSTFHADSVKG

SEQ ID NO: 12633 - DNA, 51 bp, Artificial Sequence
  Description of Artificial Sequence: Synthetic oligonucleotide
gttatatggtatgatagaaataataaatactatgcagactccgtgaagggc

SEQ ID NO: 12634 - protein, 17 aa, Artificial Sequence
  Description of Artificial Sequence: Synthetic peptide
VIWYDRNNKYYADSVKG

SEQ ID NO: 12635 - DNA, 51 bp, Artificial Sequence
  Description of Artificial Sequence: Synthetic oligonucleotide
gctattagtcgtcgtggtggtagcacattctacgcagactccgtgaagggc

SEQ ID NO: 12636 - protein, 17 aa, Artificial Sequence
  Description of Artificial Sequence: Synthetic peptide
AISRRGGSTFYADSVKG

SEQ ID NO: 12637 - DNA, 51 bp, Artificial Sequence; identical to SEQ ID NO: 12153
  Description of Artificial Sequence: Synthetic oligonucleotide

SEQ ID NO: 12638 - protein, 17 aa, Artificial Sequence
  Description of Artificial Sequence: Synthetic peptide
SISGSSSYIYYADSVKG

SEQ ID NO: 12639 - DNA, 51 bp, Artificial Sequence; identical to SEQ ID NO: 12197
  Description of Artificial Sequence: Synthetic oligonucleotide

SEQ ID NO: 12640 - protein, 17 aa, Artificial Sequence
  Description of Artificial Sequence: Synthetic peptide
WINPNSGGTNYAQKFQG

SEQ ID NO: 12641 - DNA, 51 bp, Artificial Sequence
  Description of Artificial Sequence: Synthetic oligonucleotide
tccattagtggtagtagtaattacatatactacgcagactcagtgaagggc

SEQ ID NO: 12642 - protein, 17 aa, Artificial Sequence
  Description of Artificial Sequence: Synthetic peptide
SISGSSNYIYYADSVKG

SEQ ID NO: 12643 - DNA, 51 bp, Artificial Sequence
  Description of Artificial Sequence: Synthetic oligonucleotide
tggatcagccctaaaaatggtggcacaaactatgcacagaagtttcagggc

SEQ ID NO: 12644 - protein, 17 aa, Artificial Sequence
  Description of Artificial Sequence: Synthetic peptide
WISPKNGGTNYAQKFQG

SEQ ID NO: 12645 - DNA, 51 bp, Artificial Sequence
  Description of Artificial Sequence: Synthetic oligonucleotide
tggatcaaccctaataggggtggcacaaactatgcacagaagtttcaggac

SEQ ID NO: 12646 - protein, 17 aa, Artificial Sequence
  Description of Artificial Sequence: Synthetic peptide
WINPNRGGTNYAQKFQD

SEQ ID NO: 12647 - DNA, 51 bp, Artificial Sequence
  Description of Artificial Sequence: Synthetic oligonucleotide
tggatgcaccctaacagtggtaacacaggctttgcacagaagttccggggc

SEQ ID NO: 12648 - protein, 17 aa, Artificial Sequence
  Description of Artificial Sequence: Synthetic peptide
WMHPNSGNTGFAQKFRG

SEQ ID NO: 12649 - DNA, 51 bp, Artificial Sequence
  Description of Artificial Sequence: Synthetic oligonucleotide
gctattagtggtagtggtgttagcacatactacgcagactccgtgaagggc

SEQ ID NO: 12650 - protein, 17 aa, Artificial Sequence
  Description of Artificial Sequence: Synthetic peptide
AISGSGVSTYYADSVKG

SEQ ID NO: 12651 - DNA, 51 bp, Artificial Sequence; identical to SEQ ID NO: 12123
  Description of Artificial Sequence: Synthetic oligonucleotide

SEQ ID NO: 12652 - protein, 17 aa, Artificial Sequence
  Description of Artificial Sequence: Synthetic peptide
VIWYDGSNKYYADSVKG

SEQ ID NO: 12653 - DNA, 48 bp, Artificial Sequence
  Description of Artificial Sequence: Synthetic oligonucleotide
agtatctattatagtgggagcaccgcctacaatccgtccctcaagagt

SEQ ID NO: 12654 - protein, 16 aa, Artificial Sequence
  Description of Artificial Sequence: Synthetic peptide
SIYYSGSTAYNPSLKS

SEQ ID NO: 12655 - DNA, 51 bp, Artificial Sequence; identical to SEQ ID NO: 12531
  Description of Artificial Sequence: Synthetic oligonucleotide

SEQ ID NO: 12656 - protein, 17 aa, Artificial Sequence
  Description of Artificial Sequence: Synthetic peptide
AISGRGGSTFHADSVKG

SEQ ID NO: 12657 - DNA, 51 bp, Artificial Sequence
  Description of Artificial Sequence: Synthetic oligonucleotide
tggatcaaccctaacaatggtggcacacactatgcacaggagtttcagggc

SEQ ID NO: 12658 - protein, 17 aa, Artificial Sequence
  Description of Artificial Sequence: Synthetic peptide
WINPNNGGTHYAQEFQG

SEQ ID NO: 12659 - DNA, 51 bp, Artificial Sequence
  Description of Artificial Sequence: Synthetic oligonucleotide
gttatatggcatgatggaagtaataaatactatggagactccgtgaagggc

SEQ ID NO: 12660 - protein, 17 aa, Artificial Sequence
  Description of Artificial Sequence: Synthetic peptide
VIWHDGSNKYYGDSVKG

SEQ ID NO: 12661 - DNA, 51 bp, Artificial Sequence; identical to SEQ ID NO: 12621
  Description of Artificial Sequence: Synthetic oligonucleotide

SEQ ID NO: 12662 - protein, 17 aa, Artificial Sequence
  Description of Artificial Sequence: Synthetic peptide
SISGRGGSTFHADSVKG

SEQ ID NO: 12663 - DNA, 51 bp, Artificial Sequence; identical to SEQ ID NO: 12531
  Description of Artificial Sequence: Synthetic oligonucleotide

SEQ ID NO: 12664 - protein, 17 aa, Artificial Sequence
  Description of Artificial Sequence: Synthetic peptide
AISGRGGSTFHADSVKG

SEQ ID NO: 12665 - DNA, 51 bp, Artificial Sequence; identical to SEQ ID NO: 12635
  Description of Artificial Sequence: Synthetic oligonucleotide

SEQ ID NO: 12666 - protein, 17 aa, Artificial Sequence
  Description of Artificial Sequence: Synthetic peptide
AISRRGGSTFYADSVKG

SEQ ID NO: 12667 - DNA, 51 bp, Artificial Sequence; identical to SEQ ID NO: 12197
  Description of Artificial Sequence: Synthetic oligonucleotide

SEQ ID NO: 12668 - protein, 17 aa, Artificial Sequence
  Description of Artificial Sequence: Synthetic peptide
WINPNSGGTNYAQKFQG

SEQ ID NO: 12669 - DNA, 51 bp, Artificial Sequence; identical to SEQ ID NO: 12531
  Description of Artificial Sequence: Synthetic oligonucleotide

SEQ ID NO: 12670 - protein, 17 aa, Artificial Sequence
  Description of Artificial Sequence: Synthetic peptide
AISGRGGSTFHADSVKG

SEQ ID NO: 12671 - DNA, 51 bp, Artificial Sequence
  Description of Artificial Sequence: Synthetic oligonucleotide
tggatcagccctaacaatggtggcacaaactatgcacagaagtttcagggc

SEQ ID NO: 12672 - protein, 17 aa, Artificial Sequence
  Description of Artificial Sequence: Synthetic peptide
WISPNNGGTNYAQKFQG

SEQ ID NO: 12673 - DNA, 51 bp, Artificial Sequence; identical to SEQ ID NO: 12549
  Description of Artificial Sequence: Synthetic oligonucleotide

SEQ ID NO: 12674 - protein, 17 aa, Artificial Sequence
  Description of Artificial Sequence: Synthetic peptide
VISGSGGSSFYADSVKG

SEQ ID NO: 12675 - DNA, 51 bp, Artificial Sequence
  Description of Artificial Sequence: Synthetic oligonucleotide
tggatcaaccctaacaatggtggcacacactatgcacagaagtttcagggc

SEQ ID NO: 12676 - protein, 17 aa, Artificial Sequence
  Description of Artificial Sequence: Synthetic peptide
WINPNNGGTHYAQKFQG

SEQ ID NO: 12677 - DNA, 51 bp, Artificial Sequence; identical to SEQ ID NO: 12511
  Description of Artificial Sequence: Synthetic oligonucleotide

SEQ ID NO: 12678 - protein, 17 aa, Artificial Sequence
  Description of Artificial Sequence: Synthetic peptide
AISGRGGSTFYADSVKG

SEQ ID NO: 12679 - DNA, 51 bp, Artificial Sequence
  Description of Artificial Sequence: Synthetic oligonucleotide
tccattagtggtactggtagtttcatatactacgcagactcagtgaagggc

SEQ ID NO: 12680 - protein, 17 aa, Artificial Sequence
  Description of Artificial Sequence: Synthetic peptide
SISGTGSFIYYADSVKG

SEQ ID NO: 12681 - DNA, 51 bp, Artificial Sequence; identical to SEQ ID NO: 12263
  Description of Artificial Sequence: Synthetic oligonucleotide

SEQ ID NO: 12682 - protein, 17 aa, Artificial Sequence
  Description of Artificial Sequence: Synthetic peptide
VIWHDGSNKYYADSVKG

SEQ ID NO: 12683 - DNA, 51 bp, Artificial Sequence; identical to SEQ ID NO: 12635
  Description of Artificial Sequence: Synthetic oligonucleotide

SEQ ID NO: 12684 - protein, 17 aa, Artificial Sequence
  Description of Artificial Sequence: Synthetic peptide
AISRRGGSTFYADSVKG

SEQ ID NO: 12685 - DNA, 51 bp, Artificial Sequence; identical to SEQ ID NO: 12531
  Description of Artificial Sequence: Synthetic oligonucleotide

SEQ ID NO: 12686 - protein, 17 aa, Artificial Sequence
  Description of Artificial Sequence: Synthetic peptide
AISGRGGSTFHADSVKG

SEQ ID NO: 12687 - DNA, 51 bp, Artificial Sequence
  Description of Artificial Sequence: Synthetic oligonucleotide
gctattagtggtcgtggtggtagcacattccacgcagactccatgaagggc

SEQ ID NO: 12688 - protein, 17 aa, Artificial Sequence
  Description of Artificial Sequence: Synthetic peptide
AISGRGGSTFHADSMKG

SEQ ID NO: 12689 - DNA, 51 bp, Artificial Sequence; identical to SEQ ID NO: 12519
  Description of Artificial Sequence: Synthetic oligonucleotide

SEQ ID NO: 12690 - protein, 17 aa, Artificial Sequence
  Description of Artificial Sequence: Synthetic peptide
SISGSSSYIYYADSVKG

SEQ ID NO: 12691 - DNA, 51 bp, Artificial Sequence; identical to SEQ ID NO: 12657
  Description of Artificial Sequence: Synthetic oligonucleotide

SEQ ID NO: 12692 - protein, 17 aa, Artificial Sequence
  Description of Artificial Sequence: Synthetic peptide
WINPNNGGTHYAQEFQG

SEQ ID NO: 12693 - DNA, 51 bp, Artificial Sequence
  Description of Artificial Sequence: Synthetic oligonucleotide
cttatatggtatgatggaagtaataaatactatgcagactccgtgaagggc

SEQ ID NO: 12694 - protein, 17 aa, Artificial Sequence
  Description of Artificial Sequence: Synthetic peptide
LIWYDGSNKYYADSVKG

SEQ ID NO: 12695 - DNA, 51 bp, Artificial Sequence; identical to SEQ ID NO: 12123
  Description of Artificial Sequence: Synthetic oligonucleotide

SEQ ID NO: 12696 - protein, 17 aa, Artificial Sequence
  Description of Artificial Sequence: Synthetic peptide
VIWYDGSNKYYADSVKG

SEQ ID NO: 12697 - DNA, 51 bp, Artificial Sequence
  Description of Artificial Sequence: Synthetic oligonucleotide
gttatatcatatggtggaagtaataaatactatgcagactccgtgaagggc

SEQ ID NO: 12698 - protein, 17 aa, Artificial Sequence
  Description of Artificial Sequence: Synthetic peptide
VISYGGSNKYYADSVKG

SEQ ID NO: 12699 - DNA, 51 bp, Artificial Sequence
  Description of Artificial Sequence: Synthetic oligonucleotide
tggatcaaccctaataggggtggcacaaactatgcacagaagtttcagggc

SEQ ID NO: 12700 - protein, 17 aa, Artificial Sequence
  Description of Artificial Sequence: Synthetic peptide
WINPNRGGTNYAQKFQG

SEQ ID NO: 12701 - DNA, 51 bp, Artificial Sequence
  Description of Artificial Sequence: Synthetic oligonucleotide
tccattagtggtagtagtacttacatatactacgcagactcagtgaagggc

SEQ ID NO: 12702 - protein, 17 aa, Artificial Sequence
  Description of Artificial Sequence: Synthetic peptide
SISGSSTYIYYADSVKG

SEQ ID NO: 12703 - DNA, 51 bp, Artificial Sequence
  Description of Artificial Sequence: Synthetic oligonucleotide
tggctgcaccctaacagtggtaccacaggctttgcacagaagttccggggc

SEQ ID NO: 12704 - protein, 17 aa, Artificial Sequence
  Description of Artificial Sequence: Synthetic peptide
WLHPNSGTTGFAQKFRG

SEQ ID NO: 12705 - DNA, 51 bp, Artificial Sequence; identical to SEQ ID NO: 12531
  Description of Artificial Sequence: Synthetic oligonucleotide

SEQ ID NO: 12706 - protein, 17 aa, Artificial Sequence
  Description of Artificial Sequence: Synthetic peptide
AISGRGGSTFHADSVKG

SEQ ID NO: 12707 - DNA, 51 bp, Artificial Sequence; identical to SEQ ID NO: 12103
  Description of Artificial Sequence: Synthetic oligonucleotide

SEQ ID NO: 12708 - protein, 17 aa, Artificial Sequence
  Description of Artificial Sequence: Synthetic peptide
WMNPNSGNTGYAQKFQG

SEQ ID NO: 12709 - DNA, 51 bp, Artificial Sequence
  Description of Artificial Sequence: Synthetic oligonucleotide
gctattagtcgtcgtggtggtaacacattctacgcagactccgtgaagggc

SEQ ID NO: 12710 - protein, 17 aa, Artificial Sequence
  Description of Artificial Sequence: Synthetic peptide
AISRRGGNTFYADSVKG

SEQ ID NO: 12711 - DNA, 51 bp, Artificial Sequence; identical to SEQ ID NO: 12575
  Description of Artificial Sequence: Synthetic oligonucleotide

SEQ ID NO: 12712 - protein, 17 aa, Artificial Sequence
  Description of Artificial Sequence: Synthetic peptide
VIWYDGSNKYYADSVKG

SEQ ID NO: 12713 - DNA, 51 bp, Artificial Sequence
  Description of Artificial Sequence: Synthetic oligonucleotide
attatatggtatgatggaagtaaaaaatacaatgcagactccgtgaagggc

SEQ ID NO: 12714 - protein, 17 aa, Artificial Sequence
  Description of Artificial Sequence: Synthetic peptide
IIWYDGSKKYNADSVKG

SEQ ID NO: 12715 - DNA, 51 bp, Artificial Sequence
  Description of Artificial Sequence: Synthetic oligonucleotide
tggatcaaccctaacagtgatggcactaactatgcacagaagtttcagggc

SEQ ID NO: 12716 - protein, 17 aa, Artificial Sequence
  Description of Artificial Sequence: Synthetic peptide
WINPNSDGTNYAQKFQG

SEQ ID NO: 12717 - DNA, 51 bp, Artificial Sequence; identical to SEQ ID NO: 12339
  Description of Artificial Sequence: Synthetic oligonucleotide

SEQ ID NO: 12718 - protein, 17 aa, Artificial Sequence
  Description of Artificial Sequence: Synthetic peptide
VISYDGSNKYYADSVKG

SEQ ID NO: 12719 - DNA, 51 bp, Artificial Sequence; identical to SEQ ID NO: 12339
  Description of Artificial Sequence: Synthetic oligonucleotide

SEQ ID NO: 12720 - protein, 17 aa, Artificial Sequence
  Description of Artificial Sequence: Synthetic peptide
VISYDGSNKYYADSVKG

SEQ ID NO: 12721 - DNA, 51 bp, Artificial Sequence; identical to SEQ ID NO: 12123
  Description of Artificial Sequence: Synthetic oligonucleotide

SEQ ID NO: 12722 - protein, 17 aa, Artificial Sequence
  Description of Artificial Sequence: Synthetic peptide
VIWYDGSNKYYADSVKG

SEQ ID NO: 12723 - DNA, 51 bp, Artificial Sequence; identical to SEQ ID NO: 12197
  Description of Artificial Sequence: Synthetic oligonucleotide

SEQ ID NO: 12724 - protein, 17 aa, Artificial Sequence
  Description of Artificial Sequence: Synthetic peptide
WINPNSGGTNYAQKFQG

SEQ ID NO: 12725 - DNA, 51 bp, Artificial Sequence
  Description of Artificial Sequence: Synthetic oligonucleotide
actcttagtggtcgtggtggtagcacatactacgcagactccgtgaagggc

SEQ ID NO: 12726 - protein, 17 aa, Artificial Sequence
  Description of Artificial Sequence: Synthetic peptide
TLSGRGGSTYYADSVKG

SEQ ID NO: 12727 - DNA, 51 bp, Artificial Sequence
  Description of Artificial Sequence: Synthetic oligonucleotide
tggatcaaccctaacagtggtggcacaaactctgcacagaagtttcagggc

SEQ ID NO: 12728 - protein, 17 aa, Artificial Sequence
  Description of Artificial Sequence: Synthetic peptide
WINPNSGGTNSAQKFQG

SEQ ID NO: 12729 - DNA, 48 bp, Artificial Sequence
  Description of Artificial Sequence: Synthetic oligonucleotide
ctcatttattggcatgatgataagcgctacagtccatctctgaggagc

SEQ ID NO: 12730 - protein, 16 aa, Artificial Sequence
  Description of Artificial Sequence: Synthetic peptide
LIYWHDDKRYSPSLRS

SEQ ID NO: 12731 - DNA, 51 bp, Artificial Sequence
  Description of Artificial Sequence: Synthetic oligonucleotide
tggatcaaccctaacagtggtggcacaaagtatgcacagaagtttcagggc

SEQ ID NO: 12732 - protein, 17 aa, Artificial Sequence
  Description of Artificial Sequence: Synthetic peptide
WINPNSGGTKYAQKFQG

SEQ ID NO: 12733 - DNA, 48 bp, Artificial Sequence; identical to SEQ ID NO: 12203
  Description of Artificial Sequence: Synthetic oligonucleotide

SEQ ID NO: 12734 - protein, 16 aa, Artificial Sequence
  Description of Artificial Sequence: Synthetic peptide
LIYWNDDKRYSPSLKS

SEQ ID NO: 12735 - DNA, 51 bp, Artificial Sequence
  Description of Artificial Sequence: Synthetic oligonucleotide
gttatatggaatgatggaagtaataaatactatgcagactccgtgaagggc

SEQ ID NO: 12736 - protein, 17 aa, Artificial Sequence
  Description of Artificial Sequence: Synthetic peptide
VIWNDGSNKYYADSVKG

SEQ ID NO: 12737 - DNA, 57 bp, Artificial Sequence; identical to SEQ ID NO: 12475
  Description of Artificial Sequence: Synthetic oligonucleotide

SEQ ID NO: 12738 - protein, 19 aa, Artificial Sequence
  Description of Artificial Sequence: Synthetic peptide
RIKSKTDGGTTDYAAPVKG

SEQ ID NO: 12739 - DNA, 51 bp, Artificial Sequence
  Description of Artificial Sequence: Synthetic oligonucleotide
ggtattagtggtagtggtggtagcacatactacgcagactccgtgaagggc

SEQ ID NO: 12740 - protein, 17 aa, Artificial Sequence
  Description of Artificial Sequence: Synthetic peptide
GISGSGGSTYYADSVKG

SEQ ID NO: 12741 - DNA, 51 bp, Artificial Sequence
  Description of Artificial Sequence: Synthetic oligonucleotide
cttatatggtatgatggaaataatacatactatgcagactccgtgaagggc

SEQ ID NO: 12742 - protein, 17 aa, Artificial Sequence
  Description of Artificial Sequence: Synthetic peptide
LIWYDGNNTYYADSVKG

SEQ ID NO: 12743 - DNA, 51 bp, Artificial Sequence
  Description of Artificial Sequence: Synthetic oligonucleotide
tggatcaaccctaaaagtggtggcacaaattatgcacagaagtttcagggc

SEQ ID NO: 12744 - protein, 17 aa, Artificial Sequence
  Description of Artificial Sequence: Synthetic peptide
WINPKSGGTNYAQKFQG

SEQ ID NO: 12745 - DNA, 51 bp, Artificial Sequence
  Description of Artificial Sequence: Synthetic oligonucleotide
gctattagtggtagtggtagtagcacatactacgcagactccgtgaagggc

SEQ ID NO: 12746 - protein, 17 aa, Artificial Sequence
  Description of Artificial Sequence: Synthetic peptide
AISGSGSSTYYADSVKG

SEQ ID NO: 12747 - DNA, 51 bp, Artificial Sequence; identical to SEQ ID NO: 12693
  Description of Artificial Sequence: Synthetic oligonucleotide

SEQ ID NO: 12748 - protein, 17 aa, Artificial Sequence
  Description of Artificial Sequence: Synthetic peptide
LIWYDGSNKYYADSVKG

SEQ ID NO: 12749 - DNA, 51 bp, Artificial Sequence
  Description of Artificial Sequence: Synthetic oligonucleotide
tggatcaaccctaacagtggtggcgcaaactatgcacagaagtttcagggc

SEQ ID NO: 12750 - protein, 17 aa, Artificial Sequence
  Description of Artificial Sequence: Synthetic peptide
WINPNSGGANYAQKFQG

SEQ ID NO: 12751 - DNA, 51 bp, Artificial Sequence; identical to SEQ ID NO: 12197
  Description of Artificial Sequence: Synthetic oligonucleotide

SEQ ID NO: 12752 - protein, 17 aa, Artificial Sequence
  Description of Artificial Sequence: Synthetic peptide
WINPNSGGTNYAQKFQG

SEQ ID NO: 12753 - DNA, 51 bp, Artificial Sequence; identical to SEQ ID NO: 12197
  Description of Artificial Sequence: Synthetic oligonucleotide

SEQ ID NO: 12754 - protein, 17 aa, Artificial Sequence
  Description of Artificial Sequence: Synthetic peptide
WINPNSGGTNYAQKFQG

SEQ ID NO: 12755 - DNA, 48 bp, Artificial Sequence
  Description of Artificial Sequence: Synthetic oligonucleotide
ctcatttattggcatgatgataagcgctacagtccctctctgaagagc

SEQ ID NO: 12756 - protein, 16 aa, Artificial Sequence
  Description of Artificial Sequence: Synthetic peptide
LIYWHDDKRYSPSLKS

SEQ ID NO: 12757 - DNA, 51 bp, Artificial Sequence; identical to SEQ ID NO: 12675
  Description of Artificial Sequence: Synthetic oligonucleotide

SEQ ID NO: 12758 - protein, 17 aa, Artificial Sequence
  Description of Artificial Sequence: Synthetic peptide
WINPNNGGTHYAQKFQG

SEQ ID NO: 12759 - DNA, 51 bp, Artificial Sequence; identical to SEQ ID NO: 12197
  Description of Artificial Sequence: Synthetic oligonucleotide

SEQ ID NO: 12760 - protein, 17 aa, Artificial Sequence
  Description of Artificial Sequence: Synthetic peptide
WINPNSGGTNYAQKFQG

SEQ ID NO: 12761 - DNA, 48 bp, Artificial Sequence
  Description of Artificial Sequence: Synthetic oligonucleotide
ctcatttattgggatgatgataagcgctacagcccatctctgaagagc

SEQ ID NO: 12762 - protein, 16 aa, Artificial Sequence
  Description of Artificial Sequence: Synthetic peptide
LIYWDDDKRYSPSLKS

SEQ ID NO: 12763 - DNA, 48 bp, Artificial Sequence
  Description of Artificial Sequence: Synthetic oligonucleotide
ctcatttattggaatgatgatgagcgctacagcccatctctgaagagc

SEQ ID NO: 12764 - protein, 16 aa, Artificial Sequence
  Description of Artificial Sequence: Synthetic peptide
LIYWNDDERYSPSLKS

SEQ ID NO: 12765 - DNA, 51 bp, Artificial Sequence; identical to SEQ ID NO: 12197
  Description of Artificial Sequence: Synthetic oligonucleotide

SEQ ID NO: 12766 - protein, 17 aa, Artificial Sequence
  Description of Artificial Sequence: Synthetic peptide
WINPNSGGTNYAQKFQG

SEQ ID NO: 12767 - DNA, 51 bp, Artificial Sequence
  Description of Artificial Sequence: Synthetic oligonucleotide
tggatcaaccctaacagtggtggcacagactatgcacagaagtttcagggc

SEQ ID NO: 12768 - protein, 17 aa, Artificial Sequence
  Description of Artificial Sequence: Synthetic peptide
WINPNSGGTDYAQKFQG

SEQ ID NO: 12769 - DNA, 51 bp, Artificial Sequence
  Description of Artificial Sequence: Synthetic oligonucleotide
gctattagtggtggtggtggtagcacatactacgcagactccgtgaagggc

SEQ ID NO: 12770 - protein, 17 aa, Artificial Sequence
  Description of Artificial Sequence: Synthetic peptide
AISGGGGSTYYADSVKG

SEQ ID NO: 12771 - DNA, 51 bp, Artificial Sequence; identical to SEQ ID NO: 12197
  Description of Artificial Sequence: Synthetic oligonucleotide

SEQ ID NO: 12772 - protein, 17 aa, Artificial Sequence
  Description of Artificial Sequence: Synthetic peptide
WINPNSGGTNYAQKFQG

SEQ ID NO: 12773 - DNA, 51 bp, Artificial Sequence; identical to SEQ ID NO: 12421
  Description of Artificial Sequence: Synthetic oligonucleotide

SEQ ID NO: 12774 - protein, 17 aa, Artificial Sequence
  Description of Artificial Sequence: Synthetic peptide
AISGSGGSTYYADSVKG

SEQ ID NO: 12775 - DNA, 51 bp, Artificial Sequence
  Description of Artificial Sequence: Synthetic oligonucleotide
tggatgaaccctaacagtggtaacacaggctatgcacagaggttccagggc

SEQ ID NO: 12776 - protein, 17 aa, Artificial Sequence
  Description of Artificial Sequence: Synthetic peptide
WMNPNSGNTGYAQRFQG

SEQ ID NO: 12777 - DNA, 51 bp, Artificial Sequence; identical to SEQ ID NO: 12197
  Description of Artificial Sequence: Synthetic oligonucleotide

SEQ ID NO: 12778 - protein, 17 aa, Artificial Sequence
  Description of Artificial Sequence: Synthetic peptide
WINPNSGGTNYAQKFQG

SEQ ID NO: 12779 - DNA, 57 bp, Artificial Sequence
  Description of Artificial Sequence: Synthetic oligonucleotide
cggattaaaaacaaaattgatggtgggacaacagactacgttgcacccgtgaaaggc

SEQ ID NO: 12780 - protein, 19 aa, Artificial Sequence
  Description of Artificial Sequence: Synthetic peptide
RIKNKIDGGTTDYVAPVKG

SEQ ID NO: 12781 - DNA, 48 bp, Artificial Sequence
  Description of Artificial Sequence: Synthetic oligonucleotide
aatatctattatagtgggaccacctactacaacccgtccctcaagagt

SEQ ID NO: 12782 - protein, 16 aa, Artificial Sequence
  Description of Artificial Sequence: Synthetic peptide
NIYYSGTTYYNPSLKS

SEQ ID NO: 12783 - DNA, 48 bp, Artificial Sequence
  Description of Artificial Sequence: Synthetic oligonucleotide
aatatctattatagtgggatcccctactacaacccgtccctcaagagt

SEQ ID NO: 12784 - protein, 16 aa, Artificial Sequence
  Description of Artificial Sequence: Synthetic peptide
NIYYSGIPYYNPSLKS

SEQ ID NO: 12785 - DNA, 51 bp, Artificial Sequence
  Description of Artificial Sequence: Synthetic oligonucleotide
tccattagtggtagtggtagttacatatactacgcagactcagtgaagggc

SEQ ID NO: 12786 - protein, 17 aa, Artificial Sequence
  Description of Artificial Sequence: Synthetic peptide
SISGSGSYIYYADSVKG

SEQ ID NO: 12787 - DNA, 51 bp, Artificial Sequence
  Description of Artificial Sequence: Synthetic oligonucleotide
gctattagtggtcgtggtggtaacacattctacacagactccgtgaagggc

SEQ ID NO: 12788 - protein, 17 aa, Artificial Sequence
  Description of Artificial Sequence: Synthetic peptide
AISGRGGNTFYTDSVKG

SEQ ID NO: 12789 - DNA, 51 bp, Artificial Sequence; identical to SEQ ID NO: 12227
  Description of Artificial Sequence: Synthetic oligonucleotide

SEQ ID NO: 12790 - protein, 17 aa, Artificial Sequence
  Description of Artificial Sequence: Synthetic peptide
VIWFDGSNKYYADSVKG

SEQ ID NO: 12791 - DNA, 48 bp, Artificial Sequence
  Description of Artificial Sequence: Synthetic oligonucleotide
aatatctattatagtggggccacctactacaacccgtccctcaagagt

SEQ ID NO: 12792 - protein, 16 aa, Artificial Sequence
  Description of Artificial Sequence: Synthetic peptide
NIYYSGATYYNPSLKS

SEQ ID NO: 12793 - DNA, 48 bp, Artificial Sequence
  Description of Artificial Sequence: Synthetic oligonucleotide
aatatctattatagtgggagcgcctactacattccgtccctcaagagt

SEQ ID NO: 12794 - protein, 16 aa, Artificial Sequence
  Description of Artificial Sequence: Synthetic peptide
NIYYSGSAYYIPSLKS

SEQ ID NO: 12795 - DNA, 51 bp, Artificial Sequence
  Description of Artificial Sequence: Synthetic oligonucleotide
gttatttggtatgatagaagtaataactactatgcagactccgtgaagggc

SEQ ID NO: 12796 - protein, 17 aa, Artificial Sequence
  Description of Artificial Sequence: Synthetic peptide
VIWYDRSNNYYADSVKG

SEQ ID NO: 12797 - DNA, 51 bp, Artificial Sequence; identical to SEQ ID NO: 12231
  Description of Artificial Sequence: Synthetic oligonucleotide

SEQ ID NO: 12798 - protein, 17 aa, Artificial Sequence
  Description of Artificial Sequence: Synthetic peptide
VIWYEENNQYYADSVKG

SEQ ID NO: 12799 - DNA, 51 bp, Artificial Sequence
  Description of Artificial Sequence: Synthetic oligonucleotide
gttatatggtatgaggaaagtaataaatactatacagactccgtgaagggc

SEQ ID NO: 12800 - protein, 17 aa, Artificial Sequence
  Description of Artificial Sequence: Synthetic peptide
VIWYEESNKYYTDSVKG

SEQ ID NO: 12801 - DNA, 51 bp, Artificial Sequence; identical to SEQ ID NO: 12293
  Description of Artificial Sequence: Synthetic oligonucleotide

SEQ ID NO: 12802 - protein, 17 aa, Artificial Sequence
  Description of Artificial Sequence: Synthetic peptide
IISGRGGNTFYADSVKG

SEQ ID NO: 12803 - DNA, 51 bp, Artificial Sequence; identical to SEQ ID NO: 12231
  Description of Artificial Sequence: Synthetic oligonucleotide

SEQ ID NO: 12804 - protein, 17 aa, Artificial Sequence
  Description of Artificial Sequence: Synthetic peptide
VIWYEENNQYYADSVKG

SEQ ID NO: 12805 - DNA, 51 bp, Artificial Sequence
  Description of Artificial Sequence: Synthetic oligonucleotide
gttatttggtatgaagacaataatcaatactatgcagactccgtgaagggc

SEQ ID NO: 12806 - protein, 17 aa, Artificial Sequence
  Description of Artificial Sequence: Synthetic peptide
VIWYEDNNQYYADSVKG

SEQ ID NO: 12807 - DNA, 51 bp, Artificial Sequence; identical to SEQ ID NO: 12231
  Description of Artificial Sequence: Synthetic oligonucleotide

SEQ ID NO: 12808 - protein, 17 aa, Artificial Sequence
  Description of Artificial Sequence: Synthetic peptide
VIWYEENNQYYADSVKG

SEQ ID NO: 12809 - DNA, 48 bp, Artificial Sequence; identical to SEQ ID NO: 12781
  Description of Artificial Sequence: Synthetic oligonucleotide

SEQ ID NO: 12810 - protein, 16 aa, Artificial Sequence
  Description of Artificial Sequence: Synthetic peptide
NIYYSGTTYYNPSLKS

SEQ ID NO: 12811 - DNA, 51 bp, Artificial Sequence; identical to SEQ ID NO: 12785
  Description of Artificial Sequence: Synthetic oligonucleotide

SEQ ID NO: 12812 - protein, 17 aa, Artificial Sequence
  Description of Artificial Sequence: Synthetic peptide
SISGSGSYIYYADSVKG

SEQ ID NO: 12813 - DNA, 51 bp, Artificial Sequence
  Description of Artificial Sequence: Synthetic oligonucleotide
gtcatttggtttgatggaagtaataaatactatgcagactccgtgaagggc

SEQ ID NO: 12814 - protein, 17 aa, Artificial Sequence
  Description of Artificial Sequence: Synthetic peptide
VIWFDGSNKYYADSVKG

SEQ ID NO: 12815 - DNA, 51 bp, Artificial Sequence; identical to SEQ ID NO: 12263
  Description of Artificial Sequence: Synthetic oligonucleotide

SEQ ID NO: 12816 - protein, 17 aa, Artificial Sequence
  Description of Artificial Sequence: Synthetic peptide
VIWHDGSNKYYADSVKG

SEQ ID NO: 12817 - DNA, 51 bp, Artificial Sequence
  Description of Artificial Sequence: Synthetic oligonucleotide
gtcatatggcatgatggaagtaataaatactatgtagactccgtgaagggc

SEQ ID NO: 12818 - protein, 17 aa, Artificial Sequence
  Description of Artificial Sequence: Synthetic peptide
VIWHDGSNKYYVDSVKG

SEQ ID NO: 12819 - DNA, 51 bp, Artificial Sequence; identical to SEQ ID NO: 12345
  Description of Artificial Sequence: Synthetic oligonucleotide

SEQ ID NO: 12820 - protein, 17 aa, Artificial Sequence
  Description of Artificial Sequence: Synthetic peptide
VISRSGGYTYYADSVKG

SEQ ID NO: 12821 - DNA, 51 bp, Artificial Sequence
  Description of Artificial Sequence: Synthetic oligonucleotide
gttatatggcatgatgaaagtaataaatactatacagactccgtgaagggc

SEQ ID NO: 12822 - protein, 17 aa, Artificial Sequence
  Description of Artificial Sequence: Synthetic peptide
VIWHDESNKYYTDSVKG

SEQ ID NO: 12823 - DNA, 51 bp, Artificial Sequence; identical to SEQ ID NO: 12491
  Description of Artificial Sequence: Synthetic oligonucleotide

SEQ ID NO: 12824 - protein, 17 aa, Artificial Sequence
  Description of Artificial Sequence: Synthetic peptide
VIWYDENNKYYADSVKG

SEQ ID NO: 12825 - DNA, 51 bp, Artificial Sequence
  Description of Artificial Sequence: Synthetic oligonucleotide
gttatatggtatgacgaaagtaataaatactatgaagactccgtgaagggc

SEQ ID NO: 12826 - protein, 17 aa, Artificial Sequence
  Description of Artificial Sequence: Synthetic peptide
VIWYDESNKYYEDSVKG

SEQ ID NO: 12827 - DNA, 51 bp, Artificial Sequence
  Description of Artificial Sequence: Synthetic oligonucleotide
gttattagtggtcgtggtgttaacacattctacgcagactccgtgaagggc

SEQ ID NO: 12828 - protein, 17 aa, Artificial Sequence
  Description of Artificial Sequence: Synthetic peptide
VISGRGVNTFYADSVKG

SEQ ID NO: 12829 - DNA, 51 bp, Artificial Sequence; identical to SEQ ID NO: 12123
  Description of Artificial Sequence: Synthetic oligonucleotide

SEQ ID NO: 12830 - protein, 17 aa, Artificial Sequence
  Description of Artificial Sequence: Synthetic peptide
VIWYDGSNKYYADSVKG

SEQ ID NO: 12831 - DNA, 51 bp, Artificial Sequence; identical to SEQ ID NO: 12231
  Description of Artificial Sequence: Synthetic oligonucleotide

SEQ ID NO: 12832 - protein, 17 aa, Artificial Sequence
  Description of Artificial Sequence: Synthetic peptide
VIWYEENNQYYADSVKG

SEQ ID NO: 12833 - DNA, 51 bp, Artificial Sequence
  Description of Artificial Sequence: Synthetic oligonucleotide
gttatatggcatgatgaaactaataaatactatgcagattccgtgaagggc

SEQ ID NO: 12834 - protein, 17 aa, Artificial Sequence
  Description of Artificial Sequence: Synthetic peptide
VIWHDETNKYYADSVKG

SEQ ID NO: 12835 - DNA, 51 bp, Artificial Sequence
  Description of Artificial Sequence: Synthetic oligonucleotide
actattagtggtagtggtggtatcacatactacgcagactccgtgaagggc

SEQ ID NO: 12836 - protein, 17 aa, Artificial Sequence
  Description of Artificial Sequence: Synthetic peptide
TISGSGGITYYADSVKG

SEQ ID NO: 12837 - DNA, 48 bp, Artificial Sequence; identical to SEQ ID NO: 12417
  Description of Artificial Sequence: Synthetic oligonucleotide

SEQ ID NO: 12838 - protein, 16 aa, Artificial Sequence
  Description of Artificial Sequence: Synthetic peptide
NIYYSGSTYYNPSVKS

SEQ ID NO: 12839 - DNA, 51 bp, Artificial Sequence; identical to SEQ ID NO: 12231
  Description of Artificial Sequence: Synthetic oligonucleotide

SEQ ID NO: 12840 - protein, 17 aa, Artificial Sequence
  Description of Artificial Sequence: Synthetic peptide
VIWYEENNQYYADSVKG

SEQ ID NO: 12841 - DNA, 51 bp, Artificial Sequence; identical to SEQ ID NO: 12227
  Description of Artificial Sequence: Synthetic oligonucleotide

SEQ ID NO: 12842 - protein, 17 aa, Artificial Sequence
  Description of Artificial Sequence: Synthetic peptide
VIWFDGSNKYYADSVKG

SEQ ID NO: 12843 - DNA, 51 bp, Artificial Sequence; identical to SEQ ID NO: 12273
  Description of Artificial Sequence: Synthetic oligonucleotide

SEQ ID NO: 12844 - protein, 17 aa, Artificial Sequence
  Description of Artificial Sequence: Synthetic peptide
VISGSGGSTYYADSVKG

SEQ ID NO: 12845 - DNA, 48 bp, Artificial Sequence; identical to SEQ ID NO: 12401
  Description of Artificial Sequence: Synthetic oligonucleotide

SEQ ID NO: 12846 - protein, 16 aa, Artificial Sequence
  Description of Artificial Sequence: Synthetic peptide
SIYYSGSAQYNPSLKS

SEQ ID NO: 12847 - DNA, 51 bp, Artificial Sequence
  Description of Artificial Sequence: Synthetic oligonucleotide
gttatatggtatgaggaaaataataaacactatgcagactccgtgaagggc

SEQ ID NO: 12848 - protein, 17 aa, Artificial Sequence
  Description of Artificial Sequence: Synthetic peptide
VIWYEENNKHYADSVKG

SEQ ID NO: 12849 - DNA, 51 bp, Artificial Sequence
  Description of Artificial Sequence: Synthetic oligonucleotide
gttatatggtatgaaggaagtaatcaatactatggagactccgtgaagggc

SEQ ID NO: 12850 - protein, 17 aa, Artificial Sequence
  Description of Artificial Sequence: Synthetic peptide
VIWYEGSNQYYGDSVKG

SEQ ID NO: 12851 - DNA, 48 bp, Artificial Sequence
  Description of Artificial Sequence: Synthetic oligonucleotide
agtatctattatagtggaagcacctcctacaacccgtccctcaacagt

SEQ ID NO: 12852 - protein, 16 aa, Artificial Sequence
  Description of Artificial Sequence: Synthetic peptide
SIYYSGSTSYNPSLNS

SEQ ID NO: 12853 - DNA, 51 bp, Artificial Sequence; identical to SEQ ID NO: 12293
  Description of Artificial Sequence: Synthetic oligonucleotide

SEQ ID NO: 12854 - protein, 17 aa, Artificial Sequence
  Description of Artificial Sequence: Synthetic peptide
IISGRGGNTFYADSVKG

SEQ ID NO: 12855 - DNA, 48 bp, Artificial Sequence
  Description of Artificial Sequence: Synthetic oligonucleotide
cgtatctataccagtgggagcaccaactacatcccctccctcaagagt

SEQ ID NO: 12856 - protein, 16 aa, Artificial Sequence
  Description of Artificial Sequence: Synthetic peptide
RIYTSGSTNYIPSLKS

SEQ ID NO: 12857 - DNA, 51 bp, Artificial Sequence
  Description of Artificial Sequence: Synthetic oligonucleotide
attatatcatatgttggaaagaataaatattatgcagactccgtgaagggc

SEQ ID NO: 12858 - protein, 17 aa, Artificial Sequence
  Description of Artificial Sequence: Synthetic peptide
IISYVGKNKYYADSVKG

SEQ ID NO: 12859 - DNA, 51 bp, Artificial Sequence; identical to SEQ ID NO: 12701
  Description of Artificial Sequence: Synthetic oligonucleotide

SEQ ID NO: 12860 - protein, 17 aa, Artificial Sequence
  Description of Artificial Sequence: Synthetic peptide
SISGSSTYIYYADSVKG

SEQ ID NO: 12861 - DNA, 51 bp, Artificial Sequence; identical to SEQ ID NO: 12701
  Description of Artificial Sequence: Synthetic oligonucleotide

SEQ ID NO: 12862 - protein, 17 aa, Artificial Sequence
  Description of Artificial Sequence: Synthetic peptide
SISGSSTYIYYADSVKG

SEQ ID NO: 12863 - DNA, 51 bp, Artificial Sequence; identical to SEQ ID NO: 12293
  Description of Artificial Sequence: Synthetic oligonucleotide

SEQ ID NO: 12864 - protein, 17 aa, Artificial Sequence
  Description of Artificial Sequence: Synthetic peptide
IISGRGGNTFYADSVKG

SEQ ID NO: 12865 - DNA, 51 bp, Artificial Sequence; identical to SEQ ID NO: 12567
  Description of Artificial Sequence: Synthetic oligonucleotide

SEQ ID NO: 12866 - protein, 17 aa, Artificial Sequence
  Description of Artificial Sequence: Synthetic peptide
VIWHDGSNKYYVDSVKG

SEQ ID NO: 12867 - DNA, 51 bp, Artificial Sequence; identical to SEQ ID NO: 12123
  Description of Artificial Sequence: Synthetic oligonucleotide

SEQ ID NO: 12868 - protein, 17 aa, Artificial Sequence
  Description of Artificial Sequence: Synthetic peptide
VIWYDGSNKYYADSVKG

SEQ ID NO: 12869 - DNA, 51 bp, Artificial Sequence
  Description of Artificial Sequence: Synthetic oligonucleotide
gttatatggtatgatggaagtgatagatactctgcagactccgtgaagggc

SEQ ID NO: 12870 - protein, 17 aa, Artificial Sequence
  Description of Artificial Sequence: Synthetic peptide
VIWYDGSDRYSADSVKG

SEQ ID NO: 12871 - DNA, 51 bp, Artificial Sequence; identical to SEQ ID NO: 12519
  Description of Artificial Sequence: Synthetic oligonucleotide

SEQ ID NO: 12872 - protein, 17 aa, Artificial Sequence
  Description of Artificial Sequence: Synthetic peptide
SISGSSSYIYYADSVKG

SEQ ID NO: 12873 - DNA, 51 bp, Artificial Sequence; identical to SEQ ID NO: 12123
  Description of Artificial Sequence: Synthetic oligonucleotide

SEQ ID NO: 12874 - protein, 17 aa, Artificial Sequence
  Description of Artificial Sequence: Synthetic peptide
VIWYDGSNKYYADSVKG

SEQ ID NO: 12875 - DNA, 51 bp, Artificial Sequence
  Description of Artificial Sequence: Synthetic oligonucleotide
gttatatcatatggtggaagtaataattactatgcagactccgtgaagggc

SEQ ID NO: 12876 - protein, 17 aa, Artificial Sequence
  Description of Artificial Sequence: Synthetic peptide
VISYGGSNNYYADSVKG

SEQ ID NO: 12877 - DNA, 51 bp, Artificial Sequence; identical to SEQ ID NO: 12849
  Description of Artificial Sequence: Synthetic oligonucleotide

SEQ ID NO: 12878 - protein, 17 aa, Artificial Sequence
  Description of Artificial Sequence: Synthetic peptide
VIWYEGSNQYYGDSVKG

SEQ ID NO: 12879 - DNA, 51 bp, Artificial Sequence; identical to SEQ ID NO: 12701
  Description of Artificial Sequence: Synthetic oligonucleotide

SEQ ID NO: 12880 - protein, 17 aa, Artificial Sequence
  Description of Artificial Sequence: Synthetic peptide
SISGSSTYIYYADSVKG

SEQ ID NO: 12881 - DNA, 51 bp, Artificial Sequence; identical to SEQ ID NO: 12123
  Description of Artificial Sequence: Synthetic oligonucleotide

SEQ ID NO: 12882 - protein, 17 aa, Artificial Sequence
  Description of Artificial Sequence: Synthetic peptide
VIWYDGSNKYYADSVKG

SEQ ID NO: 12883 - DNA, 51 bp, Artificial Sequence
  Description of Artificial Sequence: Synthetic oligonucleotide
attatatggcatgatggaagtaataaatactatgtagactccgtgaagggc

SEQ ID NO: 12884 - protein, 17 aa, Artificial Sequence
  Description of Artificial Sequence: Synthetic peptide
IIWHDGSNKYYVDSVKG

SEQ ID NO: 12885 - DNA, 51 bp, Artificial Sequence; identical to SEQ ID NO: 12265
  Description of Artificial Sequence: Synthetic oligonucleotide

SEQ ID NO: 12886 - protein, 17 aa, Artificial Sequence
  Description of Artificial Sequence: Synthetic peptide
VIWYEENNKYYVDSVKG

SEQ ID NO: 12887 - DNA, 51 bp, Artificial Sequence; identical to SEQ ID NO: 12263
  Description of Artificial Sequence: Synthetic oligonucleotide

SEQ ID NO: 12888 - protein, 17 aa, Artificial Sequence
  Description of Artificial Sequence: Synthetic peptide
VIWHDGSNKYYADSVKG

SEQ ID NO: 12889 - DNA, 48 bp, Artificial Sequence
  Description of Artificial Sequence: Synthetic oligonucleotide
agtgtctattatagtggggccacctcctacaacccgtccctcaagagt

SEQ ID NO: 12890 - protein, 16 aa, Artificial Sequence
  Description of Artificial Sequence: Synthetic peptide
SVYYSGATSYNPSLKS

SEQ ID NO: 12891 - DNA, 51 bp, Artificial Sequence
  Description of Artificial Sequence: Synthetic oligonucleotide
attatatggcatgatggaagtaataaatactatgcagactccgtgaagggc

SEQ ID NO: 12892 - protein, 17 aa, Artificial Sequence
  Description of Artificial Sequence: Synthetic peptide
IIWHDGSNKYYADSVKG

SEQ ID NO: 12893 - DNA, 51 bp, Artificial Sequence
  Description of Artificial Sequence: Synthetic oligonucleotide
attatatggcatgatggaagtaataaatattatgtagactccgtgaagggc

SEQ ID NO: 12894 - protein, 17 aa, Artificial Sequence
  Description of Artificial Sequence: Synthetic peptide
IIWHDGSNKYYVDSVKG

SEQ ID NO: 12895 - DNA, 51 bp, Artificial Sequence
  Description of Artificial Sequence: Synthetic oligonucleotide
gttatatggtatgatgaaaataataaatattatatagactccgtgaagggc

SEQ ID NO: 12896 - protein, 17 aa, Artificial Sequence
  Description of Artificial Sequence: Synthetic peptide
VIWYDENNKYYIDSVKG

SEQ ID NO: 12897 - DNA, 51 bp, Artificial Sequence
  Description of Artificial Sequence: Synthetic oligonucleotide
gttattagtggtagaggtggtagtacatactacgcagactccgtgaagggc

SEQ ID NO: 12898 - protein, 17 aa, Artificial Sequence
  Description of Artificial Sequence: Synthetic peptide
VISGRGGSTYYADSVKG

SEQ ID NO: 12899 - DNA, 51 bp, Artificial Sequence
  Description of Artificial Sequence: Synthetic oligonucleotide
gttattagtggtagtggtggtagcacattctacgcagactccgtgaagggc

SEQ ID NO: 12900 - protein, 17 aa, Artificial Sequence
  Description of Artificial Sequence: Synthetic peptide
VISGSGGSTFYADSVKG

SEQ ID NO: 12901 - DNA, 51 bp, Artificial Sequence
  Description of Artificial Sequence: Synthetic oligonucleotide
tggatgcaccctaacagtggtgccaccggctatgcacagaggttccagggc

SEQ ID NO: 12902 - protein, 17 aa, Artificial Sequence
  Description of Artificial Sequence: Synthetic peptide
WMHPNSGATGYAQRFQG

SEQ ID NO: 12903 - DNA, 51 bp, Artificial Sequence; identical to SEQ ID NO: 12785
  Description of Artificial Sequence: Synthetic oligonucleotide

SEQ ID NO: 12904 - protein, 17 aa, Artificial Sequence
  Description of Artificial Sequence: Synthetic peptide
SISGSGSYIYYADSVKG

SEQ ID NO: 12905 - DNA, 51 bp, Artificial Sequence
  Description of Artificial Sequence: Synthetic oligonucleotide
tccattagtggtagtagtacttacaaatactacgcagactcagtgaagggc

SEQ ID NO: 12906 - protein, 17 aa, Artificial Sequence
  Description of Artificial Sequence: Synthetic peptide
SISGSSTYKYYADSVKG

SEQ ID NO: 12907 - DNA, 51 bp, Artificial Sequence; identical to SEQ ID NO: 12283
  Description of Artificial Sequence: Synthetic oligonucleotide

SEQ ID NO: 12908 - protein, 17 aa, Artificial Sequence
  Description of Artificial Sequence: Synthetic peptide
VIWFDGSNKYYVDSVKG

SEQ ID NO: 12909 - DNA, 51 bp, Artificial Sequence; identical to SEQ ID NO: 12123
  Description of Artificial Sequence: Synthetic oligonucleotide

SEQ ID NO: 12910 - protein, 17 aa, Artificial Sequence
  Description of Artificial Sequence: Synthetic peptide
VIWYDGSNKYYADSVKG

SEQ ID NO: 12911 - DNA, 51 bp, Artificial Sequence; identical to SEQ ID NO: 12361
  Description of Artificial Sequence: Synthetic oligonucleotide

SEQ ID NO: 12912 - protein, 17 aa, Artificial Sequence
  Description of Artificial Sequence: Synthetic peptide
SISSSSSYIYYADSVKG

SEQ ID NO: 12913 - DNA, 51 bp, Artificial Sequence; identical to SEQ ID NO: 12189
  Description of Artificial Sequence: Synthetic oligonucleotide

SEQ ID NO: 12914 - protein, 17 aa, Artificial Sequence
  Description of Artificial Sequence: Synthetic peptide
WIHPNSGGTNYAQKFQG

SEQ ID NO: 12915 - DNA, 51 bp, Artificial Sequence; identical to SEQ ID NO: 12157
  Description of Artificial Sequence: Synthetic oligonucleotide

SEQ ID NO: 12916 - protein, 17 aa, Artificial Sequence
  Description of Artificial Sequence: Synthetic peptide
VLSGSGGSTFYADSVKG

SEQ ID NO: 12917 - DNA, 51 bp, Artificial Sequence; identical to SEQ ID NO: 12153
  Description of Artificial Sequence: Synthetic oligonucleotide

SEQ ID NO: 12918 - protein, 17 aa, Artificial Sequence
  Description of Artificial Sequence: Synthetic peptide
SISGSSSYIYYADSVKG

SEQ ID NO: 12919 - DNA, 51 bp, Artificial Sequence; identical to SEQ ID NO: 12269
  Description of Artificial Sequence: Synthetic oligonucleotide

SEQ ID NO: 12920 - protein, 17 aa, Artificial Sequence
  Description of Artificial Sequence: Synthetic peptide
VIWYDVTNKYYADSVKG

SEQ ID NO: 12921 - DNA, 48 bp, Artificial Sequence
  Description of Artificial Sequence: Synthetic oligonucleotide
aatatctattatagtgggagcacctactacatcccgtccctcaagagt

SEQ ID NO: 12922 - protein, 16 aa, Artificial Sequence
  Description of Artificial Sequence: Synthetic peptide
NIYYSGSTYYIPSLKS

SEQ ID NO: 12923 - DNA, 51 bp, Artificial Sequence; identical to SEQ ID NO: 12127
  Description of Artificial Sequence: Synthetic oligonucleotide

SEQ ID NO: 12924 - protein, 17 aa, Artificial Sequence
  Description of Artificial Sequence: Synthetic peptide
IIWYDGSNKYYADSVKG

SEQ ID NO: 12925 - DNA, 51 bp, Artificial Sequence; identical to SEQ ID NO: 12123
  Description of Artificial Sequence: Synthetic oligonucleotide

SEQ ID NO: 12926 - protein, 17 aa, Artificial Sequence
  Description of Artificial Sequence: Synthetic peptide
VIWYDGSNKYYADSVKG

SEQ ID NO: 12927 - DNA, 51 bp, Artificial Sequence; identical to SEQ ID NO: 12467
  Description of Artificial Sequence: Synthetic oligonucleotide

SEQ ID NO: 12928 - protein, 17 aa, Artificial Sequence
  Description of Artificial Sequence: Synthetic peptide
AISGSGGYTYYADSVKG

SEQ ID NO: 12929 - DNA, 51 bp, Artificial Sequence; identical to SEQ ID NO: 12123
  Description of Artificial Sequence: Synthetic oligonucleotide

SEQ ID NO: 12930 - protein, 17 aa, Artificial Sequence
  Description of Artificial Sequence: Synthetic peptide
VIWYDGSNKYYADSVKG

SEQ ID NO: 12931 - DNA, 51 bp, Artificial Sequence; identical to SEQ ID NO: 12231
  Description of Artificial Sequence: Synthetic oligonucleotide

SEQ ID NO: 12932 - protein, 17 aa, Artificial Sequence
  Description of Artificial Sequence: Synthetic peptide
VIWYEENNQYYADSVKG

SEQ ID NO: 12933 - DNA, 51 bp, Artificial Sequence; identical to SEQ ID NO: 12391
  Description of Artificial Sequence: Synthetic oligonucleotide

SEQ ID NO: 12934 - protein, 17 aa, Artificial Sequence
  Description of Artificial Sequence: Synthetic peptide
VIWYDENNKYYVDSVKG

SEQ ID NO: 12935 - DNA, 51 bp, Artificial Sequence; identical to SEQ ID NO: 12123
  Description of Artificial Sequence: Synthetic oligonucleotide

SEQ ID NO: 12936 - protein, 17 aa, Artificial Sequence
  Description of Artificial Sequence: Synthetic peptide
VIWYDGSNKYYADSVKG

SEQ ID NO: 12937 - DNA, 51 bp, Artificial Sequence; identical to SEQ ID NO: 12253
  Description of Artificial Sequence: Synthetic oligonucleotide

SEQ ID NO: 12938 - protein, 17 aa, Artificial Sequence
  Description of Artificial Sequence: Synthetic peptide
VISGRGGNTFYADSVKG

SEQ ID NO: 12939 - DNA, 51 bp, Artificial Sequence; identical to SEQ ID NO: 12361
  Description of Artificial Sequence: Synthetic oligonucleotide

SEQ ID NO: 12940 - protein, 17 aa, Artificial Sequence
  Description of Artificial Sequence: Synthetic peptide
SISSSSSYIYYADSVKG

SEQ ID NO: 12941 - DNA, 51 bp, Artificial Sequence
  Description of Artificial Sequence: Synthetic oligonucleotide
gttatatggtatgatgttactaataaaaagtatgcagactccgtgaagggc

SEQ ID NO: 12942 - protein, 17 aa, Artificial Sequence
  Description of Artificial Sequence: Synthetic peptide
VIWYDVTNKKYADSVKG

SEQ ID NO: 12943 - DNA, 51 bp, Artificial Sequence; identical to SEQ ID NO: 12123
  Description of Artificial Sequence: Synthetic oligonucleotide

SEQ ID NO: 12944 - protein, 17 aa, Artificial Sequence
  Description of Artificial Sequence: Synthetic peptide
VIWYDGSNKYYADSVKG

SEQ ID NO: 12945 - DNA, 51 bp, Artificial Sequence; identical to SEQ ID NO: 12361
  Description of Artificial Sequence: Synthetic oligonucleotide

SEQ ID NO: 12946 - protein, 17 aa, Artificial Sequence
  Description of Artificial Sequence: Synthetic peptide
SISSSSSYIYYADSVKG

SEQ ID NO: 12947 - DNA, 48 bp, Artificial Sequence
  Description of Artificial Sequence: Synthetic oligonucleotide
agtatctattatagtgggagcacctcctacagcccgtccctcaagagt

SEQ ID NO: 12948 - protein, 16 aa, Artificial Sequence
  Description of Artificial Sequence: Synthetic peptide
SIYYSGSTSYSPSLKS

SEQ ID NO: 12949 - DNA, 51 bp, Artificial Sequence
  Description of Artificial Sequence: Synthetic oligonucleotide
tacattagtagtagtagtagtaccatatactacgcagactctgtgaagggc

SEQ ID NO: 12950 - protein, 17 aa, Artificial Sequence
  Description of Artificial Sequence: Synthetic peptide
YISSSSSTIYYADSVKG

SEQ ID NO: 12951 - DNA, 51 bp, Artificial Sequence; identical to SEQ ID NO: 12391
  Description of Artificial Sequence: Synthetic oligonucleotide

SEQ ID NO: 12952 - protein, 17 aa, Artificial Sequence
  Description of Artificial Sequence: Synthetic peptide
VIWYDENNKYYVDSVKG

SEQ ID NO: 12953 - DNA, 51 bp, Artificial Sequence; identical to SEQ ID NO: 12123
  Description of Artificial Sequence: Synthetic oligonucleotide

SEQ ID NO: 12954 - protein, 17 aa, Artificial Sequence
  Description of Artificial Sequence: Synthetic peptide
VIWYDGSNKYYADSVKG

SEQ ID NO: 12955 - DNA, 51 bp, Artificial Sequence; identical to SEQ ID NO: 12269
  Description of Artificial Sequence: Synthetic oligonucleotide

SEQ ID NO: 12956 - protein, 17 aa, Artificial Sequence
  Description of Artificial Sequence: Synthetic peptide
VIWYDVTNKYYADSVKG

SEQ ID NO: 12957 - DNA, 51 bp, Artificial Sequence
  Description of Artificial Sequence: Synthetic oligonucleotide
gttatatcatatggtggaagtaataaagactctgcagactccgtgaagggc

SEQ ID NO: 12958 - protein, 17 aa, Artificial Sequence
  Description of Artificial Sequence: Synthetic peptide
VISYGGSNKDSADSVKG

SEQ ID NO: 12959 - DNA, 48 bp, Artificial Sequence
  Description of Artificial Sequence: Synthetic oligonucleotide
agtatctattatagtgggtacacctattacaccccgtccctcaagagt

SEQ ID NO: 12960 - protein, 16 aa, Artificial Sequence
  Description of Artificial Sequence: Synthetic peptide
SIYYSGYTYYTPSLKS

SEQ ID NO: 12961 - DNA, 51 bp, Artificial Sequence
  Description of Artificial Sequence: Synthetic oligonucleotide
gttatatcatatgcgggaactaatcaatactatgcagactccgtgaagggc

SEQ ID NO: 12962 - protein, 17 aa, Artificial Sequence
  Description of Artificial Sequence: Synthetic peptide
VISYAGTNQYYADSVKG

SEQ ID NO: 12963 - DNA, 51 bp, Artificial Sequence
  Description of Artificial Sequence: Synthetic oligonucleotide
ataatatcatatggtggacgtaataatcactatgcagactccgtgaagggc

SEQ ID NO: 12964 - protein, 17 aa, Artificial Sequence
  Description of Artificial Sequence: Synthetic peptide
IISYGGRNNHYADSVKG

SEQ ID NO: 12965 - DNA, 51 bp, Artificial Sequence
  Description of Artificial Sequence: Synthetic oligonucleotide
tccattagtggtagtagtacttacatatactgcgcagactcaatcaagggc

SEQ ID NO: 12966 - protein, 17 aa, Artificial Sequence
  Description of Artificial Sequence: Synthetic peptide
SISGSSTYIYCADSIKG

SEQ ID NO: 12967 - DNA, 51 bp, Artificial Sequence; identical to SEQ ID NO: 12339
  Description of Artificial Sequence: Synthetic oligonucleotide

SEQ ID NO: 12968 - protein, 17 aa, Artificial Sequence
  Description of Artificial Sequence: Synthetic peptide
VISYDGSNKYYADSVKG

SEQ ID NO: 12969 - DNA, 51 bp, Artificial Sequence; identical to SEQ ID NO: 12263
  Description of Artificial Sequence: Synthetic oligonucleotide

SEQ ID NO: 12970 - protein, 17 aa, Artificial Sequence
  Description of Artificial Sequence: Synthetic peptide
VIWHDGSNKYYADSVKG

SEQ ID NO: 12971 - DNA, 51 bp, Artificial Sequence; identical to SEQ ID NO: 12253
  Description of Artificial Sequence: Synthetic oligonucleotide

SEQ ID NO: 12972 - protein, 17 aa, Artificial Sequence
  Description of Artificial Sequence: Synthetic peptide
VISGRGGNTFYADSVKG

SEQ ID NO: 12973 - DNA, 51 bp, Artificial Sequence; identical to SEQ ID NO: 12263
  Description of Artificial Sequence: Synthetic oligonucleotide

SEQ ID NO: 12974 - protein, 17 aa, Artificial Sequence
  Description of Artificial Sequence: Synthetic peptide
VIWHDGSNKYYADSVKG

SEQ ID NO: 12975 - DNA, 51 bp, Artificial Sequence
  Description of Artificial Sequence: Synthetic oligonucleotide
ggtattagtggtagtggtggtagcacaaacaacgcagactccgtgaagggc

SEQ ID NO: 12976 - protein, 17 aa, Artificial Sequence
  Description of Artificial Sequence: Synthetic peptide
GISGSGGSTNNADSVKG

SEQ ID NO: 12977 - DNA, 51 bp, Artificial Sequence
  Description of Artificial Sequence: Synthetic oligonucleotide
gttatatggtatgatgaaagtaataaatactatgaagactccgtgaagggc

SEQ ID NO: 12978 - protein, 17 aa, Artificial Sequence
  Description of Artificial Sequence: Synthetic peptide
VIWYDESNKYYEDSVKG

SEQ ID NO: 12979 - DNA, 51 bp, Artificial Sequence; identical to SEQ ID NO: 12345
  Description of Artificial Sequence: Synthetic oligonucleotide

SEQ ID NO: 12980 - protein, 17 aa, Artificial Sequence
  Description of Artificial Sequence: Synthetic peptide
VISRSGGYTYYADSVKG

SEQ ID NO: 12981 - DNA, 51 bp, Artificial Sequence; identical to SEQ ID NO: 12301
  Description of Artificial Sequence: Synthetic oligonucleotide

SEQ ID NO: 12982 - protein, 17 aa, Artificial Sequence
  Description of Artificial Sequence: Synthetic peptide
VIWYDESNKYYADSVKG

SEQ ID NO: 12983 - DNA, 51 bp, Artificial Sequence
  Description of Artificial Sequence: Synthetic oligonucleotide
actattagtggtagtggtggttggacatattatgcagactccgtgaagggc

SEQ ID NO: 12984 - protein, 17 aa, Artificial Sequence
  Description of Artificial Sequence: Synthetic peptide
TISGSGGWTYYADSVKG

SEQ ID NO: 12985 - DNA, 51 bp, Artificial Sequence; identical to SEQ ID NO: 12445
  Description of Artificial Sequence: Synthetic oligonucleotide

SEQ ID NO: 12986 - protein, 17 aa, Artificial Sequence
  Description of Artificial Sequence: Synthetic peptide
IISYAGSNKSYADSVKG

SEQ ID NO: 12987 - DNA, 51 bp, Artificial Sequence; identical to SEQ ID NO: 12153
  Description of Artificial Sequence: Synthetic oligonucleotide

SEQ ID NO: 12988 - protein, 17 aa, Artificial Sequence
  Description of Artificial Sequence: Synthetic peptide
SISGSSSYIYYADSVKG

SEQ ID NO: 12989 - DNA, 51 bp, Artificial Sequence
  Description of Artificial Sequence: Synthetic oligonucleotide
attatatcatatgctggaagtaataaatactatgcagactccgtgaagggc

SEQ ID NO: 12990 - protein, 17 aa, Artificial Sequence
  Description of Artificial Sequence: Synthetic peptide
IISYAGSNKYYADSVKG

SEQ ID NO: 12991 - DNA, 48 bp, Artificial Sequence; identical to SEQ ID NO: 12377
  Description of Artificial Sequence: Synthetic oligonucleotide

SEQ ID NO: 12992 - protein, 16 aa, Artificial Sequence
  Description of Artificial Sequence: Synthetic peptide
NIYYSGSTYDNPSLKS

SEQ ID NO: 12993 - DNA, 51 bp, Artificial Sequence; identical to SEQ ID NO: 12123
  Description of Artificial Sequence: Synthetic oligonucleotide

SEQ ID NO: 12994 - protein, 17 aa, Artificial Sequence
  Description of Artificial Sequence: Synthetic peptide
VIWYDGSNKYYADSVKG

SEQ ID NO: 12995 - DNA, 51 bp, Artificial Sequence
  Description of Artificial Sequence: Synthetic oligonucleotide
gttattagtggtcgtggtattaacacattctacgcagactccgtgaagggc

SEQ ID NO: 12996 - protein, 17 aa, Artificial Sequence
  Description of Artificial Sequence: Synthetic peptide
VISGRGINTFYADSVKG

SEQ ID NO: 12997 - DNA, 48 bp, Artificial Sequence
  Description of Artificial Sequence: Synthetic oligonucleotide
aatatttattatagtgggaacacctacaacaacccgtccctcaagagt

SEQ ID NO: 12998 - protein, 16 aa, Artificial Sequence
  Description of Artificial Sequence: Synthetic peptide
NIYYSGNTYNNPSLKS

SEQ ID NO: 12999 - DNA, 51 bp, Artificial Sequence
  Description of Artificial Sequence: Synthetic oligonucleotide
attatatcatatgttggaaataataaatactatgcagactccgtgaagggc

SEQ ID NO: 13000 - protein, 17 aa, Artificial Sequence
  Description of Artificial Sequence: Synthetic peptide
IISYVGNNKYYADSVKG

SEQ ID NO: 13001 - DNA, 48 bp, Artificial Sequence
  Description of Artificial Sequence: Synthetic oligonucleotide
agtatctattatagtgggagcacctactacaacccgtccctcaagagt

SEQ ID NO: 13002 - protein, 16 aa, Artificial Sequence
  Description of Artificial Sequence: Synthetic peptide
SIYYSGSTYYNPSLKS

SEQ ID NO: 13003 - DNA, 51 bp, Artificial Sequence
  Description of Artificial Sequence: Synthetic oligonucleotide
gctattagtggtggtggtggtaacacattctacgcagactccgtgaagggc

SEQ ID NO: 13004 - protein, 17 aa, Artificial Sequence
  Description of Artificial Sequence: Synthetic peptide
AISGGGGNTFYADSVKG

SEQ ID NO: 13005 - DNA, 48 bp, Artificial Sequence
  Description of Artificial Sequence: Synthetic oligonucleotide
agtatttattatagtgggagcgcccagtacaacccgtccctcaagagt

SEQ ID NO: 13006 - protein, 16 aa, Artificial Sequence
  Description of Artificial Sequence: Synthetic peptide
SIYYSGSAQYNPSLKS

SEQ ID NO: 13007 - DNA, 48 bp, Artificial Sequence
  Description of Artificial Sequence: Synthetic oligonucleotide
tacattagtattagtagtaccatatactatgcagactctgtgaagggc

SEQ ID NO: 13008 - protein, 16 aa, Artificial Sequence
  Description of Artificial Sequence: Synthetic peptide
YISISSTIYYADSVKG

SEQ ID NO: 13009 - DNA, 48 bp, Artificial Sequence
  Description of Artificial Sequence: Synthetic oligonucleotide
aatatctattatagtgggtatccctactacaatccgtccctcaagagt

SEQ ID NO: 13010 - protein, 16 aa, Artificial Sequence
  Description of Artificial Sequence: Synthetic peptide
NIYYSGYPYYNPSLKS

SEQ ID NO: 13011 - DNA, 51 bp, Artificial Sequence; identical to SEQ ID NO: 12231
  Description of Artificial Sequence: Synthetic oligonucleotide

SEQ ID NO: 13012 - protein, 17 aa, Artificial Sequence
  Description of Artificial Sequence: Synthetic peptide
VIWYEENNQYYADSVKG

SEQ ID NO: 13013 - DNA, 51 bp, Artificial Sequence; identical to SEQ ID NO: 12361
  Description of Artificial Sequence: Synthetic oligonucleotide

SEQ ID NO: 13014 - protein, 17 aa, Artificial Sequence
  Description of Artificial Sequence: Synthetic peptide
SISSSSSYIYYADSVKG

SEQ ID NO: 13015 - DNA, 48 bp, Artificial Sequence
  Description of Artificial Sequence: Synthetic oligonucleotide
agtatctattatagtgggagcgcctatcacaacccgtccctcaagagt

SEQ ID NO: 13016 - protein, 16 aa, Artificial Sequence
  Description of Artificial Sequence: Synthetic peptide
SIYYSGSAYHNPSLKS

SEQ ID NO: 13017 - DNA, 51 bp, Artificial Sequence
  Description of Artificial Sequence: Synthetic oligonucleotide
tggatgaacactaacagtggtaacacaggctatgcacagaagttccagggc

SEQ ID NO: 13018 - protein, 17 aa, Artificial Sequence
  Description of Artificial Sequence: Synthetic peptide
WMNTNSGNTGYAQKFQG

SEQ ID NO: 13019 - DNA, 51 bp, Artificial Sequence
  Description of Artificial Sequence: Synthetic oligonucleotide
gttatatggtttgatggaaataataaatactatgtagattccgtgaagggc

SEQ ID NO: 13020 - protein, 17 aa, Artificial Sequence
  Description of Artificial Sequence: Synthetic peptide
VIWFDGNNKYYVDSVKG

SEQ ID NO: 13021 - DNA, 51 bp, Artificial Sequence; identical to SEQ ID NO: 12701
  Description of Artificial Sequence: Synthetic oligonucleotide

SEQ ID NO: 13022 - protein, 17 aa, Artificial Sequence
  Description of Artificial Sequence: Synthetic peptide
SISGSSTYIYYADSVKG

SEQ ID NO: 13023 - DNA, 51 bp, Artificial Sequence
  Description of Artificial Sequence: Synthetic oligonucleotide
tccattagtagtagtaataattacatatactacgcagactcagtgaagggc

SEQ ID NO: 13024 - protein, 17 aa, Artificial Sequence
  Description of Artificial Sequence: Synthetic peptide
SISSSNNYIYYADSVKG

SEQ ID NO: 13025 - DNA, 48 bp, Artificial Sequence
  Description of Artificial Sequence: Synthetic oligonucleotide
aatatctattatagtgggagcacctacaacaacccgtccctcaagagt

SEQ ID NO: 13026 - protein, 16 aa, Artificial Sequence
  Description of Artificial Sequence: Synthetic peptide
NIYYSGSTYNNPSLKS

SEQ ID NO: 13027 - DNA, 48 bp, Artificial Sequence; identical to SEQ ID NO: 13009
  Description of Artificial Sequence: Synthetic oligonucleotide

SEQ ID NO: 13028 - protein, 16 aa, Artificial Sequence
  Description of Artificial Sequence: Synthetic peptide
NIYYSGYPYYNPSLKS

SEQ ID NO: 13029 - DNA, 51 bp, Artificial Sequence; identical to SEQ ID NO: 12293
  Description of Artificial Sequence: Synthetic oligonucleotide

SEQ ID NO: 13030 - protein, 17 aa, Artificial Sequence
  Description of Artificial Sequence: Synthetic peptide
IISGRGGNTFYADSVKG

SEQ ID NO: 13031 - DNA, 48 bp, Artificial Sequence
  Description of Artificial Sequence: Synthetic oligonucleotide
aatatttattatagtgggagcacctacaccaacccgtccctcaagagt

SEQ ID NO: 13032 - protein, 16 aa, Artificial Sequence
  Description of Artificial Sequence: Synthetic peptide
NIYYSGSTYTNPSLKS

SEQ ID NO: 13033 - DNA, 51 bp, Artificial Sequence
  Description of Artificial Sequence: Synthetic oligonucleotide
gttatatcatatgctggaattaataaatcctatgcagactccgtgaagggc

SEQ ID NO: 13034 - protein, 17 aa, Artificial Sequence
  Description of Artificial Sequence: Synthetic peptide
VISYAGINKSYADSVKG

SEQ ID NO: 13035 - DNA, 51 bp, Artificial Sequence; identical to SEQ ID NO: 12567
  Description of Artificial Sequence: Synthetic oligonucleotide

SEQ ID NO: 13036 - protein, 17 aa, Artificial Sequence
  Description of Artificial Sequence: Synthetic peptide
VIWHDGSNKYYVDSVKG

SEQ ID NO: 13037 - DNA, 51 bp, Artificial Sequence; identical to SEQ ID NO: 12161
  Description of Artificial Sequence: Synthetic oligonucleotide

SEQ ID NO: 13038 - protein, 17 aa, Artificial Sequence
  Description of Artificial Sequence: Synthetic peptide
WMHPNSGNTGYAQKFQG

SEQ ID NO: 13039 - DNA, 51 bp, Artificial Sequence; identical to SEQ ID NO: 12827
  Description of Artificial Sequence: Synthetic oligonucleotide

SEQ ID NO: 13040 - protein, 17 aa, Artificial Sequence
  Description of Artificial Sequence: Synthetic peptide
VISGRGVNTFYADSVKG

SEQ ID NO: 13041 - DNA, 51 bp, Artificial Sequence; identical to SEQ ID NO: 12301
  Description of Artificial Sequence: Synthetic oligonucleotide

SEQ ID NO: 13042 - protein, 17 aa, Artificial Sequence
  Description of Artificial Sequence: Synthetic peptide
VIWYDESNKYYADSVKG

SEQ ID NO: 13043 - DNA, 51 bp, Artificial Sequence
  Description of Artificial Sequence: Synthetic oligonucleotide
gttatttggtatgaggaaagtaataaatactatgtagactccgtgaggggc

SEQ ID NO: 13044 - protein, 17 aa, Artificial Sequence
  Description of Artificial Sequence: Synthetic peptide
VIWYEESNKYYVDSVRG

SEQ ID NO: 13045 - DNA, 51 bp, Artificial Sequence
  Description of Artificial Sequence: Synthetic oligonucleotide
gttatatggtatgatggaaataataattactatgcagactccgtgaagggc

SEQ ID NO: 13046 - protein, 17 aa, Artificial Sequence
  Description of Artificial Sequence: Synthetic peptide
VIWYDGNNNYYADSVKG

SEQ ID NO: 13047 - DNA, 51 bp, Artificial Sequence; identical to SEQ ID NO: 12617
  Description of Artificial Sequence: Synthetic oligonucleotide

SEQ ID NO: 13048 - protein, 17 aa, Artificial Sequence
  Description of Artificial Sequence: Synthetic peptide
VIWYDVSNKYYADSVKG

SEQ ID NO: 13049 - DNA, 51 bp, Artificial Sequence
  Description of Artificial Sequence: Synthetic oligonucleotide
gttatttggtatgatgaaaataatgaatactatgcagactccgtgaagggc

SEQ ID NO: 13050 - protein, 17 aa, Artificial Sequence
  Description of Artificial Sequence: Synthetic peptide
VIWYDENNEYYADSVKG

SEQ ID NO: 13051 - DNA, 51 bp, Artificial Sequence
  Description of Artificial Sequence: Synthetic oligonucleotide
tggatcaaccctaacagtggtggcacaaactatgtacagaagtttcagggc

SEQ ID NO: 13052 - protein, 17 aa, Artificial Sequence
  Description of Artificial Sequence: Synthetic peptide
WINPNSGGTNYVQKFQG

SEQ ID NO: 13053 - DNA, 51 bp, Artificial Sequence
  Description of Artificial Sequence: Synthetic oligonucleotide
actattagtgttggtggtggtaccacatactacgcagactccgtgaagggc

SEQ ID NO: 13054 - protein, 17 aa, Artificial Sequence
  Description of Artificial Sequence: Synthetic peptide
TISVGGGTTYYADSVKG

SEQ ID NO: 13055 - DNA, 51 bp, Artificial Sequence
  Description of Artificial Sequence: Synthetic oligonucleotide
gttattagtggtagtggtggtaacacatacttcgcagactccgtgaagggc

SEQ ID NO: 13056 - protein, 17 aa, Artificial Sequence
  Description of Artificial Sequence: Synthetic peptide
VISGSGGNTYFADSVKG

SEQ ID NO: 13057 - DNA, 51 bp, Artificial Sequence
  Description of Artificial Sequence: Synthetic oligonucleotide
gttattagtggtagtggtggtaccacattctacgcagactccgtgaagggc

SEQ ID NO: 13058 - protein, 17 aa, Artificial Sequence
  Description of Artificial Sequence: Synthetic peptide
VISGSGGTTFYADSVKG

SEQ ID NO: 13059 - DNA, 51 bp, Artificial Sequence
  Description of Artificial Sequence: Synthetic oligonucleotide
tccattagtggtagtagtagttacatgtactacgcagactcagtgaagggc

SEQ ID NO: 13060 - protein, 17 aa, Artificial Sequence
  Description of Artificial Sequence: Synthetic peptide
SISGSSSYMYYADSVKG

SEQ ID NO: 13061 - DNA, 51 bp, Artificial Sequence
  Description of Artificial Sequence: Synthetic oligonucleotide
tggatcaaccctaacagtggtggcacaaactatgaacagaagtttcagggc

SEQ ID NO: 13062 - protein, 17 aa, Artificial Sequence
  Description of Artificial Sequence: Synthetic peptide
WINPNSGGTNYEQKFQG

SEQ ID NO: 13063 - DNA, 51 bp, Artificial Sequence; identical to SEQ ID NO: 12153
  Description of Artificial Sequence: Synthetic oligonucleotide

SEQ ID NO: 13064 - protein, 17 aa, Artificial Sequence
  Description of Artificial Sequence: Synthetic peptide
SISGSSSYIYYADSVKG

SEQ ID NO: 13065 - DNA, 51 bp, Artificial Sequence
  Description of Artificial Sequence: Synthetic oligonucleotide
tggatcaaccctaacagtaatggcacaatctctgcacagaagtttcagggc

SEQ ID NO: 13066 - protein, 17 aa, Artificial Sequence
  Description of Artificial Sequence: Synthetic peptide
WINPNSNGTISAQKFQG

SEQ ID NO: 13067 - DNA, 51 bp, Artificial Sequence
  Description of Artificial Sequence: Synthetic oligonucleotide
tggatcaatcctaacagtggtggcacaaactatgcacagaagtttcagggc

SEQ ID NO: 13068 - protein, 17 aa, Artificial Sequence
  Description of Artificial Sequence: Synthetic peptide
WINPNSGGTNYAQKFQG

SEQ ID NO: 13069 - DNA, 57 bp, Artificial Sequence; identical to SEQ ID NO: 12475
  Description of Artificial Sequence: Synthetic oligonucleotide

SEQ ID NO: 13070 - protein, 19 aa, Artificial Sequence
  Description of Artificial Sequence: Synthetic peptide
RIKSKTDGGTTDYAAPVKG

SEQ ID NO: 13071 - DNA, 51 bp, Artificial Sequence
  Description of Artificial Sequence: Synthetic oligonucleotide
tggatcaaccctaacagtggtgggacaaacaatgcacagaagtttcagggc

SEQ ID NO: 13072 - protein, 17 aa, Artificial Sequence
  Description of Artificial Sequence: Synthetic peptide
WINPNSGGTNNAQKFQG

SEQ ID NO: 13073 - DNA, 51 bp, Artificial Sequence
  Description of Artificial Sequence: Synthetic oligonucleotide
gctcttagtggtcgtggtggtagcacatactacgcagactccgtgaagggc

SEQ ID NO: 13074 - protein, 17 aa, Artificial Sequence
  Description of Artificial Sequence: Synthetic peptide
ALSGRGGSTYYADSVKG

SEQ ID NO: 13075 - DNA, 51 bp, Artificial Sequence; identical to SEQ ID NO: 12505
  Description of Artificial Sequence: Synthetic oligonucleotide

SEQ ID NO: 13076 - protein, 17 aa, Artificial Sequence
  Description of Artificial Sequence: Synthetic peptide
WMHPDSGNTGYAQKFQG

SEQ ID NO: 13077 - DNA, 48 bp, Artificial Sequence; identical to SEQ ID NO: 12203
  Description of Artificial Sequence: Synthetic oligonucleotide

SEQ ID NO: 13078 - protein, 16 aa, Artificial Sequence
  Description of Artificial Sequence: Synthetic peptide
LIYWNDDKRYSPSLKS

SEQ ID NO: 13079 - DNA, 51 bp, Artificial Sequence; identical to SEQ ID NO: 12701
  Description of Artificial Sequence: Synthetic oligonucleotide

SEQ ID NO: 13080 - protein, 17 aa, Artificial Sequence
  Description of Artificial Sequence: Synthetic peptide
SISGSSTYIYYADSVKG

SEQ ID NO: 13081 - DNA, 51 bp, Artificial Sequence
  Description of Artificial Sequence: Synthetic oligonucleotide
tggatcaaccctaacaataatggcacaaactatgcacagaagtttcagggc

SEQ ID NO: 13082 - protein, 17 aa, Artificial Sequence
  Description of Artificial Sequence: Synthetic peptide
WINPNNNGTNYAQKFQG

SEQ ID NO: 13083 - DNA, 48 bp, Artificial Sequence
  Description of Artificial Sequence: Synthetic oligonucleotide
ctcatttattggaataatgataaggtctacagcccatctctgaagagc

SEQ ID NO: 13084 - protein, 16 aa, Artificial Sequence
  Description of Artificial Sequence: Synthetic peptide
LIYWNNDKVYSPSLKS

SEQ ID NO: 13085 - DNA, 51 bp, Artificial Sequence
  Description of Artificial Sequence: Synthetic oligonucleotide
tggatgtaccctaacagtggtaacacgggctatgcacagaagttccagggc

SEQ ID NO: 13086 - protein, 17 aa, Artificial Sequence
  Description of Artificial Sequence: Synthetic peptide
WMYPNSGNTGYAQKFQG

SEQ ID NO: 13087 - DNA, 51 bp, Artificial Sequence
  Description of Artificial Sequence: Synthetic oligonucleotide
gctattagtggtcgtggtggtagcacatactacgcagactccgtgaagggc

SEQ ID NO: 13088 - protein, 17 aa, Artificial Sequence
  Description of Artificial Sequence: Synthetic peptide
AISGRGGSTYYADSVKG

SEQ ID NO: 13089 - DNA, 51 bp, Artificial Sequence; identical to SEQ ID NO: 12161
  Description of Artificial Sequence: Synthetic oligonucleotide

SEQ ID NO: 13090 - protein, 17 aa, Artificial Sequence
  Description of Artificial Sequence: Synthetic peptide
WMHPNSGNTGYAQKFQG

SEQ ID NO: 13091 - DNA, 51 bp, Artificial Sequence; identical to SEQ ID NO: 12103
  Description of Artificial Sequence: Synthetic oligonucleotide

SEQ ID NO: 13092 - protein, 17 aa, Artificial Sequence
  Description of Artificial Sequence: Synthetic peptide
WMNPNSGNTGYAQKFQG

SEQ ID NO: 13093 - DNA, 51 bp, Artificial Sequence
  Description of Artificial Sequence: Synthetic oligonucleotide
tggatgcaccctaacagtggtaacacaggctgtgcacagaagttccagggc

SEQ ID NO: 13094 - protein, 17 aa, Artificial Sequence
  Description of Artificial Sequence: Synthetic peptide
WMHPNSGNTGCAQKFQG

SEQ ID NO: 13095 - DNA, 51 bp, Artificial Sequence; identical to SEQ ID NO: 12643
  Description of Artificial Sequence: Synthetic oligonucleotide

SEQ ID NO: 13096 - protein, 17 aa, Artificial Sequence
  Description of Artificial Sequence: Synthetic peptide
WISPKNGGTNYAQKFQG

SEQ ID NO: 13097 - DNA, 51 bp, Artificial Sequence; identical to SEQ ID NO: 12103
  Description of Artificial Sequence: Synthetic oligonucleotide

SEQ ID NO: 13098 - protein, 17 aa, Artificial Sequence
  Description of Artificial Sequence: Synthetic peptide
WMNPNSGNTGYAQKFQG

SEQ ID NO: 13099 - DNA, 51 bp, Artificial Sequence; identical to SEQ ID NO: 12647
  Description of Artificial Sequence: Synthetic oligonucleotide

SEQ ID NO: 13100 - protein, 17 aa, Artificial Sequence
  Description of Artificial Sequence: Synthetic peptide
WMHPNSGNTGFAQKFRG

SEQ ID NO: 13101 - DNA, 51 bp, Artificial Sequence; identical to SEQ ID NO: 12701
  Description of Artificial Sequence: Synthetic oligonucleotide

SEQ ID NO: 13102 - protein, 17 aa, Artificial Sequence
  Description of Artificial Sequence: Synthetic peptide
SISGSSTYIYYADSVKG

SEQ ID NO: 13103 - DNA, 51 bp, Artificial Sequence; identical to SEQ ID NO: 12531
  Description of Artificial Sequence: Synthetic oligonucleotide

SEQ ID NO: 13104 - protein, 17 aa, Artificial Sequence
  Description of Artificial Sequence: Synthetic peptide
AISGRGGSTFHADSVKG

SEQ ID NO: 13105 - DNA, 51 bp, Artificial Sequence; identical to SEQ ID NO: 12103
  Description of Artificial Sequence: Synthetic oligonucleotide

SEQ ID NO: 13106 - protein, 17 aa, Artificial Sequence
  Description of Artificial Sequence: Synthetic peptide
WMNPNSGNTGYAQKFQG

SEQ ID NO: 13107 - DNA, 51 bp, Artificial Sequence; identical to SEQ ID NO: 12153
  Description of Artificial Sequence: Synthetic oligonucleotide

SEQ ID NO: 13108 - protein, 17 aa, Artificial Sequence
  Description of Artificial Sequence: Synthetic peptide
SISGSSSYIYYADSVKG

SEQ ID NO: 13109 - DNA, 51 bp, Artificial Sequence; identical to SEQ ID NO: 12531
  Description of Artificial Sequence: Synthetic oligonucleotide

SEQ ID NO: 13110 - protein, 17 aa, Artificial Sequence
  Description of Artificial Sequence: Synthetic peptide
AISGRGGSTFHADSVKG

SEQ ID NO: 13111 - DNA, 51 bp, Artificial Sequence; identical to SEQ ID NO: 12103
  Description of Artificial Sequence: Synthetic oligonucleotide

SEQ ID NO: 13112 - protein, 17 aa, Artificial Sequence
  Description of Artificial Sequence: Synthetic peptide
WMNPNSGNTGYAQKFQG

SEQ ID NO: 13113 - DNA, 51 bp, Artificial Sequence; identical to SEQ ID NO: 12103
  Description of Artificial Sequence: Synthetic oligonucleotide

SEQ ID NO: 13114 - protein, 17 aa, Artificial Sequence
  Description of Artificial Sequence: Synthetic peptide
WMNPNSGNTGYAQKFQG

SEQ ID NO: 13115 - DNA, 51 bp, Artificial Sequence
  Description of Artificial Sequence: Synthetic oligonucleotide
actattagtggtcgtggtggtagcacattccacgcagactccgtgaagggc

SEQ ID NO: 13116 - protein, 17 aa, Artificial Sequence
  Description of Artificial Sequence: Synthetic peptide
TISGRGGSTFHADSVKG

SEQ ID NO: 13117 - DNA, 57 bp, Artificial Sequence; identical to SEQ ID NO: 12475
  Description of Artificial Sequence: Synthetic oligonucleotide

SEQ ID NO: 13118 - protein, 19 aa, Artificial Sequence
  Description of Artificial Sequence: Synthetic peptide
RIKSKTDGGTTDYAAPVKG

SEQ ID NO: 13119 - DNA, 48 bp, Artificial Sequence
  Description of Artificial Sequence: Synthetic oligonucleotide
ctcatttattggagtgatgataagcgctacagcccatctctgaagagc

SEQ ID NO: 13120 - protein, 16 aa, Artificial Sequence
  Description of Artificial Sequence: Synthetic peptide
LIYWSDDKRYSPSLKS

SEQ ID NO: 13121 - DNA, 51 bp, Artificial Sequence; identical to SEQ ID NO: 12391
  Description of Artificial Sequence: Synthetic oligonucleotide

SEQ ID NO: 13122 - protein, 17 aa, Artificial Sequence
  Description of Artificial Sequence: Synthetic peptide
VIWYDENNKYYVDSVKG

SEQ ID NO: 13123 - DNA, 51 bp, Artificial Sequence; identical to SEQ ID NO: 13059
  Description of Artificial Sequence: Synthetic oligonucleotide

SEQ ID NO: 13124 - protein, 17 aa, Artificial Sequence
  Description of Artificial Sequence: Synthetic peptide
SISGSSSYMYYADSVKG

SEQ ID NO: 13125 - DNA, 51 bp, Artificial Sequence; identical to SEQ ID NO: 12645
  Description of Artificial Sequence: Synthetic oligonucleotide

SEQ ID NO: 13126 - protein, 17 aa, Artificial Sequence
  Description of Artificial Sequence: Synthetic peptide
WINPNRGGTNYAQKFQD

SEQ ID NO: 13127 - DNA, 51 bp, Artificial Sequence; identical to SEQ ID NO: 12361
  Description of Artificial Sequence: Synthetic oligonucleotide

SEQ ID NO: 13128 - protein, 17 aa, Artificial Sequence
  Description of Artificial Sequence: Synthetic peptide
SISSSSSYIYYADSVKG

SEQ ID NO: 13129 - DNA, 51 bp, Artificial Sequence; identical to SEQ ID NO: 12153
  Description of Artificial Sequence: Synthetic oligonucleotide

SEQ ID NO: 13130 - protein, 17 aa, Artificial Sequence
  Description of Artificial Sequence: Synthetic peptide
SISGSSSYIYYADSVKG

SEQ ID NO: 13131 - DNA, 57 bp, Artificial Sequence; identical to SEQ ID NO: 12475
  Description of Artificial Sequence: Synthetic oligonucleotide

SEQ ID NO: 13132 - protein, 19 aa, Artificial Sequence
  Description of Artificial Sequence: Synthetic peptide
RIKSKTDGGTTDYAAPVKG

SEQ ID NO: 13133 - DNA, 51 bp, Artificial Sequence
  Description of Artificial Sequence: Synthetic oligonucleotide
tccattagtggtggtgccggtcacatatattactcagactcagtgaagggc

SEQ ID NO: 13134 - protein, 17 aa, Artificial Sequence
  Description of Artificial Sequence: Synthetic peptide
SISGGAGHIYYSDSVKG

SEQ ID NO: 13135 - DNA, 48 bp, Artificial Sequence
  Description of Artificial Sequence: Synthetic oligonucleotide
tccattagtactagtactttcatatactacgcagattcagtgaagggc

SEQ ID NO: 13136 - protein, 16 aa, Artificial Sequence
  Description of Artificial Sequence: Synthetic peptide
SISTSTFIYYADSVKG

SEQ ID NO: 13137 - DNA, 51 bp, Artificial Sequence
  Description of Artificial Sequence: Synthetic oligonucleotide
tccattagtggtaatagtggttacatatactacgcagactcagtgaagggc

SEQ ID NO: 13138 - protein, 17 aa, Artificial Sequence
  Description of Artificial Sequence: Synthetic peptide
SISGNSGYIYYADSVKG

SEQ ID NO: 13139 - DNA, 48 bp, Artificial Sequence; identical to SEQ ID NO: 12405
  Description of Artificial Sequence: Synthetic oligonucleotide

SEQ ID NO: 13140 - protein, 16 aa, Artificial Sequence
  Description of Artificial Sequence: Synthetic peptide
SIYYSGSANYNPSLKS

SEQ ID NO: 13141 - DNA, 51 bp, Artificial Sequence
  Description of Artificial Sequence: Synthetic oligonucleotide
gttattagtgggcgtggtggtagcacatactacgcagactccgtgaagggc

SEQ ID NO: 13142 - protein, 17 aa, Artificial Sequence
  Description of Artificial Sequence: Synthetic peptide
VISGRGGSTYYADSVKG

SEQ ID NO: 13143 - DNA, 48 bp, Artificial Sequence
  Description of Artificial Sequence: Synthetic oligonucleotide
aatatttattatagtgggagcgcctacaacaacccgtccctcaagagt

SEQ ID NO: 13144 - protein, 16 aa, Artificial Sequence
  Description of Artificial Sequence: Synthetic peptide
NIYYSGSAYNNPSLKS

SEQ ID NO: 13145 - DNA, 51 bp, Artificial Sequence; identical to SEQ ID NO: 12361
  Description of Artificial Sequence: Synthetic oligonucleotide

SEQ ID NO: 13146 - protein, 17 aa, Artificial Sequence
  Description of Artificial Sequence: Synthetic peptide
SISSSSSYIYYADSVKG

SEQ ID NO: 13147 - DNA, 51 bp, Artificial Sequence; identical to SEQ ID NO: 12161
  Description of Artificial Sequence: Synthetic oligonucleotide

SEQ ID NO: 13148 - protein, 17 aa, Artificial Sequence
  Description of Artificial Sequence: Synthetic peptide
WMHPNSGNTGYAQKFQG

SEQ ID NO: 13149 - DNA, 51 bp, Artificial Sequence; identical to SEQ ID NO: 12161
  Description of Artificial Sequence: Synthetic oligonucleotide

SEQ ID NO: 13150 - protein, 17 aa, Artificial Sequence
  Description of Artificial Sequence: Synthetic peptide
WMHPNSGNTGYAQKFQG

SEQ ID NO: 13151 - DNA, 51 bp, Artificial Sequence; identical to SEQ ID NO: 13051
  Description of Artificial Sequence: Synthetic oligonucleotide

SEQ ID NO: 13152 - protein, 17 aa, Artificial Sequence
  Description of Artificial Sequence: Synthetic peptide
WINPNSGGTNYVQKFQG

SEQ ID NO: 13153 - DNA, 51 bp, Artificial Sequence; identical to SEQ ID NO: 13051
  Description of Artificial Sequence: Synthetic oligonucleotide

SEQ ID NO: 13154 - protein, 17 aa, Artificial Sequence
  Description of Artificial Sequence: Synthetic peptide
WINPNSGGTNYVQKFQG

SEQ ID NO: 13155 - DNA, 51 bp, Artificial Sequence
  Description of Artificial Sequence: Synthetic oligonucleotide
tggatgcaccctaacagtggtaacacaggctatgcaaagaagttccagggc

SEQ ID NO: 13156 - protein, 17 aa, Artificial Sequence
  Description of Artificial Sequence: Synthetic peptide
WMHPNSGNTGYAKKFQG

SEQ ID NO: 13157 - DNA, 51 bp, Artificial Sequence; identical to SEQ ID NO: 12499
  Description of Artificial Sequence: Synthetic oligonucleotide

SEQ ID NO: 13158 - protein, 17 aa, Artificial Sequence
  Description of Artificial Sequence: Synthetic peptide
WMYPNSGNTGYAQKFQG

SEQ ID NO: 13159 - DNA, 51 bp, Artificial Sequence
  Description of Artificial Sequence: Synthetic oligonucleotide
attatctggcatgatggaagtaataaatactatgcagactccgtgaagggc

SEQ ID NO: 13160 - protein, 17 aa, Artificial Sequence
  Description of Artificial Sequence: Synthetic peptide
IIWHDGSNKYYADSVKG

SEQ ID NO: 13161 - DNA, 51 bp, Artificial Sequence; identical to SEQ ID NO: 13081
  Description of Artificial Sequence: Synthetic oligonucleotide

SEQ ID NO: 13162 - protein, 17 aa, Artificial Sequence
  Description of Artificial Sequence: Synthetic peptide
WINPNNNGTNYAQKFQG

SEQ ID NO: 13163 - DNA, 51 bp, Artificial Sequence
  Description of Artificial Sequence: Synthetic oligonucleotide
tgggtccaccctaacagtggtggcacaaactttgcacagaagtttcaggac

SEQ ID NO: 13164 - protein, 17 aa, Artificial Sequence
  Description of Artificial Sequence: Synthetic peptide
WVHPNSGGTNFAQKFQD

SEQ ID NO: 13165 - DNA, 51 bp, Artificial Sequence; identical to SEQ ID NO: 13085
  Description of Artificial Sequence: Synthetic oligonucleotide

SEQ ID NO: 13166 - protein, 17 aa, Artificial Sequence
  Description of Artificial Sequence: Synthetic peptide
WMYPNSGNTGYAQKFQG

SEQ ID NO: 13167 - DNA, 51 bp, Artificial Sequence; identical to SEQ ID NO: 12167
  Description of Artificial Sequence: Synthetic oligonucleotide

SEQ ID NO: 13168 - protein, 17 aa, Artificial Sequence
  Description of Artificial Sequence: Synthetic peptide
VIWYDGSNKYYADSVKG

SEQ ID NO: 13169 - DNA, 51 bp, Artificial Sequence; identical to SEQ ID NO: 12123
  Description of Artificial Sequence: Synthetic oligonucleotide

SEQ ID NO: 13170 - protein, 17 aa, Artificial Sequence
  Description of Artificial Sequence: Synthetic peptide
VIWYDGSNKYYADSVKG

SEQ ID NO: 13171 - DNA, 51 bp, Artificial Sequence; identical to SEQ ID NO: 12123
  Description of Artificial Sequence: Synthetic oligonucleotide

SEQ ID NO: 13172 - protein, 17 aa, Artificial Sequence
  Description of Artificial Sequence: Synthetic peptide
VIWYDGSNKYYADSVKG

SEQ ID NO: 13173 - DNA, 51 bp, Artificial Sequence
  Description of Artificial Sequence: Synthetic oligonucleotide
gttatatggcatgatggaagtaatgcatactatgcagactccgtgaagggc

SEQ ID NO: 13174 - protein, 17 aa, Artificial Sequence
  Description of Artificial Sequence: Synthetic peptide
VIWHDGSNAYYADSVKG

SEQ ID NO: 13175 - DNA, 51 bp, Artificial Sequence; identical to SEQ ID NO: 13155
  Description of Artificial Sequence: Synthetic oligonucleotide

SEQ ID NO: 13176 - protein, 17 aa, Artificial Sequence
  Description of Artificial Sequence: Synthetic peptide
WMHPNSGNTGYAKKFQG

SEQ ID NO: 13177 - DNA, 51 bp, Artificial Sequence
  Description of Artificial Sequence: Synthetic oligonucleotide
gccattagtggtaatagtacttacatatactacgcagactcgttgaagggc

SEQ ID NO: 13178 - protein, 17 aa, Artificial Sequence
  Description of Artificial Sequence: Synthetic peptide
AISGNSTYIYYADSLKG

SEQ ID NO: 13179 - DNA, 51 bp, Artificial Sequence
  Description of Artificial Sequence: Synthetic oligonucleotide
gctattagtggtcgtggtgttaacacattcgacgcagactccgtgaagggc

SEQ ID NO: 13180 - protein, 17 aa, Artificial Sequence
  Description of Artificial Sequence: Synthetic peptide
AISGRGVNTFDADSVKG

SEQ ID NO: 13181 - DNA, 51 bp, Artificial Sequence; identical to SEQ ID NO: 12491
  Description of Artificial Sequence: Synthetic oligonucleotide

SEQ ID NO: 13182 - protein, 17 aa, Artificial Sequence
  Description of Artificial Sequence: Synthetic peptide
VIWYDENNKYYADSVKG

SEQ ID NO: 13183 - DNA, 51 bp, Artificial Sequence
  Description of Artificial Sequence: Synthetic oligonucleotide
tccattagtggaagtagtacttacatatactacgcagactcagtgaagggc

SEQ ID NO: 13184 - protein, 17 aa, Artificial Sequence
  Description of Artificial Sequence: Synthetic peptide
SISGSSTYIYYADSVKG

SEQ ID NO: 13185 - DNA, 51 bp, Artificial Sequence
  Description of Artificial Sequence: Synthetic oligonucleotide
gctattagtggtcgtggtattaacacattcgacgcagactccgtgaagggc

SEQ ID NO: 13186 - protein, 17 aa, Artificial Sequence
  Description of Artificial Sequence: Synthetic peptide
AISGRGINTFDADSVKG

SEQ ID NO: 13187 - DNA, 51 bp, Artificial Sequence
  Description of Artificial Sequence: Synthetic oligonucleotide
tacattagtagtagtggtattaccaaatactacgcagactctatgaagggc

SEQ ID NO: 13188 - protein, 17 aa, Artificial Sequence
  Description of Artificial Sequence: Synthetic peptide
YISSSGITKYYADSMKG

SEQ ID NO: 13189 - DNA, 51 bp, Artificial Sequence; identical to SEQ ID NO: 12161
  Description of Artificial Sequence: Synthetic oligonucleotide

SEQ ID NO: 13190 - protein, 17 aa, Artificial Sequence
  Description of Artificial Sequence: Synthetic peptide
WMHPNSGNTGYAQKFQG

SEQ ID NO: 13191 - DNA, 51 bp, Artificial Sequence; identical to SEQ ID NO: 13185
  Description of Artificial Sequence: Synthetic oligonucleotide

SEQ ID NO: 13192 - protein, 17 aa, Artificial Sequence
  Description of Artificial Sequence: Synthetic peptide
AISGRGINTFDADSVKG

SEQ ID NO: 13193 - DNA, 51 bp, Artificial Sequence
  Description of Artificial Sequence: Synthetic oligonucleotide
tacattagtagtagtggtagaaccatattctacgcagactctttgaagggc

SEQ ID NO: 13194 - protein, 17 aa, Artificial Sequence
  Description of Artificial Sequence: Synthetic peptide
YISSSGRTIFYADSLKG

SEQ ID NO: 13195 - DNA, 51 bp, Artificial Sequence
  Description of Artificial Sequence: Synthetic oligonucleotide
gctattagtggtagtggtagtaacacattctacgcagactccgtgaagggc

SEQ ID NO: 13196 - protein, 17 aa, Artificial Sequence
  Description of Artificial Sequence: Synthetic peptide
AISGSGSNTFYADSVKG

SEQ ID NO: 13197 - DNA, 51 bp, Artificial Sequence; identical to SEQ ID NO: 12123
  Description of Artificial Sequence: Synthetic oligonucleotide

SEQ ID NO: 13198 - protein, 17 aa, Artificial Sequence
  Description of Artificial Sequence: Synthetic peptide
VIWYDGSNKYYADSVKG

SEQ ID NO: 13199 - DNA, 51 bp, Artificial Sequence; identical to SEQ ID NO: 12123
  Description of Artificial Sequence: Synthetic oligonucleotide

SEQ ID NO: 13200 - protein, 17 aa, Artificial Sequence
  Description of Artificial Sequence: Synthetic peptide
VIWYDGSNKYYADSVKG

SEQ ID NO: 13201 - DNA, 51 bp, Artificial Sequence
  Description of Artificial Sequence: Synthetic oligonucleotide
gttatatggtttgaaggaagtaataaatactatgcagattccgtgaagggc

SEQ ID NO: 13202 - protein, 17 aa, Artificial Sequence
  Description of Artificial Sequence: Synthetic peptide
VIWFEGSNKYYADSVKG

SEQ ID NO: 13203 - DNA, 51 bp, Artificial Sequence
  Description of Artificial Sequence: Synthetic oligonucleotide
gttatatggtatgatggaagtaataaatactatgctgactccgtgaagggc

SEQ ID NO: 13204 - protein, 17 aa, Artificial Sequence
  Description of Artificial Sequence: Synthetic peptide
VIWYDGSNKYYADSVKG

SEQ ID NO: 13205 - DNA, 51 bp, Artificial Sequence
  Description of Artificial Sequence: Synthetic oligonucleotide
attctcagtggtggtggtaagaccacatactacgcagactccgtgaagggc

SEQ ID NO: 13206 - protein, 17 aa, Artificial Sequence
  Description of Artificial Sequence: Synthetic peptide
ILSGGGKTTYYADSVKG

SEQ ID NO: 13207 - DNA, 51 bp, Artificial Sequence; identical to SEQ ID NO: 12123
  Description of Artificial Sequence: Synthetic oligonucleotide

SEQ ID NO: 13208 - protein, 17 aa, Artificial Sequence
  Description of Artificial Sequence: Synthetic peptide
VIWYDGSNKYYADSVKG

SEQ ID NO: 13209 - DNA, 48 bp, Artificial Sequence
  Description of Artificial Sequence: Synthetic oligonucleotide
tatatctattacagtggaaacaccaactacaacccctccctcaagagt

SEQ ID NO: 13210 - protein, 16 aa, Artificial Sequence
  Description of Artificial Sequence: Synthetic peptide
YIYYSGNTNYNPSLKS

SEQ ID NO: 13211 - DNA, 51 bp, Artificial Sequence
  Description of Artificial Sequence: Synthetic oligonucleotide
gttatatggtatgaaggaagtaataaatactatgcagactccgtgaagggc

SEQ ID NO: 13212 - protein, 17 aa, Artificial Sequence
  Description of Artificial Sequence: Synthetic peptide
VIWYEGSNKYYADSVKG

SEQ ID NO: 13213 - DNA, 51 bp, Artificial Sequence; identical to SEQ ID NO: 12123
  Description of Artificial Sequence: Synthetic oligonucleotide

SEQ ID NO: 13214 - protein, 17 aa, Artificial Sequence
  Description of Artificial Sequence: Synthetic peptide
VIWYDGSNKYYADSVKG

SEQ ID NO: 13215 - DNA, 51 bp, Artificial Sequence; identical to SEQ ID NO: 12123
  Description of Artificial Sequence: Synthetic oligonucleotide

SEQ ID NO: 13216 - protein, 17 aa, Artificial Sequence
  Description of Artificial Sequence: Synthetic peptide
VIWYDGSNKYYADSVKG

SEQ ID NO: 13217 - DNA, 51 bp, Artificial Sequence; identical to SEQ ID NO: 13203
  Description of Artificial Sequence: Synthetic oligonucleotide

SEQ ID NO: 13218 - protein, 17 aa, Artificial Sequence
  Description of Artificial Sequence: Synthetic peptide
VIWYDGSNKYYADSVKG

SEQ ID NO: 13219 - DNA, 51 bp, Artificial Sequence; identical to SEQ ID NO: 13179
  Description of Artificial Sequence: Synthetic oligonucleotide

SEQ ID NO: 13220 - protein, 17 aa, Artificial Sequence
  Description of Artificial Sequence: Synthetic peptide
AISGRGVNTFDADSVKG

SEQ ID NO: 13221 - DNA, 51 bp, Artificial Sequence
  Description of Artificial Sequence: Synthetic oligonucleotide
ggtgttgttggtagtggtggtagaacatactacgcagactccgtgaagggc

SEQ ID NO: 13222 - protein, 17 aa, Artificial Sequence
  Description of Artificial Sequence: Synthetic peptide
GVVGSGGRTYYADSVKG

SEQ ID NO: 13223 - DNA, 51 bp, Artificial Sequence; identical to SEQ ID NO: 12949
  Description of Artificial Sequence: Synthetic oligonucleotide

SEQ ID NO: 13224 - protein, 17 aa, Artificial Sequence
  Description of Artificial Sequence: Synthetic peptide
YISSSSSTIYYADSVKG

SEQ ID NO: 13225 - DNA, 51 bp, Artificial Sequence
  Description of Artificial Sequence: Synthetic oligonucleotide
gttatatggtttgatgaatataataaatactatgcagactccgtgaagggc

SEQ ID NO: 13226 - protein, 17 aa, Artificial Sequence
  Description of Artificial Sequence: Synthetic peptide
VIWFDEYNKYYADSVKG

SEQ ID NO: 13227 - DNA, 51 bp, Artificial Sequence
  Description of Artificial Sequence: Synthetic oligonucleotide
tacattagtagtagtggtattaccaaatactacgcagactctgtgaagggc

SEQ ID NO: 13228 - protein, 17 aa, Artificial Sequence
  Description of Artificial Sequence: Synthetic peptide
YISSSGITKYYADSVKG

SEQ ID NO: 13229 - DNA, 51 bp, Artificial Sequence; identical to SEQ ID NO: 13203
  Description of Artificial Sequence: Synthetic oligonucleotide

SEQ ID NO: 13230 - protein, 17 aa, Artificial Sequence
  Description of Artificial Sequence: Synthetic peptide
VIWYDGSNKYYADSVKG

SEQ ID NO: 13231 - DNA, 51 bp, Artificial Sequence; identical to SEQ ID NO: 13195
  Description of Artificial Sequence: Synthetic oligonucleotide

SEQ ID NO: 13232 - protein, 17 aa, Artificial Sequence
  Description of Artificial Sequence: Synthetic peptide
AISGSGSNTFYADSVKG

SEQ ID NO: 13233 - DNA, 51 bp, Artificial Sequence; identical to SEQ ID NO: 13203
  Description of Artificial Sequence: Synthetic oligonucleotide

SEQ ID NO: 13234 - protein, 17 aa, Artificial Sequence
  Description of Artificial Sequence: Synthetic peptide
VIWYDGSNKYYADSVKG

SEQ ID NO: 13235 - DNA, 51 bp, Artificial Sequence; identical to SEQ ID NO: 13179
  Description of Artificial Sequence: Synthetic oligonucleotide

SEQ ID NO: 13236 - protein, 17 aa, Artificial Sequence
  Description of Artificial Sequence: Synthetic peptide
AISGRGVNTFDADSVKG

SEQ ID NO: 13237 - DNA, 51 bp, Artificial Sequence
  Description of Artificial Sequence: Synthetic oligonucleotide
gttattagtggtcgtggtggtaccacatactacgcagactccgtgaagggc

SEQ ID NO: 13238 - protein, 17 aa, Artificial Sequence
  Description of Artificial Sequence: Synthetic peptide
VISGRGGTTYYADSVKG

SEQ ID NO: 13239 - DNA, 51 bp, Artificial Sequence; identical to SEQ ID NO: 13183
  Description of Artificial Sequence: Synthetic oligonucleotide

SEQ ID NO: 13240 - protein, 17 aa, Artificial Sequence
  Description of Artificial Sequence: Synthetic peptide
SISGSSTYIYYADSVKG

SEQ ID NO: 13241 - DNA, 51 bp, Artificial Sequence
  Description of Artificial Sequence: Synthetic oligonucleotide
gttatatggtttgatgaatatactaaatactatgcagactccgtgaagggc

SEQ ID NO: 13242 - protein, 17 aa, Artificial Sequence
  Description of Artificial Sequence: Synthetic peptide
VIWFDEYTKYYADSVKG

SEQ ID NO: 13243 - DNA, 51 bp, Artificial Sequence
  Description of Artificial Sequence: Synthetic oligonucleotide
attatatggtatgatggaagtaataaatactatgtagactccgtgaagggc

SEQ ID NO: 13244 - protein, 17 aa, Artificial Sequence
  Description of Artificial Sequence: Synthetic peptide
IIWYDGSNKYYVDSVKG

SEQ ID NO: 13245 - DNA, 51 bp, Artificial Sequence; identical to SEQ ID NO: 13203
  Description of Artificial Sequence: Synthetic oligonucleotide

SEQ ID NO: 13246 - protein, 17 aa, Artificial Sequence
  Description of Artificial Sequence: Synthetic peptide
VIWYDGSNKYYADSVKG

SEQ ID NO: 13247 - DNA, 51 bp, Artificial Sequence; identical to SEQ ID NO: 13201
  Description of Artificial Sequence: Synthetic oligonucleotide

SEQ ID NO: 13248 - protein, 17 aa, Artificial Sequence
  Description of Artificial Sequence: Synthetic peptide
VIWFEGSNKYYADSVKG

SEQ ID NO: 13249 - DNA, 51 bp, Artificial Sequence; identical to SEQ ID NO: 12123
  Description of Artificial Sequence: Synthetic oligonucleotide

SEQ ID NO: 13250 - protein, 17 aa, Artificial Sequence
  Description of Artificial Sequence: Synthetic peptide
VIWYDGSNKYYADSVKG

SEQ ID NO: 13251 - DNA, 51 bp, Artificial Sequence; identical to SEQ ID NO: 13185
  Description of Artificial Sequence: Synthetic oligonucleotide

SEQ ID NO: 13252 - protein, 17 aa, Artificial Sequence
  Description of Artificial Sequence: Synthetic peptide
AISGRGINTFDADSVKG

SEQ ID NO: 13253 - DNA, 51 bp, Artificial Sequence; identical to SEQ ID NO: 12491
  Description of Artificial Sequence: Synthetic oligonucleotide

SEQ ID NO: 13254 - protein, 17 aa, Artificial Sequence
  Description of Artificial Sequence: Synthetic peptide
VIWYDENNKYYADSVKG

SEQ ID NO: 13255 - DNA, 51 bp, Artificial Sequence; identical to SEQ ID NO: 13201
  Description of Artificial Sequence: Synthetic oligonucleotide

SEQ ID NO: 13256 - protein, 17 aa, Artificial Sequence
  Description of Artificial Sequence: Synthetic peptide
VIWFEGSNKYYADSVKG

SEQ ID NO: 13257 - DNA, 51 bp, Artificial Sequence
  Description of Artificial Sequence: Synthetic oligonucleotide
gttatatggtatgatggaagaaataaatactatgcagactccgtgaagggc

SEQ ID NO: 13258 - protein, 17 aa, Artificial Sequence
  Description of Artificial Sequence: Synthetic peptide
VIWYDGRNKYYADSVKG

SEQ ID NO: 13259 - DNA, 51 bp, Artificial Sequence
  Description of Artificial Sequence: Synthetic oligonucleotide
tacattaatagtaatggttttaccatatactacgcagactctgtgaagggc

SEQ ID NO: 13260 - protein, 17 aa, Artificial Sequence
  Description of Artificial Sequence: Synthetic peptide
YINSNGFTIYYADSVKG

SEQ ID NO: 13261 - DNA, 51 bp, Artificial Sequence
  Description of Artificial Sequence: Synthetic oligonucleotide
gttatatggtatgatgactataataaaaagtatgcagactccgtgaagggc

SEQ ID NO: 13262 - protein, 17 aa, Artificial Sequence
  Description of Artificial Sequence: Synthetic peptide
VIWYDDYNKKYADSVKG

SEQ ID NO: 13263 - DNA, 51 bp, Artificial Sequence; identical to SEQ ID NO: 12123
  Description of Artificial Sequence: Synthetic oligonucleotide

SEQ ID NO: 13264 - protein, 17 aa, Artificial Sequence
  Description of Artificial Sequence: Synthetic peptide
VIWYDGSNKYYADSVKG

SEQ ID NO: 13265 - DNA, 51 bp, Artificial Sequence; identical to SEQ ID NO: 12227
  Description of Artificial Sequence: Synthetic oligonucleotide

SEQ ID NO: 13266 - protein, 17 aa, Artificial Sequence
  Description of Artificial Sequence: Synthetic peptide
VIWFDGSNKYYADSVKG

SEQ ID NO: 13267 - DNA, 51 bp, Artificial Sequence
  Description of Artificial Sequence: Synthetic oligonucleotide
ggtattagtggtagtggtagtcgcacatactacgcagactccgtgaagggc

SEQ ID NO: 13268 - protein, 17 aa, Artificial Sequence
  Description of Artificial Sequence: Synthetic peptide
GISGSGSRTYYADSVKG

SEQ ID NO: 13269 - DNA, 51 bp, Artificial Sequence; identical to SEQ ID NO: 12123
  Description of Artificial Sequence: Synthetic oligonucleotide

SEQ ID NO: 13270 - protein, 17 aa, Artificial Sequence
  Description of Artificial Sequence: Synthetic peptide
VIWYDGSNKYYADSVKG

SEQ ID NO: 13271 - DNA, 51 bp, Artificial Sequence
  Description of Artificial Sequence: Synthetic oligonucleotide
gctattagtggtcgtggtggtaacacattctacgcagagtccgtgaggggc

SEQ ID NO: 13272 - protein, 17 aa, Artificial Sequence
  Description of Artificial Sequence: Synthetic peptide
AISGRGGNTFYAESVRG

SEQ ID NO: 13273 - DNA, 51 bp, Artificial Sequence
  Description of Artificial Sequence: Synthetic oligonucleotide
tacattaatagtaatggttttaccaaatactacgcagactctgtgaagggc

SEQ ID NO: 13274 - protein, 17 aa, Artificial Sequence
  Description of Artificial Sequence: Synthetic peptide
YINSNGFTKYYADSVKG

SEQ ID NO: 13275 - DNA, 51 bp, Artificial Sequence
  Description of Artificial Sequence: Synthetic oligonucleotide
gttgtatggtatgatgaaattaataaaaagtatgcagactccgtgaagggc

SEQ ID NO: 13276 - protein, 17 aa, Artificial Sequence
  Description of Artificial Sequence: Synthetic peptide
VVWYDEINKKYADSVKG

SEQ ID NO: 13277 - DNA, 51 bp, Artificial Sequence
  Description of Artificial Sequence: Synthetic oligonucleotide
gttattagtggtcgtggtggtagcacattctacgcagactccgtgaagggc

SEQ ID NO: 13278 - protein, 17 aa, Artificial Sequence
  Description of Artificial Sequence: Synthetic peptide
VISGRGGSTFYADSVKG

SEQ ID NO: 13279 - DNA, 51 bp, Artificial Sequence; identical to SEQ ID NO: 12123
  Description of Artificial Sequence: Synthetic oligonucleotide

SEQ ID NO: 13280 - protein, 17 aa, Artificial Sequence
  Description of Artificial Sequence: Synthetic peptide
VIWYDGSNKYYADSVKG

SEQ ID NO: 13281 - DNA, 51 bp, Artificial Sequence; identical to SEQ ID NO: 13277
  Description of Artificial Sequence: Synthetic oligonucleotide

SEQ ID NO: 13282 - protein, 17 aa, Artificial Sequence
  Description of Artificial Sequence: Synthetic peptide
VISGRGGSTFYADSVKG

SEQ ID NO: 13283 - DNA, 51 bp, Artificial Sequence
  Description of Artificial Sequence: Synthetic oligonucleotide
gctattagtggtagtggtggtaccacattctacgcagactccgtgaagggc

SEQ ID NO: 13284 - protein, 17 aa, Artificial Sequence
  Description of Artificial Sequence: Synthetic peptide
AISGSGGTTFYADSVKG

SEQ ID NO: 13285 - DNA, 51 bp, Artificial Sequence
  Description of Artificial Sequence: Synthetic oligonucleotide
gttatatggtatgaggaaaataagaaatactatgcagactccgtgaagggc

SEQ ID NO: 13286 - protein, 17 aa, Artificial Sequence
  Description of Artificial Sequence: Synthetic peptide
VIWYEENKKYYADSVKG

SEQ ID NO: 13287 - DNA, 51 bp, Artificial Sequence
  Description of Artificial Sequence: Synthetic oligonucleotide
tacattagtagtgctggtggtgccatatactacgcagactctgtgaagggc

SEQ ID NO: 13288 - protein, 17 aa, Artificial Sequence
  Description of Artificial Sequence: Synthetic peptide
YISSAGGAIYYADSVKG

SEQ ID NO: 13289 - DNA, 51 bp, Artificial Sequence
  Description of Artificial Sequence: Synthetic oligonucleotide
gttatatggtatgatgtaagtaataaatactatgtagactccgtgaagggc

SEQ ID NO: 13290 - protein, 17 aa, Artificial Sequence
  Description of Artificial Sequence: Synthetic peptide
VIWYDVSNKYYVDSVKG

SEQ ID NO: 13291 - DNA, 51 bp, Artificial Sequence; identical to SEQ ID NO: 13287
  Description of Artificial Sequence: Synthetic oligonucleotide

SEQ ID NO: 13292 - protein, 17 aa, Artificial Sequence
  Description of Artificial Sequence: Synthetic peptide
YISSAGGAIYYADSVKG

SEQ ID NO: 13293 - DNA, 51 bp, Artificial Sequence; identical to SEQ ID NO: 13287
  Description of Artificial Sequence: Synthetic oligonucleotide

SEQ ID NO: 13294 - protein, 17 aa, Artificial Sequence
  Description of Artificial Sequence: Synthetic peptide
YISSAGGAIYYADSVKG

SEQ ID NO: 13295 - DNA, 51 bp, Artificial Sequence
  Description of Artificial Sequence: Synthetic oligonucleotide
gttatatggtatgatgaagataataaatattatgtagactccgtgaagggc

SEQ ID NO: 13296 - protein, 17 aa, Artificial Sequence
  Description of Artificial Sequence: Synthetic peptide
VIWYDEDNKYYVDSVKG

SEQ ID NO: 13297 - DNA, 51 bp, Artificial Sequence; identical to SEQ ID NO: 12123
  Description of Artificial Sequence: Synthetic oligonucleotide

SEQ ID NO: 13298 - protein, 17 aa, Artificial Sequence
  Description of Artificial Sequence: Synthetic peptide
VIWYDGSNKYYADSVKG

SEQ ID NO: 13299 - DNA, 51 bp, Artificial Sequence; identical to SEQ ID NO: 12899
  Description of Artificial Sequence: Synthetic oligonucleotide

SEQ ID NO: 13300 - protein, 17 aa, Artificial Sequence
  Description of Artificial Sequence: Synthetic peptide
VISGSGGSTFYADSVKG

SEQ ID NO: 13301 - DNA, 51 bp, Artificial Sequence; identical to SEQ ID NO: 12123
  Description of Artificial Sequence: Synthetic oligonucleotide

SEQ ID NO: 13302 - protein, 17 aa, Artificial Sequence
  Description of Artificial Sequence: Synthetic peptide
VIWYDGSNKYYADSVKG

SEQ ID NO: 13303 - DNA, 51 bp, Artificial Sequence
  Description of Artificial Sequence: Synthetic oligonucleotide
gctattagtggtagtggtggtaactcattctacgcagactccgtgaagggc

SEQ ID NO: 13304 - protein, 17 aa, Artificial Sequence
  Description of Artificial Sequence: Synthetic peptide
AISGSGGNSFYADSVKG

SEQ ID NO: 13305 - DNA, 51 bp, Artificial Sequence
  Description of Artificial Sequence: Synthetic oligonucleotide
gttatatggtttgatgtaagtaataaaaagtatgtagactccgtgaagggc

SEQ ID NO: 13306 - protein, 17 aa, Artificial Sequence
  Description of Artificial Sequence: Synthetic peptide
VIWFDVSNKKYVDSVKG

SEQ ID NO: 13307 - DNA, 51 bp, Artificial Sequence; identical to SEQ ID NO: 12123
  Description of Artificial Sequence: Synthetic oligonucleotide

SEQ ID NO: 13308 - protein, 17 aa, Artificial Sequence
  Description of Artificial Sequence: Synthetic peptide
VIWYDGSNKYYADSVKG

SEQ ID NO: 13309 - DNA, 51 bp, Artificial Sequence
  Description of Artificial Sequence: Synthetic oligonucleotide
cttatatggtatgatggaaggaataaatactatgcagactccgtgaagggc

SEQ ID NO: 13310 - protein, 17 aa, Artificial Sequence
  Description of Artificial Sequence: Synthetic peptide
LIWYDGRNKYYADSVKG

SEQ ID NO: 13311 - DNA, 51 bp, Artificial Sequence
  Description of Artificial Sequence: Synthetic oligonucleotide
tggatcaaccctaataacaatgccacaaactatgctcagaactttcagggc

SEQ ID NO: 13312 - protein, 17 aa, Artificial Sequence
  Description of Artificial Sequence: Synthetic peptide
WINPNNNATNYAQNFQG

SEQ ID NO: 13313 - DNA, 51 bp, Artificial Sequence; identical to SEQ ID NO: 13057
  Description of Artificial Sequence: Synthetic oligonucleotide

SEQ ID NO: 13314 - protein, 17 aa, Artificial Sequence
  Description of Artificial Sequence: Synthetic peptide
VISGSGGTTFYADSVKG

SEQ ID NO: 13315 - DNA, 51 bp, Artificial Sequence; identical to SEQ ID NO: 13259
  Description of Artificial Sequence: Synthetic oligonucleotide

SEQ ID NO: 13316 - protein, 17 aa, Artificial Sequence
  Description of Artificial Sequence: Synthetic peptide
YINSNGFTIYYADSVKG

SEQ ID NO: 13317 - DNA, 51 bp, Artificial Sequence
  Description of Artificial Sequence: Synthetic oligonucleotide
gttattagtggtcgtggtggtaccacattctacgcagactccgtgaagggc

SEQ ID NO: 13318 - protein, 17 aa, Artificial Sequence
  Description of Artificial Sequence: Synthetic peptide
VISGRGGTTFYADSVKG

SEQ ID NO: 13319 - DNA, 51 bp, Artificial Sequence; identical to SEQ ID NO: 12153
  Description of Artificial Sequence: Synthetic oligonucleotide

SEQ ID NO: 13320 - protein, 17 aa, Artificial Sequence
  Description of Artificial Sequence: Synthetic peptide
SISGSSSYIYYADSVKG

SEQ ID NO: 13321 - DNA, 51 bp, Artificial Sequence; identical to SEQ ID NO: 13277
  Description of Artificial Sequence: Synthetic oligonucleotide

SEQ ID NO: 13322 - protein, 17 aa, Artificial Sequence
  Description of Artificial Sequence: Synthetic peptide
VISGRGGSTFYADSVKG

SEQ ID NO: 13323 - DNA, 51 bp, Artificial Sequence
  Description of Artificial Sequence: Synthetic oligonucleotide
tgggtcaaccctaacagtggtggcacaaactctgcacagaagtttcagggc

SEQ ID NO: 13324 - protein, 17 aa, Artificial Sequence
  Description of Artificial Sequence: Synthetic peptide
WVNPNSGGTNSAQKFQG

SEQ ID NO: 13325 - DNA, 51 bp, Artificial Sequence
  Description of Artificial Sequence: Synthetic oligonucleotide
tccatcagtagtagtagtaattacatatactacgcagactcagtgaagggc

SEQ ID NO: 13326 - protein, 17 aa, Artificial Sequence
  Description of Artificial Sequence: Synthetic peptide
SISSSSNYIYYADSVKG

SEQ ID NO: 13327 - DNA, 51 bp, Artificial Sequence
  Description of Artificial Sequence: Synthetic oligonucleotide
gttatatggtatgatggaagtagtaaatactatgcagactccgtgaagggc

SEQ ID NO: 13328 - protein, 17 aa, Artificial Sequence
  Description of Artificial Sequence: Synthetic peptide
VIWYDGSSKYYADSVKG

SEQ ID NO: 13329 - DNA, 51 bp, Artificial Sequence
  Description of Artificial Sequence: Synthetic oligonucleotide
gctattagtggtcgtggtagtaacacattctacacagactccgtgaagggc

SEQ ID NO: 13330 - protein, 17 aa, Artificial Sequence
  Description of Artificial Sequence: Synthetic peptide
AISGRGSNTFYTDSVKG

SEQ ID NO: 13331 - DNA, 51 bp, Artificial Sequence; identical to SEQ ID NO: 12301
  Description of Artificial Sequence: Synthetic oligonucleotide

SEQ ID NO: 13332 - protein, 17 aa, Artificial Sequence
  Description of Artificial Sequence: Synthetic peptide
VIWYDESNKYYADSVKG

SEQ ID NO: 13333 - DNA, 51 bp, Artificial Sequence
  Description of Artificial Sequence: Synthetic oligonucleotide
actatgagtggtagtggtggtcgcacatactacgcagactccgtgaacggc

SEQ ID NO: 13334 - protein, 17 aa, Artificial Sequence
  Description of Artificial Sequence: Synthetic peptide
TMSGSGGRTYYADSVNG

SEQ ID NO: 13335 - DNA, 51 bp, Artificial Sequence
  Description of Artificial Sequence: Synthetic oligonucleotide
gttattagtgctagtggtggtaactcattctacgcagactccgtgaagggc

SEQ ID NO: 13336 - protein, 17 aa, Artificial Sequence
  Description of Artificial Sequence: Synthetic peptide
VISASGGNSFYADSVKG

SEQ ID NO: 13337 - DNA, 51 bp, Artificial Sequence; identical to SEQ ID NO: 12361
  Description of Artificial Sequence: Synthetic oligonucleotide

SEQ ID NO: 13338 - protein, 17 aa, Artificial Sequence
  Description of Artificial Sequence: Synthetic peptide
SISSSSSYIYYADSVKG

SEQ ID NO: 13339 - DNA, 51 bp, Artificial Sequence
  Description of Artificial Sequence: Synthetic oligonucleotide
tggatcaaccctaataataatgccacaaactatgctcagagctttcagggc

SEQ ID NO: 13340 - protein, 17 aa, Artificial Sequence
  Description of Artificial Sequence: Synthetic peptide
WINPNNNATNYAQSFQG

SEQ ID NO: 13341 - DNA, 51 bp, Artificial Sequence
  Description of Artificial Sequence: Synthetic oligonucleotide
tgggtcaaccctaacagtggtggctcaaactctgcacagcagtttcagggc

SEQ ID NO: 13342 - protein, 17 aa, Artificial Sequence
  Description of Artificial Sequence: Synthetic peptide
WVNPNSGGSNSAQQFQG

SEQ ID NO: 13343 - DNA, 51 bp, Artificial Sequence
  Description of Artificial Sequence: Synthetic oligonucleotide
tggatcaaccctaacactaatggcacacagtatgcacagaagtttcagggc

SEQ ID NO: 13344 - protein, 17 aa, Artificial Sequence
  Description of Artificial Sequence: Synthetic peptide
WINPNTNGTQYAQKFQG

SEQ ID NO: 13345 - DNA, 51 bp, Artificial Sequence
  Description of Artificial Sequence: Synthetic oligonucleotide
gttatatggtttgatggaaataataaatactatgcagactccgtgaagggc

SEQ ID NO: 13346 - protein, 17 aa, Artificial Sequence
  Description of Artificial Sequence: Synthetic peptide
VIWFDGNNKYYADSVKG

SEQ ID NO: 13347 - DNA, 51 bp, Artificial Sequence; identical to SEQ ID NO: 13057
  Description of Artificial Sequence: Synthetic oligonucleotide

SEQ ID NO: 13348 - protein, 17 aa, Artificial Sequence
  Description of Artificial Sequence: Synthetic peptide
VISGSGGTTFYADSVKG

SEQ ID NO: 13349 - DNA, 51 bp, Artificial Sequence
  Description of Artificial Sequence: Synthetic oligonucleotide
gttatatggtttggtggaaataataaatactatggagactccgtgaagggc

SEQ ID NO: 13350 - protein, 17 aa, Artificial Sequence
  Description of Artificial Sequence: Synthetic peptide
VIWFGGNNKYYGDSVKG

SEQ ID NO: 13351 - DNA, 51 bp, Artificial Sequence
  Description of Artificial Sequence: Synthetic oligonucleotide
gttatatggtatgaggaaagtaataaatactatgcagactccgtgaagggc

SEQ ID NO: 13352 - protein, 17 aa, Artificial Sequence
  Description of Artificial Sequence: Synthetic peptide
VIWYEESNKYYADSVKG

SEQ ID NO: 13353 - DNA, 51 bp, Artificial Sequence
  Description of Artificial Sequence: Synthetic oligonucleotide
tggatcaaccctaacagtggtgccacaaactatgcacagaactttcagggc

SEQ ID NO: 13354 - protein, 17 aa, Artificial Sequence
  Description of Artificial Sequence: Synthetic peptide
WINPNSGATNYAQNFQG

SEQ ID NO: 13355 - DNA, 51 bp, Artificial Sequence
  Description of Artificial Sequence: Synthetic oligonucleotide
gttacatggtttgatggaagtaatcaacgctatgcagactccgtgaagggc

SEQ ID NO: 13356 - protein, 17 aa, Artificial Sequence
  Description of Artificial Sequence: Synthetic peptide
VTWFDGSNQRYADSVKG

SEQ ID NO: 13357 - DNA, 51 bp, Artificial Sequence
  Description of Artificial Sequence: Synthetic oligonucleotide
gctattagtggtcgtggtggtaatacattctacgcagactccgtgaagggc

SEQ ID NO: 13358 - protein, 17 aa, Artificial Sequence
  Description of Artificial Sequence: Synthetic peptide
AISGRGGNTFYADSVKG

SEQ ID NO: 13359 - DNA, 51 bp, Artificial Sequence
  Description of Artificial Sequence: Synthetic oligonucleotide
tccattagtagtggtaatagttccatatactacgcagactcagtgaagggc

SEQ ID NO: 13360 - protein, 17 aa, Artificial Sequence
  Description of Artificial Sequence: Synthetic peptide
SISSGNSSIYYADSVKG

SEQ ID NO: 13361 - DNA, 51 bp, Artificial Sequence
  Description of Artificial Sequence: Synthetic oligonucleotide
attatatcatatggaggaagtaataaatactatgcagactccgtgaagggc

SEQ ID NO: 13362 - protein, 17 aa, Artificial Sequence
  Description of Artificial Sequence: Synthetic peptide
IISYGGSNKYYADSVKG

SEQ ID NO: 13363 - DNA, 51 bp, Artificial Sequence; identical to SEQ ID NO: 13345
  Description of Artificial Sequence: Synthetic oligonucleotide

SEQ ID NO: 13364 - protein, 17 aa, Artificial Sequence
  Description of Artificial Sequence: Synthetic peptide
VIWFDGNNKYYADSVKG

SEQ ID NO: 13365 - DNA, 51 bp, Artificial Sequence
  Description of Artificial Sequence: Synthetic oligonucleotide
cttatatggtatgatggaagtaataaataccatgcagactccgtgaagggc

SEQ ID NO: 13366 - protein, 17 aa, Artificial Sequence
  Description of Artificial Sequence: Synthetic peptide
LIWYDGSNKYHADSVKG

SEQ ID NO: 13367 - DNA, 51 bp, Artificial Sequence
  Description of Artificial Sequence: Synthetic oligonucleotide
gttatatgggacgatggaagtaataaatactatgcagactccgtgaagggc

SEQ ID NO: 13368 - protein, 17 aa, Artificial Sequence
  Description of Artificial Sequence: Synthetic peptide
VIWDDGSNKYYADSVKG

SEQ ID NO: 13369 - DNA, 51 bp, Artificial Sequence
  Description of Artificial Sequence: Synthetic oligonucleotide
tggatcaaccctaacaatggtggcacacagtatgcacagaagtttcagggc

SEQ ID NO: 13370 - protein, 17 aa, Artificial Sequence
  Description of Artificial Sequence: Synthetic peptide
WINPNNGGTQYAQKFQG

SEQ ID NO: 13371 - DNA, 51 bp, Artificial Sequence; identical to SEQ ID NO: 12701
  Description of Artificial Sequence: Synthetic oligonucleotide

SEQ ID NO: 13372 - protein, 17 aa, Artificial Sequence
  Description of Artificial Sequence: Synthetic peptide
SISGSSTYIYYADSVKG

SEQ ID NO: 13373 - DNA, 51 bp, Artificial Sequence; identical to SEQ ID NO: 12153
  Description of Artificial Sequence: Synthetic oligonucleotide

SEQ ID NO: 13374 - protein, 17 aa, Artificial Sequence
  Description of Artificial Sequence: Synthetic peptide
SISGSSSYIYYADSVKG

SEQ ID NO: 13375 - DNA, 51 bp, Artificial Sequence
  Description of Artificial Sequence: Synthetic oligonucleotide
gttgtatgggatgatggaagtaataaatactatgcagactccgtgaagggc

SEQ ID NO: 13376 - protein, 17 aa, Artificial Sequence
  Description of Artificial Sequence: Synthetic peptide
VVWDDGSNKYYADSVKG

SEQ ID NO: 13377 - DNA, 51 bp, Artificial Sequence
  Description of Artificial Sequence: Synthetic oligonucleotide
gctattagtggtagtggtggtaacacattctacgcagactccgtgaagggc

SEQ ID NO: 13378 - protein, 17 aa, Artificial Sequence
  Description of Artificial Sequence: Synthetic peptide
AISGSGGNTFYADSVKG

SEQ ID NO: 13379 - DNA, 51 bp, Artificial Sequence
  Description of Artificial Sequence: Synthetic oligonucleotide
gttatatcatatggtggaagtaataaataccatgcagactccgtgaagggc

SEQ ID NO: 13380 - protein, 17 aa, Artificial Sequence
  Description of Artificial Sequence: Synthetic peptide
VISYGGSNKYHADSVKG

SEQ ID NO: 13381 - DNA, 51 bp, Artificial Sequence
  Description of Artificial Sequence: Synthetic oligonucleotide
ggtattagtggtagtggtggtcgcacatactacgcagactccgtgaagggc

SEQ ID NO: 13382 - protein, 17 aa, Artificial Sequence
  Description of Artificial Sequence: Synthetic peptide
GISGSGGRTYYADSVKG

SEQ ID NO: 13383 - DNA, 51 bp, Artificial Sequence
  Description of Artificial Sequence: Synthetic oligonucleotide
gctattagtggtagtggtggtgccacatactacgcagactccgtgaagggc

SEQ ID NO: 13384 - protein, 17 aa, Artificial Sequence
  Description of Artificial Sequence: Synthetic peptide
AISGSGGATYYADSVKG

SEQ ID NO: 13385 - DNA, 51 bp, Artificial Sequence; identical to SEQ ID NO: 12503
  Description of Artificial Sequence: Synthetic oligonucleotide

SEQ ID NO: 13386 - protein, 17 aa, Artificial Sequence
  Description of Artificial Sequence: Synthetic peptide
VIWYDESNKYYGDSVKG

SEQ ID NO: 13387 - DNA, 51 bp, Artificial Sequence
  Description of Artificial Sequence: Synthetic oligonucleotide
gttatatcatatggtggaagtaataaatacgatgcagactccgtgaagggc

SEQ ID NO: 13388 - protein, 17 aa, Artificial Sequence
  Description of Artificial Sequence: Synthetic peptide
VISYGGSNKYDADSVKG

SEQ ID NO: 13389 - DNA, 51 bp, Artificial Sequence
  Description of Artificial Sequence: Synthetic oligonucleotide
tggatcaaccctaacaataacggcacaaactatgcacagaagtttcagggc

SEQ ID NO: 13390 - protein, 17 aa, Artificial Sequence
  Description of Artificial Sequence: Synthetic peptide
WINPNNNGTNYAQKFQG

SEQ ID NO: 13391 - DNA, 51 bp, Artificial Sequence; identical to SEQ ID NO: 12123
  Description of Artificial Sequence: Synthetic oligonucleotide

SEQ ID NO: 13392 - protein, 17 aa, Artificial Sequence
  Description of Artificial Sequence: Synthetic peptide
VIWYDGSNKYYADSVKG

SEQ ID NO: 13393 - DNA, 51 bp, Artificial Sequence
  Description of Artificial Sequence: Synthetic oligonucleotide
gttgtatggtatgatggaaataatagatactatgcagactccgtgaagggc

SEQ ID NO: 13394 - protein, 17 aa, Artificial Sequence
  Description of Artificial Sequence: Synthetic peptide
VVWYDGNNRYYADSVKG

SEQ ID NO: 13395 - DNA, 51 bp, Artificial Sequence
  Description of Artificial Sequence: Synthetic oligonucleotide
gttacatggtttgatggaaataataactactatgcagactccgtgaagggc

SEQ ID NO: 13396 - protein, 17 aa, Artificial Sequence
  Description of Artificial Sequence: Synthetic peptide
VTWFDGNNNYYADSVKG

SEQ ID NO: 13397 - DNA, 51 bp, Artificial Sequence
  Description of Artificial Sequence: Synthetic oligonucleotide
gctattagtggtagtggtgttaacacattctacgcagactccgtgaagggc

SEQ ID NO: 13398 - protein, 17 aa, Artificial Sequence
  Description of Artificial Sequence: Synthetic peptide
AISGSGVNTFYADSVKG

SEQ ID NO: 13399 - DNA, 51 bp, Artificial Sequence
  Description of Artificial Sequence: Synthetic oligonucleotide
tccattagtggtactagtagttacatatactacgcagactcagtgaagggc

SEQ ID NO: 13400 - protein, 17 aa, Artificial Sequence
  Description of Artificial Sequence: Synthetic peptide
SISGTSSYIYYADSVKG

SEQ ID NO: 13401 - DNA, 51 bp, Artificial Sequence; identical to SEQ ID NO: 12123
  Description of Artificial Sequence: Synthetic oligonucleotide

SEQ ID NO: 13402 - protein, 17 aa, Artificial Sequence
  Description of Artificial Sequence: Synthetic peptide
VIWYDGSNKYYADSVKG

SEQ ID NO: 13403 - DNA, 51 bp, Artificial Sequence; identical to SEQ ID NO: 12491
  Description of Artificial Sequence: Synthetic oligonucleotide

SEQ ID NO: 13404 - protein, 17 aa, Artificial Sequence
  Description of Artificial Sequence: Synthetic peptide
VIWYDENNKYYADSVKG

SEQ ID NO: 13405 - DNA, 51 bp, Artificial Sequence
  Description of Artificial Sequence: Synthetic oligonucleotide
gttatatggtatgaggaaagtaataaatactatggagactccgtgaagggc

SEQ ID NO: 13406 - protein, 17 aa, Artificial Sequence
  Description of Artificial Sequence: Synthetic peptide
VIWYEESNKYYGDSVKG

SEQ ID NO: 13407 - DNA, 51 bp, Artificial Sequence
  Description of Artificial Sequence: Synthetic oligonucleotide
tggatccaccctaacaataatgccacaaactatgcacagaagtttcagggc

SEQ ID NO: 13408 - protein, 17 aa, Artificial Sequence
  Description of Artificial Sequence: Synthetic peptide
WIHPNNNATNYAQKFQG

SEQ ID NO: 13409 - DNA, 51 bp, Artificial Sequence
  Description of Artificial Sequence: Synthetic oligonucleotide
gctattagtggtcgtggtagtagcacattctacgcagactccgtgaagggc

SEQ ID NO: 13410 - protein, 17 aa, Artificial Sequence
  Description of Artificial Sequence: Synthetic peptide
AISGRGSSTFYADSVKG

SEQ ID NO: 13411 - DNA, 51 bp, Artificial Sequence; identical to SEQ ID NO: 12123
  Description of Artificial Sequence: Synthetic oligonucleotide

SEQ ID NO: 13412 - protein, 17 aa, Artificial Sequence
  Description of Artificial Sequence: Synthetic peptide
VIWYDGSNKYYADSVKG

SEQ ID NO: 13413 - DNA, 51 bp, Artificial Sequence; identical to SEQ ID NO: 13365
  Description of Artificial Sequence: Synthetic oligonucleotide

SEQ ID NO: 13414 - protein, 17 aa, Artificial Sequence
  Description of Artificial Sequence: Synthetic peptide
LIWYDGSNKYHADSVKG

SEQ ID NO: 13415 - DNA, 51 bp, Artificial Sequence
  Description of Artificial Sequence: Synthetic oligonucleotide
gttatatggtttgatggaaataataaatactatgaagactccgtgaagggc

SEQ ID NO: 13416 - protein, 17 aa, Artificial Sequence
  Description of Artificial Sequence: Synthetic peptide
VIWFDGNNKYYEDSVKG

SEQ ID NO: 13417 - DNA, 51 bp, Artificial Sequence
  Description of Artificial Sequence: Synthetic oligonucleotide
tccattagtagtagtagtaatcacatagactacgcagactcagtgaagggc

SEQ ID NO: 13418 - protein, 17 aa, Artificial Sequence
  Description of Artificial Sequence: Synthetic peptide
SISSSSNHIDYADSVKG

SEQ ID NO: 13419 - DNA, 51 bp, Artificial Sequence; identical to SEQ ID NO: 12491
  Description of Artificial Sequence: Synthetic oligonucleotide

SEQ ID NO: 13420 - protein, 17 aa, Artificial Sequence
  Description of Artificial Sequence: Synthetic peptide
VIWYDENNKYYADSVKG

SEQ ID NO: 13421 - DNA, 51 bp, Artificial Sequence
  Description of Artificial Sequence: Synthetic oligonucleotide
gttatatggtatgatggaaatggcaaatattatgcagactccgtgaagggc

SEQ ID NO: 13422 - protein, 17 aa, Artificial Sequence
  Description of Artificial Sequence: Synthetic peptide
VIWYDGNGKYYADSVKG

SEQ ID NO: 13423 - DNA, 51 bp, Artificial Sequence
  Description of Artificial Sequence: Synthetic oligonucleotide
attatatcatatggtggaagtaataaatacgatgcagactccgtgaagggc

SEQ ID NO: 13424 - protein, 17 aa, Artificial Sequence
  Description of Artificial Sequence: Synthetic peptide
IISYGGSNKYDADSVKG

SEQ ID NO: 13425 - DNA, 51 bp, Artificial Sequence; identical to SEQ ID NO: 12263
  Description of Artificial Sequence: Synthetic oligonucleotide

SEQ ID NO: 13426 - protein, 17 aa, Artificial Sequence
  Description of Artificial Sequence: Synthetic peptide
VIWHDGSNKYYADSVKG

SEQ ID NO: 13427 - DNA, 51 bp, Artificial Sequence
  Description of Artificial Sequence: Synthetic oligonucleotide
gctatcagtggtagtggtgttaactcattctacgcagactccgtgaagggc

SEQ ID NO: 13428 - protein, 17 aa, Artificial Sequence
  Description of Artificial Sequence: Synthetic peptide
AISGSGVNSFYADSVKG

SEQ ID NO: 13429 - DNA, 51 bp, Artificial Sequence
  Description of Artificial Sequence: Synthetic oligonucleotide
gttatatggtatgaagaaactaataaatactatgcagactccgtgaagggc

SEQ ID NO: 13430 - protein, 17 aa, Artificial Sequence
  Description of Artificial Sequence: Synthetic peptide
VIWYEETNKYYADSVKG

SEQ ID NO: 13431 - DNA, 51 bp, Artificial Sequence
  Description of Artificial Sequence: Synthetic oligonucleotide
gtaatcaaccctagtaatggtagaacaagctacgcacagaagttccagggc

SEQ ID NO: 13432 - protein, 17 aa, Artificial Sequence
  Description of Artificial Sequence: Synthetic peptide
VINPSNGRTSYAQKFQG

SEQ ID NO: 13433 - DNA, 51 bp, Artificial Sequence
  Description of Artificial Sequence: Synthetic oligonucleotide
gttatatcatatgttggaagtactaaatactatgcagactccgtgaggggc

SEQ ID NO: 13434 - protein, 17 aa, Artificial Sequence
  Description of Artificial Sequence: Synthetic peptide
VISYVGSTKYYADSVRG

SEQ ID NO: 13435 - DNA, 51 bp, Artificial Sequence; identical to SEQ ID NO: 12161
  Description of Artificial Sequence: Synthetic oligonucleotide

SEQ ID NO: 13436 - protein, 17 aa, Artificial Sequence
  Description of Artificial Sequence: Synthetic peptide
WMHPNSGNTGYAQKFQG

SEQ ID NO: 13437 - DNA, 51 bp, Artificial Sequence
  Description of Artificial Sequence: Synthetic oligonucleotide
tccattagtagtagtagtacttacatatactacggagactcagtgaagggc

SEQ ID NO: 13438 - protein, 17 aa, Artificial Sequence
  Description of Artificial Sequence: Synthetic peptide
SISSSSTYIYYGDSVKG

SEQ ID NO: 13439 - DNA, 51 bp, Artificial Sequence; identical to SEQ ID NO: 13377
  Description of Artificial Sequence: Synthetic oligonucleotide

SEQ ID NO: 13440 - protein, 17 aa, Artificial Sequence
  Description of Artificial Sequence: Synthetic peptide
AISGSGGNTFYADSVKG

SEQ ID NO: 13441 - DNA, 51 bp, Artificial Sequence; identical to SEQ ID NO: 12153
  Description of Artificial Sequence: Synthetic oligonucleotide

SEQ ID NO: 13442 - protein, 17 aa, Artificial Sequence
  Description of Artificial Sequence: Synthetic peptide
SISGSSSYIYYADSVKG

SEQ ID NO: 13443 - DNA, 51 bp, Artificial Sequence
  Description of Artificial Sequence: Synthetic oligonucleotide
tggatcaaccctaacaataatgccacaaactatgcacagaagtttcagggc

SEQ ID NO: 13444 - protein, 17 aa, Artificial Sequence
  Description of Artificial Sequence: Synthetic peptide
WINPNNNATNYAQKFQG

SEQ ID NO: 13445 - DNA, 51 bp, Artificial Sequence
  Description of Artificial Sequence: Synthetic oligonucleotide
gttatatggcatgatggaagtaataaatattatgtagactccgtgaagggc

SEQ ID NO: 13446 - protein, 17 aa, Artificial Sequence
  Description of Artificial Sequence: Synthetic peptide
VIWHDGSNKYYVDSVKG

SEQ ID NO: 13447 - DNA, 51 bp, Artificial Sequence
  Description of Artificial Sequence: Synthetic oligonucleotide
tggatcaaccctaacagaggtggcacaaattatgtacagaagtttcagggt

SEQ ID NO: 13448 - protein, 17 aa, Artificial Sequence
  Description of Artificial Sequence: Synthetic peptide
WINPNRGGTNYVQKFQG

SEQ ID NO: 13449 - DNA, 51 bp, Artificial Sequence
  Description of Artificial Sequence: Synthetic oligonucleotide
tggatcaaccctaacagtggtggcacaaactatgcacagaggtttcagggc

SEQ ID NO: 13450 - protein, 17 aa, Artificial Sequence
  Description of Artificial Sequence: Synthetic peptide
WINPNSGGTNYAQRFQG

SEQ ID NO: 13451 - DNA, 51 bp, Artificial Sequence; identical to SEQ ID NO: 13323
  Description of Artificial Sequence: Synthetic oligonucleotide

SEQ ID NO: 13452 - protein, 17 aa, Artificial Sequence
  Description of Artificial Sequence: Synthetic peptide
WVNPNSGGTNSAQKFQG

SEQ ID NO: 13453 - DNA, 51 bp, Artificial Sequence
  Description of Artificial Sequence: Synthetic oligonucleotide
gttatatggtatgatgaaagtaataaacactatgcagactccgtgaagggc

SEQ ID NO: 13454 - protein, 17 aa, Artificial Sequence
  Description of Artificial Sequence: Synthetic peptide
VIWYDESNKHYADSVKG

SEQ ID NO: 13455 - DNA, 51 bp, Artificial Sequence; identical to SEQ ID NO: 12123
  Description of Artificial Sequence: Synthetic oligonucleotide

SEQ ID NO: 13456 - protein, 17 aa, Artificial Sequence
  Description of Artificial Sequence: Synthetic peptide
VIWYDGSNKYYADSVKG

SEQ ID NO: 13457 - DNA, 51 bp, Artificial Sequence
  Description of Artificial Sequence: Synthetic oligonucleotide
attatatggtatgatgaaaataataaatactatgcagactccgtgaagggc

SEQ ID NO: 13458 - protein, 17 aa, Artificial Sequence
  Description of Artificial Sequence: Synthetic peptide
IIWYDENNKYYADSVKG

SEQ ID NO: 13459 - DNA, 51 bp, Artificial Sequence; identical to SEQ ID NO: 12123
  Description of Artificial Sequence: Synthetic oligonucleotide

SEQ ID NO: 13460 - protein, 17 aa, Artificial Sequence
  Description of Artificial Sequence: Synthetic peptide
VIWYDGSNKYYADSVKG

SEQ ID NO: 13461 - DNA, 51 bp, Artificial Sequence
  Description of Artificial Sequence: Synthetic oligonucleotide
gttatatggtatgaagaaagtaataaatactatgcagactccgtgaagggc

SEQ ID NO: 13462 - protein, 17 aa, Artificial Sequence
  Description of Artificial Sequence: Synthetic peptide
VIWYEESNKYYADSVKG

SEQ ID NO: 13463 - DNA, 51 bp, Artificial Sequence
  Description of Artificial Sequence: Synthetic oligonucleotide
tggatcaaccctaacagcggtggcacaaactatgtacagaaatttcagggc

SEQ ID NO: 13464 - protein, 17 aa, Artificial Sequence
  Description of Artificial Sequence: Synthetic peptide
WINPNSGGTNYVQKFQG

SEQ ID NO: 13465 - DNA, 51 bp, Artificial Sequence; identical to SEQ ID NO: 12161
  Description of Artificial Sequence: Synthetic oligonucleotide

SEQ ID NO: 13466 - protein, 17 aa, Artificial Sequence
  Description of Artificial Sequence: Synthetic peptide
WMHPNSGNTGYAQKFQG

SEQ ID NO: 13467 - DNA, 51 bp, Artificial Sequence
  Description of Artificial Sequence: Synthetic oligonucleotide
tctattagtggtagtggtggttggacaaactacgcagactccgtgaagggc

SEQ ID NO: 13468 - protein, 17 aa, Artificial Sequence
  Description of Artificial Sequence: Synthetic peptide
SISGSGGWTNYADSVKG

SEQ ID NO: 13469 - DNA, 51 bp, Artificial Sequence
  Description of Artificial Sequence: Synthetic oligonucleotide
ggtattagtggtagtggtaatagaacatactacgcagactccgtgaagggc

SEQ ID NO: 13470 - protein, 17 aa, Artificial Sequence
  Description of Artificial Sequence: Synthetic peptide
GISGSGNRTYYADSVKG

SEQ ID NO: 13471 - DNA, 48 bp, Artificial Sequence
  Description of Artificial Sequence: Synthetic oligonucleotide
agtatctattatagtgggagcgcctcctacaacccgtccctcaagagt

SEQ ID NO: 13472 - protein, 16 aa, Artificial Sequence
  Description of Artificial Sequence: Synthetic peptide
SIYYSGSASYNPSLKS

SEQ ID NO: 13473 - DNA, 51 bp, Artificial Sequence; identical to SEQ ID NO: 13377
  Description of Artificial Sequence: Synthetic oligonucleotide

SEQ ID NO: 13474 - protein, 17 aa, Artificial Sequence
  Description of Artificial Sequence: Synthetic peptide
AISGSGGNTFYADSVKG

SEQ ID NO: 13475 - DNA, 51 bp, Artificial Sequence
  Description of Artificial Sequence: Synthetic oligonucleotide
gctattagtggtagtggtggtaacacattctacgcagactccgtgacgggc

SEQ ID NO: 13476 - protein, 17 aa, Artificial Sequence
  Description of Artificial Sequence: Synthetic peptide
AISGSGGNTFYADSVTG

SEQ ID NO: 13477 - DNA, 51 bp, Artificial Sequence; identical to SEQ ID NO: 12133
  Description of Artificial Sequence: Synthetic oligonucleotide

SEQ ID NO: 13478 - protein, 17 aa, Artificial Sequence
  Description of Artificial Sequence: Synthetic peptide
VIWYDGSNKYYVDSVKG

SEQ ID NO: 13479 - DNA, 48 bp, Artificial Sequence
  Description of Artificial Sequence: Synthetic oligonucleotide
cgcatctataccagggggagcaccaactacaacccctccctcaagagt

SEQ ID NO: 13480 - protein, 16 aa, Artificial Sequence
  Description of Artificial Sequence: Synthetic peptide
RIYTRGSTNYNPSLKS

SEQ ID NO: 13481 - DNA, 48 bp, Artificial Sequence
  Description of Artificial Sequence: Synthetic oligonucleotide
cgcatctatatcagggggagcaccaactacaacccctccctcaagagt

SEQ ID NO: 13482 - protein, 16 aa, Artificial Sequence
  Description of Artificial Sequence: Synthetic peptide
RIYIRGSTNYNPSLKS

SEQ ID NO: 13483 - DNA, 51 bp, Artificial Sequence
  Description of Artificial Sequence: Synthetic oligonucleotide
attatatggtatgatgaaagtaataaatactatgcagactccgtgaagggc

SEQ ID NO: 13484 - protein, 17 aa, Artificial Sequence
  Description of Artificial Sequence: Synthetic peptide
IIWYDESNKYYADSVKG

SEQ ID NO: 13485 - DNA, 51 bp, Artificial Sequence; identical to SEQ ID NO: 12123
  Description of Artificial Sequence: Synthetic oligonucleotide

SEQ ID NO: 13486 - protein, 17 aa, Artificial Sequence
  Description of Artificial Sequence: Synthetic peptide
VIWYDGSNKYYADSVKG

SEQ ID NO: 13487 - DNA, 51 bp, Artificial Sequence; identical to SEQ ID NO: 12123
  Description of Artificial Sequence: Synthetic oligonucleotide

SEQ ID NO: 13488 - protein, 17 aa, Artificial Sequence
  Description of Artificial Sequence: Synthetic peptide
VIWYDGSNKYYADSVKG

SEQ ID NO: 13489 - DNA, 51 bp, Artificial Sequence; identical to SEQ ID NO: 12101
  Description of Artificial Sequence: Synthetic oligonucleotide

SEQ ID NO: 13490 - protein, 17 aa, Artificial Sequence
  Description of Artificial Sequence: Synthetic peptide
WMTPNSGNTGYAQKFQG

SEQ ID NO: 13491 - DNA, 51 bp, Artificial Sequence
  Description of Artificial Sequence: Synthetic oligonucleotide
tggatgcaccctaacagtggtagcacaggctatgcacagaagttccagggc

SEQ ID NO: 13492 - protein, 17 aa, Artificial Sequence
  Description of Artificial Sequence: Synthetic peptide
WMHPNSGSTGYAQKFQG

SEQ ID NO: 13493 - DNA, 51 bp, Artificial Sequence
  Description of Artificial Sequence: Synthetic oligonucleotide
gctattagtactggtggtggtaacacatactacgcagactccgtgaagggc

SEQ ID NO: 13494 - protein, 17 aa, Artificial Sequence
  Description of Artificial Sequence: Synthetic peptide
AISTGGGNTYYADSVKG

SEQ ID NO: 13495 - DNA, 51 bp, Artificial Sequence
  Description of Artificial Sequence: Synthetic oligonucleotide
gctactagtggtagtggtgttaacacattctacgcagactccgtgaagggc

SEQ ID NO: 13496 - protein, 17 aa, Artificial Sequence
  Description of Artificial Sequence: Synthetic peptide
ATSGSGVNTFYADSVKG

SEQ ID NO: 13497 - DNA, 51 bp, Artificial Sequence; identical to SEQ ID NO: 12361
  Description of Artificial Sequence: Synthetic oligonucleotide

SEQ ID NO: 13498 - protein, 17 aa, Artificial Sequence
  Description of Artificial Sequence: Synthetic peptide
SISSSSSYIYYADSVKG

SEQ ID NO: 13499 - DNA, 51 bp, Artificial Sequence; identical to SEQ ID NO: 12127
  Description of Artificial Sequence: Synthetic oligonucleotide

SEQ ID NO: 13500 - protein, 17 aa, Artificial Sequence
  Description of Artificial Sequence: Synthetic peptide
IIWYDGSNKYYADSVKG

SEQ ID NO: 13501 - DNA, 51 bp, Artificial Sequence
  Description of Artificial Sequence: Synthetic oligonucleotide
gttatatggtatgatggaagtaataaatactctgcagactccgtgaagggc

SEQ ID NO: 13502 - protein, 17 aa, Artificial Sequence
  Description of Artificial Sequence: Synthetic peptide
VIWYDGSNKYSADSVKG

SEQ ID NO: 13503 - DNA, 48 bp, Artificial Sequence
  Description of Artificial Sequence: Synthetic oligonucleotide
agcatctattatagtgggatcgcctcctataatccgtccctcaagagt

SEQ ID NO: 13504 - protein, 16 aa, Artificial Sequence
  Description of Artificial Sequence: Synthetic peptide
SIYYSGIASYNPSLKS

SEQ ID NO: 13505 - DNA, 51 bp, Artificial Sequence; identical to SEQ ID NO: 12361
  Description of Artificial Sequence: Synthetic oligonucleotide

SEQ ID NO: 13506 - protein, 17 aa, Artificial Sequence
  Description of Artificial Sequence: Synthetic peptide
SISSSSSYIYYADSVKG

SEQ ID NO: 13507 - DNA, 51 bp, Artificial Sequence
  Description of Artificial Sequence: Synthetic oligonucleotide
gttatatggtatgatagaagtaataaatactatgcagactccgtgaagggc

SEQ ID NO: 13508 - protein, 17 aa, Artificial Sequence
  Description of Artificial Sequence: Synthetic peptide
VIWYDRSNKYYADSVKG

SEQ ID NO: 13509 - DNA, 51 bp, Artificial Sequence
  Description of Artificial Sequence: Synthetic oligonucleotide
gctatatggtatgatggaagtaataaatactatggagactccgtgaagggc

SEQ ID NO: 13510 - protein, 17 aa, Artificial Sequence
  Description of Artificial Sequence: Synthetic peptide
AIWYDGSNKYYGDSVKG

SEQ ID NO: 13511 - DNA, 51 bp, Artificial Sequence
  Description of Artificial Sequence: Synthetic oligonucleotide
ggtattagtggtagtggtgctaaaacatactatgcagactccgtgaagggc

SEQ ID NO: 13512 - protein, 17 aa, Artificial Sequence
  Description of Artificial Sequence: Synthetic peptide
GISGSGAKTYYADSVKG

SEQ ID NO: 13513 - DNA, 51 bp, Artificial Sequence
  Description of Artificial Sequence: Synthetic oligonucleotide
tggatcaaacctaaaagtggtggcacaaaccaagcacagaagtttcagggc

SEQ ID NO: 13514 - protein, 17 aa, Artificial Sequence
  Description of Artificial Sequence: Synthetic peptide
WIKPKSGGTNQAQKFQG

SEQ ID NO: 13515 - DNA, 51 bp, Artificial Sequence
  Description of Artificial Sequence: Synthetic oligonucleotide
gctatgagtggtagtggtggtagaacatactacgcagactccgtgaagggc

SEQ ID NO: 13516 - protein, 17 aa, Artificial Sequence
  Description of Artificial Sequence: Synthetic peptide
AMSGSGGRTYYADSVKG

SEQ ID NO: 13517 - DNA, 51 bp, Artificial Sequence; identical to SEQ ID NO: 13437
  Description of Artificial Sequence: Synthetic oligonucleotide

SEQ ID NO: 13518 - protein, 17 aa, Artificial Sequence
  Description of Artificial Sequence: Synthetic peptide
SISSSSTYIYYGDSVKG

SEQ ID NO: 13519 - DNA, 51 bp, Artificial Sequence
  Description of Artificial Sequence: Synthetic oligonucleotide
tccattagtggtagtagtagttacataaactacacagactcagtgaagggc

SEQ ID NO: 13520 - protein, 17 aa, Artificial Sequence
  Description of Artificial Sequence: Synthetic peptide
SISGSSSYINYTDSVKG

SEQ ID NO: 13521 - DNA, 48 bp, Artificial Sequence; identical to SEQ ID NO: 13479
  Description of Artificial Sequence: Synthetic oligonucleotide

SEQ ID NO: 13522 - protein, 16 aa, Artificial Sequence
  Description of Artificial Sequence: Synthetic peptide
RIYTRGSTNYNPSLKS

SEQ ID NO: 13523 - DNA, 51 bp, Artificial Sequence; identical to SEQ ID NO: 12151
  Description of Artificial Sequence: Synthetic oligonucleotide

SEQ ID NO: 13524 - protein, 17 aa, Artificial Sequence
  Description of Artificial Sequence: Synthetic peptide
AIWYDGSNKYYADSVKG

SEQ ID NO: 13525 - DNA, 51 bp, Artificial Sequence
  Description of Artificial Sequence: Synthetic oligonucleotide
gttatatggtatgctggaagtaataaatactatgtagactccgtgaagggc

SEQ ID NO: 13526 - protein, 17 aa, Artificial Sequence
  Description of Artificial Sequence: Synthetic peptide
VIWYAGSNKYYVDSVKG

SEQ ID NO: 13527 - DNA, 51 bp, Artificial Sequence
  Description of Artificial Sequence: Synthetic oligonucleotide
gttattagtggtagtggtggtagtacattctacgcagactccgtgaagggc

SEQ ID NO: 13528 - protein, 17 aa, Artificial Sequence
  Description of Artificial Sequence: Synthetic peptide
VISGSGGSTFYADSVKG

SEQ ID NO: 13529 - DNA, 51 bp, Artificial Sequence
  Description of Artificial Sequence: Synthetic oligonucleotide
tacattagtagtagtggtagtaccatatactacgcagactctgtgaagggc

SEQ ID NO: 13530 - protein, 17 aa, Artificial Sequence
  Description of Artificial Sequence: Synthetic peptide
YISSSGSTIYYADSVKG

SEQ ID NO: 13531 - DNA, 51 bp, Artificial Sequence; identical to SEQ ID NO: 13081
  Description of Artificial Sequence: Synthetic oligonucleotide

SEQ ID NO: 13532 - protein, 17 aa, Artificial Sequence
  Description of Artificial Sequence: Synthetic peptide
WINPNNNGTNYAQKFQG

SEQ ID NO: 13533 - DNA, 51 bp, Artificial Sequence; identical to SEQ ID NO: 13377
  Description of Artificial Sequence: Synthetic oligonucleotide

SEQ ID NO: 13534 - protein, 17 aa, Artificial Sequence
  Description of Artificial Sequence: Synthetic peptide
AISGSGGNTFYADSVKG

SEQ ID NO: 13535 - DNA, 51 bp, Artificial Sequence; identical to SEQ ID NO: 13377
  Description of Artificial Sequence: Synthetic oligonucleotide

SEQ ID NO: 13536 - protein, 17 aa, Artificial Sequence
  Description of Artificial Sequence: Synthetic peptide
AISGSGGNTFYADSVKG

SEQ ID NO: 13537 - DNA, 51 bp, Artificial Sequence
  Description of Artificial Sequence: Synthetic oligonucleotide
gctagcagtggtagtggtggtaacacattctacgcagactccgtgacgggc

SEQ ID NO: 13538 - protein, 17 aa, Artificial Sequence
  Description of Artificial Sequence: Synthetic peptide
ASSGSGGNTFYADSVTG

SEQ ID NO: 13539 - DNA, 51 bp, Artificial Sequence
  Description of Artificial Sequence: Synthetic oligonucleotide
tggatgaaccctaacagtgttaacacaggctatgcacagaagttccagggc

SEQ ID NO: 13540 - protein, 17 aa, Artificial Sequence
  Description of Artificial Sequence: Synthetic peptide
WMNPNSVNTGYAQKFQG

SEQ ID NO: 13541 - DNA, 51 bp, Artificial Sequence; identical to SEQ ID NO: 12103
  Description of Artificial Sequence: Synthetic oligonucleotide

SEQ ID NO: 13542 - protein, 17 aa, Artificial Sequence
  Description of Artificial Sequence: Synthetic peptide
WMNPNSGNTGYAQKFQG

SEQ ID NO: 13543 - DNA, 51 bp, Artificial Sequence
  Description of Artificial Sequence: Synthetic oligonucleotide
gctattagtggtagtggtggtaacacattctacggagactccgtgaagggc

SEQ ID NO: 13544 - protein, 17 aa, Artificial Sequence
  Description of Artificial Sequence: Synthetic peptide
AISGSGGNTFYGDSVKG

SEQ ID NO: 13545 - DNA, 51 bp, Artificial Sequence; identical to SEQ ID NO: 13543
  Description of Artificial Sequence: Synthetic oligonucleotide

SEQ ID NO: 13546 - protein, 17 aa, Artificial Sequence
  Description of Artificial Sequence: Synthetic peptide
AISGSGGNTFYGDSVKG

SEQ ID NO: 13547 - DNA, 51 bp, Artificial Sequence
  Description of Artificial Sequence: Synthetic oligonucleotide
gttatatggtatgctggaagtaataaataccatgtagactccgtgaagggc

SEQ ID NO: 13548 - protein, 17 aa, Artificial Sequence
  Description of Artificial Sequence: Synthetic peptide
VIWYAGSNKYHVDSVKG

SEQ ID NO: 13549 - DNA, 51 bp, Artificial Sequence
  Description of Artificial Sequence: Synthetic oligonucleotide
tggatgaaccctaacagtggtagcacaggctatgcacagaagttccagggc

SEQ ID NO: 13550 - protein, 17 aa, Artificial Sequence
  Description of Artificial Sequence: Synthetic peptide
WMNPNSGSTGYAQKFQG

SEQ ID NO: 13551 - DNA, 51 bp, Artificial Sequence; identical to SEQ ID NO: 13377
  Description of Artificial Sequence: Synthetic oligonucleotide

SEQ ID NO: 13552 - protein, 17 aa, Artificial Sequence
  Description of Artificial Sequence: Synthetic peptide
AISGSGGNTFYADSVKG

SEQ ID NO: 13553 - DNA, 51 bp, Artificial Sequence
  Description of Artificial Sequence: Synthetic oligonucleotide
gttatatggtatgatggaagtaaaaaatattatgcagactccgtgaagggc

SEQ ID NO: 13554 - protein, 17 aa, Artificial Sequence
  Description of Artificial Sequence: Synthetic peptide
VIWYDGSKKYYADSVKG

SEQ ID NO: 13555 - DNA, 51 bp, Artificial Sequence; identical to SEQ ID NO: 13377
  Description of Artificial Sequence: Synthetic oligonucleotide

SEQ ID NO: 13556 - protein, 17 aa, Artificial Sequence
  Description of Artificial Sequence: Synthetic peptide
AISGSGGNTFYADSVKG

SEQ ID NO: 13557 - DNA, 51 bp, Artificial Sequence
  Description of Artificial Sequence: Synthetic oligonucleotide
gttatatggtatgatggaagtaataaataccatgcagactccgtgaagggc

SEQ ID NO: 13558 - protein, 17 aa, Artificial Sequence
  Description of Artificial Sequence: Synthetic peptide
VIWYDGSNKYHADSVKG

SEQ ID NO: 13559 - DNA, 51 bp, Artificial Sequence
  Description of Artificial Sequence: Synthetic oligonucleotide
tggatgactcctaacagtggtaacacaggctatgcacagaagttccagggc

SEQ ID NO: 13560 - protein, 17 aa, Artificial Sequence
  Description of Artificial Sequence: Synthetic peptide
WMTPNSGNTGYAQKFQG

SEQ ID NO: 13561 - DNA, 51 bp, Artificial Sequence; identical to SEQ ID NO: 12197
  Description of Artificial Sequence: Synthetic oligonucleotide

SEQ ID NO: 13562 - protein, 17 aa, Artificial Sequence
  Description of Artificial Sequence: Synthetic peptide
WINPNSGGTNYAQKFQG

SEQ ID NO: 13563 - DNA, 51 bp, Artificial Sequence; identical to SEQ ID NO: 13377
  Description of Artificial Sequence: Synthetic oligonucleotide

SEQ ID NO: 13564 - protein, 17 aa, Artificial Sequence
  Description of Artificial Sequence: Synthetic peptide
AISGSGGNTFYADSVKG

SEQ ID NO: 13565 - DNA, 51 bp, Artificial Sequence; identical to SEQ ID NO: 12123
  Description of Artificial Sequence: Synthetic oligonucleotide

SEQ ID NO: 13566 - protein, 17 aa, Artificial Sequence
  Description of Artificial Sequence: Synthetic peptide
VIWYDGSNKYYADSVKG

SEQ ID NO: 13567 - DNA, 48 bp, Artificial Sequence; identical to SEQ ID NO: 12481
  Description of Artificial Sequence: Synthetic oligonucleotide

SEQ ID NO: 13568 - protein, 16 aa, Artificial Sequence
  Description of Artificial Sequence: Synthetic peptide
NIYYSGSTYYNPSLKS

SEQ ID NO: 13569 - DNA, 51 bp, Artificial Sequence
  Description of Artificial Sequence: Synthetic oligonucleotide
tggatcaacccgaacagtggtggcacaaactatgtacagaaatttcagggc

SEQ ID NO: 13570 - protein, 17 aa, Artificial Sequence
  Description of Artificial Sequence: Synthetic peptide
WINPNSGGTNYVQKFQG

SEQ ID NO: 13571 - DNA, 51 bp, Artificial Sequence
  Description of Artificial Sequence: Synthetic oligonucleotide
tacattagtagtagtagtgggaccatatactacgcagactctgtgaagggc

SEQ ID NO: 13572 - protein, 17 aa, Artificial Sequence
  Description of Artificial Sequence: Synthetic peptide
YISSSSGTIYYADSVKG

SEQ ID NO: 13573 - DNA, 51 bp, Artificial Sequence; identical to SEQ ID NO: 13051
  Description of Artificial Sequence: Synthetic oligonucleotide

SEQ ID NO: 13574 - protein, 17 aa, Artificial Sequence
  Description of Artificial Sequence: Synthetic peptide
WINPNSGGTNYVQKFQG

SEQ ID NO: 13575 - DNA, 51 bp, Artificial Sequence; identical to SEQ ID NO: 12103
  Description of Artificial Sequence: Synthetic oligonucleotide

SEQ ID NO: 13576 - protein, 17 aa, Artificial Sequence
  Description of Artificial Sequence: Synthetic peptide
WMNPNSGNTGYAQKFQG

SEQ ID NO: 13577 - DNA, 51 bp, Artificial Sequence
  Description of Artificial Sequence: Synthetic oligonucleotide
gttatatggcatgatggaagtgataaatattatgtagactccgtgaagggc

SEQ ID NO: 13578 - protein, 17 aa, Artificial Sequence
  Description of Artificial Sequence: Synthetic peptide
VIWHDGSDKYYVDSVKG

SEQ ID NO: 13579 - DNA, 51 bp, Artificial Sequence; identical to SEQ ID NO: 12123
  Description of Artificial Sequence: Synthetic oligonucleotide

SEQ ID NO: 13580 - protein, 17 aa, Artificial Sequence
  Description of Artificial Sequence: Synthetic peptide
VIWYDGSNKYYADSVKG

SEQ ID NO: 13581 - DNA, 51 bp, Artificial Sequence
  Description of Artificial Sequence: Synthetic oligonucleotide
tccattagtggtagtagcacttacatgaactacacagactcagtgaagggc

SEQ ID NO: 13582 - protein, 17 aa, Artificial Sequence
  Description of Artificial Sequence: Synthetic peptide
SISGSSTYMNYTDSVKG

SEQ ID NO: 13583 - DNA, 51 bp, Artificial Sequence
  Description of Artificial Sequence: Synthetic oligonucleotide
tggatcaaccctaacagtggtggcacaaactttgcacagaagtttcagggc

SEQ ID NO: 13584 - protein, 17 aa, Artificial Sequence
  Description of Artificial Sequence: Synthetic peptide
WINPNSGGTNFAQKFQG

SEQ ID NO: 13585 - DNA, 51 bp, Artificial Sequence
  Description of Artificial Sequence: Synthetic oligonucleotide
gtcatatggtatgatggaagtaataaatactatgcagactccgtgaagggc

SEQ ID NO: 13586 - protein, 17 aa, Artificial Sequence
  Description of Artificial Sequence: Synthetic peptide
VIWYDGSNKYYADSVKG

SEQ ID NO: 13587 - DNA, 51 bp, Artificial Sequence
  Description of Artificial Sequence: Synthetic oligonucleotide
gttatatggtttgatgaaactaataaatactatggagactccgtgaagggc

SEQ ID NO: 13588 - protein, 17 aa, Artificial Sequence
  Description of Artificial Sequence: Synthetic peptide
VIWFDETNKYYGDSVKG

SEQ ID NO: 13589 - DNA, 51 bp, Artificial Sequence; identical to SEQ ID NO: 13585
  Description of Artificial Sequence: Synthetic oligonucleotide

SEQ ID NO: 13590 - protein, 17 aa, Artificial Sequence
  Description of Artificial Sequence: Synthetic peptide
VIWYDGSNKYYADSVKG

SEQ ID NO: 13591 - DNA, 48 bp, Artificial Sequence
  Description of Artificial Sequence: Synthetic oligonucleotide
cgtatctataccagtgggatctccaactacaatccctccctcaagagt

SEQ ID NO: 13592 - protein, 16 aa, Artificial Sequence
  Description of Artificial Sequence: Synthetic peptide
RIYTSGISNYNPSLKS

SEQ ID NO: 13593 - DNA, 51 bp, Artificial Sequence
  Description of Artificial Sequence: Synthetic oligonucleotide
gttatatggtatgatggaagtaataaatactatgcagactccatgaagggc

SEQ ID NO: 13594 - protein, 17 aa, Artificial Sequence
  Description of Artificial Sequence: Synthetic peptide
VIWYDGSNKYYADSMKG

SEQ ID NO: 13595 - DNA, 51 bp, Artificial Sequence; identical to SEQ ID NO: 12127
  Description of Artificial Sequence: Synthetic oligonucleotide

SEQ ID NO: 13596 - protein, 17 aa, Artificial Sequence
  Description of Artificial Sequence: Synthetic peptide
IIWYDGSNKYYADSVKG

SEQ ID NO: 13597 - DNA, 51 bp, Artificial Sequence
  Description of Artificial Sequence: Synthetic oligonucleotide
tggatcaaaccaaacagtggtggcacaaaccaagcacagaagtttcagggc

SEQ ID NO: 13598 - protein, 17 aa, Artificial Sequence
  Description of Artificial Sequence: Synthetic peptide
WIKPNSGGTNQAQKFQG

SEQ ID NO: 13599 - DNA, 51 bp, Artificial Sequence
  Description of Artificial Sequence: Synthetic oligonucleotide
gttatatggtatgatgaaagtaataaatactatgtagactccgtgaagggc

SEQ ID NO: 13600 - protein, 17 aa, Artificial Sequence
  Description of Artificial Sequence: Synthetic peptide
VIWYDESNKYYVDSVKG

SEQ ID NO: 13601 - DNA, 48 bp, Artificial Sequence
  Description of Artificial Sequence: Synthetic oligonucleotide
agtatctattacagtgggagcacctcctacaacccgtccctcaagagt

SEQ ID NO: 13602 - protein, 16 aa, Artificial Sequence
  Description of Artificial Sequence: Synthetic peptide
SIYYSGSTSYNPSLKS

SEQ ID NO: 13603 - DNA, 51 bp, Artificial Sequence; identical to SEQ ID NO: 12273
  Description of Artificial Sequence: Synthetic oligonucleotide

SEQ ID NO: 13604 - protein, 17 aa, Artificial Sequence
  Description of Artificial Sequence: Synthetic peptide
VISGSGGSTYYADSVKG

SEQ ID NO: 13605 - DNA, 51 bp, Artificial Sequence
  Description of Artificial Sequence: Synthetic oligonucleotide
gtgatatggtttgagggaagtaataaacactatacagactccgtgaagggc

SEQ ID NO: 13606 - protein, 17 aa, Artificial Sequence
  Description of Artificial Sequence: Synthetic peptide
VIWFEGSNKHYTDSVKG

SEQ ID NO: 13607 - DNA, 51 bp, Artificial Sequence; identical to SEQ ID NO: 12727
  Description of Artificial Sequence: Synthetic oligonucleotide

SEQ ID NO: 13608 - protein, 17 aa, Artificial Sequence
  Description of Artificial Sequence: Synthetic peptide
WINPNSGGTNSAQKFQG

SEQ ID NO: 13609 - DNA, 51 bp, Artificial Sequence
  Description of Artificial Sequence: Synthetic oligonucleotide
tggatcagcgcttacagtggtaacacaaactatgcacagaagctccagggc

SEQ ID NO: 13610 - protein, 17 aa, Artificial Sequence
  Description of Artificial Sequence: Synthetic peptide
WISAYSGNTNYAQKLQG

SEQ ID NO: 13611 - DNA, 51 bp, Artificial Sequence
  Description of Artificial Sequence: Synthetic oligonucleotide
gttatatggtatgatggaagtaataaatactatggagactccgtgaagggc

SEQ ID NO: 13612 - protein, 17 aa, Artificial Sequence
  Description of Artificial Sequence: Synthetic peptide
VIWYDGSNKYYGDSVKG

SEQ ID NO: 13613 - DNA, 51 bp, Artificial Sequence
  Description of Artificial Sequence: Synthetic oligonucleotide
tccattagtagtagtaatagttccatatactacgcagactcagtgaagggc

SEQ ID NO: 13614 - protein, 17 aa, Artificial Sequence
  Description of Artificial Sequence: Synthetic peptide
SISSSNSSIYYADSVKG

SEQ ID NO: 13615 - DNA, 51 bp, Artificial Sequence
  Description of Artificial Sequence: Synthetic oligonucleotide
tggatcaaccctaacagtggtggcacaaacaatgcacagaagtttcagggc

SEQ ID NO: 13616 - protein, 17 aa, Artificial Sequence
  Description of Artificial Sequence: Synthetic peptide
WINPNSGGTNNAQKFQG

SEQ ID NO: 13617 - DNA, 51 bp, Artificial Sequence
  Description of Artificial Sequence: Synthetic oligonucleotide
tggatcaaaccaaacagtggtggcacaaaccaagcacagaagttccagggc

SEQ ID NO: 13618 - protein, 17 aa, Artificial Sequence
  Description of Artificial Sequence: Synthetic peptide
WIKPNSGGTNQAQKFQG

SEQ ID NO: 13619 - DNA, 51 bp, Artificial Sequence
  Description of Artificial Sequence: Synthetic oligonucleotide
gttatatggtttgagggaagtcataaatactatacagactccgtgaagggc

SEQ ID NO: 13620 - protein, 17 aa, Artificial Sequence
  Description of Artificial Sequence: Synthetic peptide
VIWFEGSHKYYTDSVKG

SEQ ID NO: 13621 - DNA, 51 bp, Artificial Sequence
  Description of Artificial Sequence: Synthetic oligonucleotide
gttatatggcatgatggaagtgataaatactatgcagactccgtgaagggc

SEQ ID NO: 13622 - protein, 17 aa, Artificial Sequence
  Description of Artificial Sequence: Synthetic peptide
VIWHDGSDKYYADSVKG

SEQ ID NO: 13623 - DNA, 51 bp, Artificial Sequence; identical to SEQ ID NO: 13399
  Description of Artificial Sequence: Synthetic oligonucleotide

SEQ ID NO: 13624 - protein, 17 aa, Artificial Sequence
  Description of Artificial Sequence: Synthetic peptide
SISGTSSYIYYADSVKG

SEQ ID NO: 13625 - DNA, 51 bp, Artificial Sequence
  Description of Artificial Sequence: Synthetic oligonucleotide
ggtattagtggtagtggtgctagaacatactacgcagactccgtgaagggc

SEQ ID NO: 13626 - protein, 17 aa, Artificial Sequence
  Description of Artificial Sequence: Synthetic peptide
GISGSGARTYYADSVKG

SEQ ID NO: 13627 - DNA, 51 bp, Artificial Sequence; identical to SEQ ID NO: 12123
  Description of Artificial Sequence: Synthetic oligonucleotide

SEQ ID NO: 13628 - protein, 17 aa, Artificial Sequence
  Description of Artificial Sequence: Synthetic peptide
VIWYDGSNKYYADSVKG

SEQ ID NO: 13629 - DNA, 51 bp, Artificial Sequence
  Description of Artificial Sequence: Synthetic oligonucleotide
tggatcaaccctaacaatggtggcacacactatgcacagaagtttcaggac

SEQ ID NO: 13630 - protein, 17 aa, Artificial Sequence
  Description of Artificial Sequence: Synthetic peptide
WINPNNGGTHYAQKFQD

SEQ ID NO: 13631 - DNA, 51 bp, Artificial Sequence
  Description of Artificial Sequence: Synthetic oligonucleotide
gctatatggtatgatggaagtaataaatattatggagactccgtgaagggc

SEQ ID NO: 13632 - protein, 17 aa, Artificial Sequence
  Description of Artificial Sequence: Synthetic peptide
AIWYDGSNKYYGDSVKG

SEQ ID NO: 13633 - DNA, 51 bp, Artificial Sequence; identical to SEQ ID NO: 13597
  Description of Artificial Sequence: Synthetic oligonucleotide

SEQ ID NO: 13634 - protein, 17 aa, Artificial Sequence
  Description of Artificial Sequence: Synthetic peptide
WIKPNSGGTNQAQKFQG

SEQ ID NO: 13635 - DNA, 51 bp, Artificial Sequence
  Description of Artificial Sequence: Synthetic oligonucleotide
gttatattatatgatggaagtaagaaatactatgcagactccgtgaagggc

SEQ ID NO: 13636 - protein, 17 aa, Artificial Sequence
  Description of Artificial Sequence: Synthetic peptide
VILYDGSKKYYADSVKG

SEQ ID NO: 13637 - DNA, 51 bp, Artificial Sequence
  Description of Artificial Sequence: Synthetic oligonucleotide
tacattagtagaagtagtagtcacatatactacgcagactcagtgaagggc

SEQ ID NO: 13638 - protein, 17 aa, Artificial Sequence
  Description of Artificial Sequence: Synthetic peptide
YISRSSSHIYYADSVKG

SEQ ID NO: 13639 - DNA, 51 bp, Artificial Sequence
  Description of Artificial Sequence: Synthetic oligonucleotide
tccattagtggtagtagtagttacatatattacgcagactcagtgatgggc

SEQ ID NO: 13640 - protein, 17 aa, Artificial Sequence
  Description of Artificial Sequence: Synthetic peptide
SISGSSSYIYYADSVMG

SEQ ID NO: 13641 - DNA, 51 bp, Artificial Sequence; identical to SEQ ID NO: 12617
  Description of Artificial Sequence: Synthetic oligonucleotide

SEQ ID NO: 13642 - protein, 17 aa, Artificial Sequence
  Description of Artificial Sequence: Synthetic peptide
VIWYDVSNKYYADSVKG

SEQ ID NO: 13643 - DNA, 48 bp, Artificial Sequence
  Description of Artificial Sequence: Synthetic oligonucleotide
aatatctattatagtgggagcacctattacatcccgtccctcaagagt

SEQ ID NO: 13644 - protein, 16 aa, Artificial Sequence
  Description of Artificial Sequence: Synthetic peptide
NIYYSGSTYYIPSLKS

SEQ ID NO: 13645 - DNA, 51 bp, Artificial Sequence
  Description of Artificial Sequence: Synthetic oligonucleotide
gttatatggtatgatggaagtgataaatactatgcagactccgtgaagggc

SEQ ID NO: 13646 - protein, 17 aa, Artificial Sequence
  Description of Artificial Sequence: Synthetic peptide
VIWYDGSDKYYADSVKG

SEQ ID NO: 13647 - DNA, 51 bp, Artificial Sequence
  Description of Artificial Sequence: Synthetic oligonucleotide
tggatcaaccctaacagtaatgccacaaactatgcacagaagtttcagggc

SEQ ID NO: 13648 - protein, 17 aa, Artificial Sequence
  Description of Artificial Sequence: Synthetic peptide
WINPNSNATNYAQKFQG

SEQ ID NO: 13649 - DNA, 51 bp, Artificial Sequence; identical to SEQ ID NO: 12123
  Description of Artificial Sequence: Synthetic oligonucleotide

SEQ ID NO: 13650 - protein, 17 aa, Artificial Sequence
  Description of Artificial Sequence: Synthetic peptide
VIWYDGSNKYYADSVKG

SEQ ID NO: 13651 - DNA, 51 bp, Artificial Sequence
  Description of Artificial Sequence: Synthetic oligonucleotide
tggatcaaccctaagagtggtggcacaaactctgcacagaagtttcagggc

SEQ ID NO: 13652 - protein, 17 aa, Artificial Sequence
  Description of Artificial Sequence: Synthetic peptide
WINPKSGGTNSAQKFQG

SEQ ID NO: 13653 - DNA, 51 bp, Artificial Sequence; identical to SEQ ID NO: 12263
  Description of Artificial Sequence: Synthetic oligonucleotide

SEQ ID NO: 13654 - protein, 17 aa, Artificial Sequence
  Description of Artificial Sequence: Synthetic peptide
VIWHDGSNKYYADSVKG

SEQ ID NO: 13655 - DNA, 51 bp, Artificial Sequence; identical to SEQ ID NO: 12161
  Description of Artificial Sequence: Synthetic oligonucleotide

SEQ ID NO: 13656 - protein, 17 aa, Artificial Sequence
  Description of Artificial Sequence: Synthetic peptide
WMHPNSGNTGYAQKFQG

SEQ ID NO: 13657 - DNA, 51 bp, Artificial Sequence; identical to SEQ ID NO: 13483
  Description of Artificial Sequence: Synthetic oligonucleotide

SEQ ID NO: 13658 - protein, 17 aa, Artificial Sequence
  Description of Artificial Sequence: Synthetic peptide
IIWYDESNKYYADSVKG

SEQ ID NO: 13659 - DNA, 51 bp, Artificial Sequence
  Description of Artificial Sequence: Synthetic oligonucleotide
tggatcaaacctaacagtggtggcacaaaccaagcacagaagtttcagggc

SEQ ID NO: 13660 - protein, 17 aa, Artificial Sequence
  Description of Artificial Sequence: Synthetic peptide
WIKPNSGGTNQAQKFQG

SEQ ID NO: 13661 - DNA, 51 bp, Artificial Sequence; identical to SEQ ID NO: 13597
  Description of Artificial Sequence: Synthetic oligonucleotide

SEQ ID NO: 13662 - protein, 17 aa, Artificial Sequence
  Description of Artificial Sequence: Synthetic peptide
WIKPNSGGTNQAQKFQG

SEQ ID NO: 13663 - DNA, 51 bp, Artificial Sequence
  Description of Artificial Sequence: Synthetic oligonucleotide
tccattagtggtaatagtacttacatatactacacagactcagtgaagggc

SEQ ID NO: 13664 - protein, 17 aa, Artificial Sequence
  Description of Artificial Sequence: Synthetic peptide
SISGNSTYIYYTDSVKG

SEQ ID NO: 13665 - DNA, 51 bp, Artificial Sequence
  Description of Artificial Sequence: Synthetic oligonucleotide
gtgatatggtatgatgaaagtaataaatactatgcagactccgtgaagggc

SEQ ID NO: 13666 - protein, 17 aa, Artificial Sequence
  Description of Artificial Sequence: Synthetic peptide
VIWYDESNKYYADSVKG

SEQ ID NO: 13667 - DNA, 51 bp, Artificial Sequence; identical to SEQ ID NO: 13491
  Description of Artificial Sequence: Synthetic oligonucleotide

SEQ ID NO: 13668 - protein, 17 aa, Artificial Sequence
  Description of Artificial Sequence: Synthetic peptide
WMHPNSGSTGYAQKFQG

SEQ ID NO: 13669 - DNA, 51 bp, Artificial Sequence
  Description of Artificial Sequence: Synthetic oligonucleotide
gttatttggtatgatagaacaaataaatactatgcagactccgtgaagggc

SEQ ID NO: 13670 - protein, 17 aa, Artificial Sequence
  Description of Artificial Sequence: Synthetic peptide
VIWYDRTNKYYADSVKG

SEQ ID NO: 13671 - DNA, 51 bp, Artificial Sequence; identical to SEQ ID NO: 13399
  Description of Artificial Sequence: Synthetic oligonucleotide

SEQ ID NO: 13672 - protein, 17 aa, Artificial Sequence
  Description of Artificial Sequence: Synthetic peptide
SISGTSSYIYYADSVKG

SEQ ID NO: 13673 - DNA, 51 bp, Artificial Sequence; identical to SEQ ID NO: 12727
  Description of Artificial Sequence: Synthetic oligonucleotide

SEQ ID NO: 13674 - protein, 17 aa, Artificial Sequence
  Description of Artificial Sequence: Synthetic peptide
WINPNSGGTNSAQKFQG

SEQ ID NO: 13675 - DNA, 51 bp, Artificial Sequence
  Description of Artificial Sequence: Synthetic oligonucleotide
gttatatggtatgatagaaataataaatactatggagactccgtgaagggc

SEQ ID NO: 13676 - protein, 17 aa, Artificial Sequence
  Description of Artificial Sequence: Synthetic peptide
VIWYDRNNKYYGDSVKG

SEQ ID NO: 13677 - DNA, 51 bp, Artificial Sequence
  Description of Artificial Sequence: Synthetic oligonucleotide
actattagtggtagtggtggttacacatactccgcagactccgtgaagggc

SEQ ID NO: 13678 - protein, 17 aa, Artificial Sequence
  Description of Artificial Sequence: Synthetic peptide
TISGSGGYTYSADSVKG

SEQ ID NO: 13679 - DNA, 51 bp, Artificial Sequence
  Description of Artificial Sequence: Synthetic oligonucleotide
gttatatggtttgatgaaagtaataaatactatgcagactccgtgaagggc

SEQ ID NO: 13680 - protein, 17 aa, Artificial Sequence
  Description of Artificial Sequence: Synthetic peptide
VIWFDESNKYYADSVKG

SEQ ID NO: 13681 - DNA, 51 bp, Artificial Sequence
  Description of Artificial Sequence: Synthetic oligonucleotide
tggatcaaccctaaaagtggtggcacaaattatgtacagaagtttcagggc

SEQ ID NO: 13682 - protein, 17 aa, Artificial Sequence
  Description of Artificial Sequence: Synthetic peptide
WINPKSGGTNYVQKFQG

SEQ ID NO: 13683 - DNA, 51 bp, Artificial Sequence
  Description of Artificial Sequence: Synthetic oligonucleotide
tggatcaaccctaaaagtggtggcacgaatcatgtccagaagtttcagggc

SEQ ID NO: 13684 - protein, 17 aa, Artificial Sequence
  Description of Artificial Sequence: Synthetic peptide
WINPKSGGTNHVQKFQG

SEQ ID NO: 13685 - DNA, 51 bp, Artificial Sequence
  Description of Artificial Sequence: Synthetic oligonucleotide
gttatattatatgatggaagtaagaaatactatgcagcctccgtgaagggc

SEQ ID NO: 13686 - protein, 17 aa, Artificial Sequence
  Description of Artificial Sequence: Synthetic peptide
VILYDGSKKYYAASVKG

SEQ ID NO: 13687 - DNA, 51 bp, Artificial Sequence
  Description of Artificial Sequence: Synthetic oligonucleotide
gacattagtcgtagtggtggtaccacattctacgcagactccgtgaagggc

SEQ ID NO: 13688 - protein, 17 aa, Artificial Sequence
  Description of Artificial Sequence: Synthetic peptide
DISRSGGTTFYADSVKG

SEQ ID NO: 13689 - DNA, 51 bp, Artificial Sequence; identical to SEQ ID NO: 12123
  Description of Artificial Sequence: Synthetic oligonucleotide

SEQ ID NO: 13690 - protein, 17 aa, Artificial Sequence
  Description of Artificial Sequence: Synthetic peptide
VIWYDGSNKYYADSVKG

SEQ ID NO: 13691 - DNA, 48 bp, Artificial Sequence
  Description of Artificial Sequence: Synthetic oligonucleotide
gaaatcaatcttagtggaagtaccaactacaacccgtccctcaagagt

SEQ ID NO: 13692 - protein, 16 aa, Artificial Sequence
  Description of Artificial Sequence: Synthetic peptide
EINLSGSTNYNPSLKS

SEQ ID NO: 13693 - DNA, 48 bp, Artificial Sequence
  Description of Artificial Sequence: Synthetic oligonucleotide
gaaatcaatcatagtggaagaaccaactacaacccgtccctcaagagt

SEQ ID NO: 13694 - protein, 16 aa, Artificial Sequence
  Description of Artificial Sequence: Synthetic peptide
EINHSGRTNYNPSLKS

SEQ ID NO: 13695 - DNA, 51 bp, Artificial Sequence
  Description of Artificial Sequence: Synthetic oligonucleotide
tggatgaaccctaacagtggtaacacaggctgtgcacagaagttccagggc

SEQ ID NO: 13696 - protein, 17 aa, Artificial Sequence
  Description of Artificial Sequence: Synthetic peptide
WMNPNSGNTGCAQKFQG

SEQ ID NO: 13697 - DNA, 51 bp, Artificial Sequence; identical to SEQ ID NO: 12159
  Description of Artificial Sequence: Synthetic oligonucleotide

SEQ ID NO: 13698 - protein, 17 aa, Artificial Sequence
  Description of Artificial Sequence: Synthetic peptide
WMHPNSGNTGYAQKFRG

SEQ ID NO: 13699 - DNA, 51 bp, Artificial Sequence; identical to SEQ ID NO: 12161
  Description of Artificial Sequence: Synthetic oligonucleotide

SEQ ID NO: 13700 - protein, 17 aa, Artificial Sequence
  Description of Artificial Sequence: Synthetic peptide
WMHPNSGNTGYAQKFQG

SEQ ID NO: 13701 - DNA, 51 bp, Artificial Sequence
  Description of Artificial Sequence: Synthetic oligonucleotide
tggatgcaccctaacagtggtaacacaggctttgcacagaagttccagggc

SEQ ID NO: 13702 - protein, 17 aa, Artificial Sequence
  Description of Artificial Sequence: Synthetic peptide
WMHPNSGNTGFAQKFQG

SEQ ID NO: 13703 - DNA, 51 bp, Artificial Sequence; identical to SEQ ID NO: 12103
  Description of Artificial Sequence: Synthetic oligonucleotide

SEQ ID NO: 13704 - protein, 17 aa, Artificial Sequence
  Description of Artificial Sequence: Synthetic peptide
WMNPNSGNTGYAQKFQG

SEQ ID NO: 13705 - DNA, 51 bp, Artificial Sequence
  Description of Artificial Sequence: Synthetic oligonucleotide
gttatttggtatgatggaagtaataaatactatgcagactccgtgaagggc

SEQ ID NO: 13706 - protein, 17 aa, Artificial Sequence
  Description of Artificial Sequence: Synthetic peptide
VIWYDGSNKYYADSVKG

SEQ ID NO: 13707 - DNA, 51 bp, Artificial Sequence; identical to SEQ ID NO: 12103
  Description of Artificial Sequence: Synthetic oligonucleotide

SEQ ID NO: 13708 - protein, 17 aa, Artificial Sequence
  Description of Artificial Sequence: Synthetic peptide
WMNPNSGNTGYAQKFQG

SEQ ID NO: 13709 - DNA, 48 bp, Artificial Sequence
  Description of Artificial Sequence: Synthetic oligonucleotide
agtatctattatagtggatacacctcctacaacccgtccctcaagagt

SEQ ID NO: 13710 - protein, 16 aa, Artificial Sequence
  Description of Artificial Sequence: Synthetic peptide
SIYYSGYTSYNPSLKS

SEQ ID NO: 13711 - DNA, 51 bp, Artificial Sequence; identical to SEQ ID NO: 12103
  Description of Artificial Sequence: Synthetic oligonucleotide

SEQ ID NO: 13712 - protein, 17 aa, Artificial Sequence
  Description of Artificial Sequence: Synthetic peptide
WMNPNSGNTGYAQKFQG

SEQ ID NO: 13713 - DNA, 48 bp, Artificial Sequence
  Description of Artificial Sequence: Synthetic oligonucleotide
gaaatcaatcatagtggaagcaccaactacaacccgtccctcacgagt

SEQ ID NO: 13714 - protein, 16 aa, Artificial Sequence
  Description of Artificial Sequence: Synthetic peptide
EINHSGSTNYNPSLTS

SEQ ID NO: 13715 - DNA, 48 bp, Artificial Sequence
  Description of Artificial Sequence: Synthetic oligonucleotide
gaaatcaatcatagtggaagcaccaactacaacccgtccctcaagagt

SEQ ID NO: 13716 - protein, 16 aa, Artificial Sequence
  Description of Artificial Sequence: Synthetic peptide
EINHSGSTNYNPSLKS

SEQ ID NO: 13717 - DNA, 48 bp, Artificial Sequence; identical to SEQ ID NO: 13715
  Description of Artificial Sequence: Synthetic oligonucleotide

SEQ ID NO: 13718 - protein, 16 aa, Artificial Sequence
  Description of Artificial Sequence: Synthetic peptide
EINHSGSTNYNPSLKS

SEQ ID NO: 13719 - DNA, 48 bp, Artificial Sequence
  Description of Artificial Sequence: Synthetic oligonucleotide
ggtatctattatagtgggagcacctcctacaacccgtccctcaagagt

SEQ ID NO: 13720 - protein, 16 aa, Artificial Sequence
  Description of Artificial Sequence: Synthetic peptide
GIYYSGSTSYNPSLKS

SEQ ID NO: 13721 - DNA, 48 bp, Artificial Sequence
  Description of Artificial Sequence: Synthetic oligonucleotide
gaaatcaatcatagtggatgcaccaacttcaacccgtccctcaagagt

SEQ ID NO: 13722 - protein, 16 aa, Artificial Sequence
  Description of Artificial Sequence: Synthetic peptide
EINHSGCTNFNPSLKS

SEQ ID NO: 13723 - DNA, 51 bp, Artificial Sequence; identical to SEQ ID NO: 12103
  Description of Artificial Sequence: Synthetic oligonucleotide

SEQ ID NO: 13724 - protein, 17 aa, Artificial Sequence
  Description of Artificial Sequence: Synthetic peptide
WMNPNSGNTGYAQKFQG

SEQ ID NO: 13725 - DNA, 51 bp, Artificial Sequence; identical to SEQ ID NO: 12161
  Description of Artificial Sequence: Synthetic oligonucleotide

SEQ ID NO: 13726 - protein, 17 aa, Artificial Sequence
  Description of Artificial Sequence: Synthetic peptide
WMHPNSGNTGYAQKFQG

SEQ ID NO: 13727 - DNA, 51 bp, Artificial Sequence
  Description of Artificial Sequence: Synthetic oligonucleotide
tggatgcaccctaacaatggtaacacaggctatgcacagaagttccagggc

SEQ ID NO: 13728 - protein, 17 aa, Artificial Sequence
  Description of Artificial Sequence: Synthetic peptide
WMHPNNGNTGYAQKFQG

SEQ ID NO: 13729 - DNA, 51 bp, Artificial Sequence; identical to SEQ ID NO: 12161
  Description of Artificial Sequence: Synthetic oligonucleotide

SEQ ID NO: 13730 - protein, 17 aa, Artificial Sequence
  Description of Artificial Sequence: Synthetic peptide
WMHPNSGNTGYAQKFQG

SEQ ID NO: 13731 - DNA, 48 bp, Artificial Sequence
  Description of Artificial Sequence: Synthetic oligonucleotide
gaaatcaatcatagtggaaggaccaactacaacccgtccctcaagagt

SEQ ID NO: 13732 - protein, 16 aa, Artificial Sequence
  Description of Artificial Sequence: Synthetic peptide
EINHSGRTNYNPSLKS

SEQ ID NO: 13733 - DNA, 48 bp, Artificial Sequence
  Description of Artificial Sequence: Synthetic oligonucleotide
gaaatcaatcttagtggaagcaccaactacaacccgtccctcaagagt

SEQ ID NO: 13734 - protein, 16 aa, Artificial Sequence
  Description of Artificial Sequence: Synthetic peptide
EINLSGSTNYNPSLKS

SEQ ID NO: 13735 - DNA, 48 bp, Artificial Sequence
  Description of Artificial Sequence: Synthetic oligonucleotide
gaaatcaattatagtggaagaaccaactacaacccgtccctcaagagt

SEQ ID NO: 13736 - protein, 16 aa, Artificial Sequence
  Description of Artificial Sequence: Synthetic peptide
EINYSGRTNYNPSLKS

SEQ ID NO: 13737 - DNA, 51 bp, Artificial Sequence; identical to SEQ ID NO: 12103
  Description of Artificial Sequence: Synthetic oligonucleotide

SEQ ID NO: 13738 - protein, 17 aa, Artificial Sequence
  Description of Artificial Sequence: Synthetic peptide
WMNPNSGNTGYAQKFQG

SEQ ID NO: 13739 - DNA, 51 bp, Artificial Sequence; identical to SEQ ID NO: 12161
  Description of Artificial Sequence: Synthetic oligonucleotide

SEQ ID NO: 13740 - protein, 17 aa, Artificial Sequence
  Description of Artificial Sequence: Synthetic peptide
WMHPNSGNTGYAQKFQG

SEQ ID NO: 13741 - DNA, 57 bp, Artificial Sequence
  Description of Artificial Sequence: Synthetic oligonucleotide
cgtattaaaaacaaagctgatggtgggacaacagacttcgctgcacccgtgaaaggc

SEQ ID NO: 13742 - protein, 19 aa, Artificial Sequence
  Description of Artificial Sequence: Synthetic peptide
RIKNKADGGTTDFAAPVKG

SEQ ID NO: 13743 - DNA, 48 bp, Artificial Sequence; identical to SEQ ID NO: 13715
  Description of Artificial Sequence: Synthetic oligonucleotide

SEQ ID NO: 13744 - protein, 16 aa, Artificial Sequence
  Description of Artificial Sequence: Synthetic peptide
EINHSGSTNYNPSLKS

SEQ ID NO: 13745 - DNA, 51 bp, Artificial Sequence
  Description of Artificial Sequence: Synthetic oligonucleotide
gttatatggtatgatggaagtaataaaaactatgcagactccgtgaagggc

SEQ ID NO: 13746 - protein, 17 aa, Artificial Sequence
  Description of Artificial Sequence: Synthetic peptide
VIWYDGSNKNYADSVKG

SEQ ID NO: 13747 - DNA, 51 bp, Artificial Sequence; identical to SEQ ID NO: 13705
  Description of Artificial Sequence: Synthetic oligonucleotide

SEQ ID NO: 13748 - protein, 17 aa, Artificial Sequence
  Description of Artificial Sequence: Synthetic peptide
VIWYDGSNKYYADSVKG

SEQ ID NO: 13749 - DNA, 48 bp, Artificial Sequence
  Description of Artificial Sequence: Synthetic oligonucleotide
gaaatcaatcatagtggagacaccaactacaacccgtccctcaagagt

SEQ ID NO: 13750 - protein, 16 aa, Artificial Sequence
  Description of Artificial Sequence: Synthetic peptide
EINHSGDTNYNPSLKS

SEQ ID NO: 13751 - DNA, 48 bp, Artificial Sequence
  Description of Artificial Sequence: Synthetic oligonucleotide
gaaatcaatcatagtggaaggaccaacttcaacccgtccctcaagagt

SEQ ID NO: 13752 - protein, 16 aa, Artificial Sequence
  Description of Artificial Sequence: Synthetic peptide
EINHSGRTNFNPSLKS

SEQ ID NO: 13753 - DNA, 51 bp, Artificial Sequence; identical to SEQ ID NO: 12103
  Description of Artificial Sequence: Synthetic oligonucleotide

SEQ ID NO: 13754 - protein, 17 aa, Artificial Sequence
  Description of Artificial Sequence: Synthetic peptide
WMNPNSGNTGYAQKFQG

SEQ ID NO: 13755 - DNA, 51 bp, Artificial Sequence
  Description of Artificial Sequence: Synthetic oligonucleotide
tggatgcatcctaacagtggtaacacaggctatgcacagaagttccagggc

SEQ ID NO: 13756 - protein, 17 aa, Artificial Sequence
  Description of Artificial Sequence: Synthetic peptide
WMHPNSGNTGYAQKFQG

SEQ ID NO: 13757 - DNA, 48 bp, Artificial Sequence; identical to SEQ ID NO: 13715
  Description of Artificial Sequence: Synthetic oligonucleotide

SEQ ID NO: 13758 - protein, 16 aa, Artificial Sequence
  Description of Artificial Sequence: Synthetic peptide
EINHSGSTNYNPSLKS

SEQ ID NO: 13759 - DNA, 48 bp, Artificial Sequence; identical to SEQ ID NO: 13715
  Description of Artificial Sequence: Synthetic oligonucleotide

SEQ ID NO: 13760 - protein, 16 aa, Artificial Sequence
  Description of Artificial Sequence: Synthetic peptide
EINHSGSTNYNPSLKS

SEQ ID NO: 13761 - DNA, 48 bp, Artificial Sequence
  Description of Artificial Sequence: Synthetic oligonucleotide
gctattggtactgctggtgacacatactatccaggctccgtgaagggc

SEQ ID NO: 13762 - protein, 16 aa, Artificial Sequence
  Description of Artificial Sequence: Synthetic peptide
AIGTAGDTYYPGSVKG

SEQ ID NO: 13763 - DNA, 48 bp, Artificial Sequence
  Description of Artificial Sequence: Synthetic oligonucleotide
gaaatcaatcacagtggaagcaccaactacaacccgtccctcaagagt

SEQ ID NO: 13764 - protein, 16 aa, Artificial Sequence
  Description of Artificial Sequence: Synthetic peptide
EINHSGSTNYNPSLKS

SEQ ID NO: 13765 - DNA, 51 bp, Artificial Sequence; identical to SEQ ID NO: 13257
  Description of Artificial Sequence: Synthetic oligonucleotide

SEQ ID NO: 13766 - protein, 17 aa, Artificial Sequence
  Description of Artificial Sequence: Synthetic peptide
VIWYDGRNKYYADSVKG

SEQ ID NO: 13767 - DNA, 48 bp, Artificial Sequence; identical to SEQ ID NO: 13731
  Description of Artificial Sequence: Synthetic oligonucleotide

SEQ ID NO: 13768 - protein, 16 aa, Artificial Sequence
  Description of Artificial Sequence: Synthetic peptide
EINHSGRTNYNPSLKS

SEQ ID NO: 13769 - DNA, 51 bp, Artificial Sequence
  Description of Artificial Sequence: Synthetic oligonucleotide
gttatatggtatgatggaagtaatcaaaactatgcagactccgtgaagggc

SEQ ID NO: 13770 - protein, 17 aa, Artificial Sequence
  Description of Artificial Sequence: Synthetic peptide
VIWYDGSNQNYADSVKG

SEQ ID NO: 13771 - DNA, 51 bp, Artificial Sequence; identical to SEQ ID NO: 12103
  Description of Artificial Sequence: Synthetic oligonucleotide

SEQ ID NO: 13772 - protein, 17 aa, Artificial Sequence
  Description of Artificial Sequence: Synthetic peptide
WMNPNSGNTGYAQKFQG

SEQ ID NO: 13773 - DNA, 48 bp, Artificial Sequence; identical to SEQ ID NO: 13715
  Description of Artificial Sequence: Synthetic oligonucleotide

SEQ ID NO: 13774 - protein, 16 aa, Artificial Sequence
  Description of Artificial Sequence: Synthetic peptide
EINHSGSTNYNPSLKS

SEQ ID NO: 13775 - DNA, 48 bp, Artificial Sequence; identical to SEQ ID NO: 13715
  Description of Artificial Sequence: Synthetic oligonucleotide

SEQ ID NO: 13776 - protein, 16 aa, Artificial Sequence
  Description of Artificial Sequence: Synthetic peptide
EINHSGSTNYNPSLKS

SEQ ID NO: 13777 - DNA, 51 bp, Artificial Sequence; identical to SEQ ID NO: 13727
  Description of Artificial Sequence: Synthetic oligonucleotide

SEQ ID NO: 13778 - protein, 17 aa, Artificial Sequence
  Description of Artificial Sequence: Synthetic peptide
WMHPNNGNTGYAQKFQG

SEQ ID NO: 13779 - DNA, 48 bp, Artificial Sequence; identical to SEQ ID NO: 13735
  Description of Artificial Sequence: Synthetic oligonucleotide

SEQ ID NO: 13780 - protein, 16 aa, Artificial Sequence
  Description of Artificial Sequence: Synthetic peptide
EINYSGRTNYNPSLKS

SEQ ID NO: 13781 - DNA, 51 bp, Artificial Sequence; identical to SEQ ID NO: 12161
  Description of Artificial Sequence: Synthetic oligonucleotide

SEQ ID NO: 13782 - protein, 17 aa, Artificial Sequence
  Description of Artificial Sequence: Synthetic peptide
WMHPNSGNTGYAQKFQG

SEQ ID NO: 13783 - DNA, 48 bp, Artificial Sequence; identical to SEQ ID NO: 13735
  Description of Artificial Sequence: Synthetic oligonucleotide

SEQ ID NO: 13784 - protein, 16 aa, Artificial Sequence
  Description of Artificial Sequence: Synthetic peptide
EINYSGRTNYNPSLKS

SEQ ID NO: 13785 - DNA, 51 bp, Artificial Sequence; identical to SEQ ID NO: 12161
  Description of Artificial Sequence: Synthetic oligonucleotide

SEQ ID NO: 13786 - protein, 17 aa, Artificial Sequence
  Description of Artificial Sequence: Synthetic peptide
WMHPNSGNTGYAQKFQG

SEQ ID NO: 13787 - DNA, 51 bp, Artificial Sequence; identical to SEQ ID NO: 12161
  Description of Artificial Sequence: Synthetic oligonucleotide

SEQ ID NO: 13788 - protein, 17 aa, Artificial Sequence
  Description of Artificial Sequence: Synthetic peptide
WMHPNSGNTGYAQKFQG

SEQ ID NO: 13789 - DNA, 48 bp, Artificial Sequence
  Description of Artificial Sequence: Synthetic oligonucleotide
gaaatcaattataggggaagcaccaactacaacccgtccctcaagagt

SEQ ID NO: 13790 - protein, 16 aa, Artificial Sequence
  Description of Artificial Sequence: Synthetic peptide
EINYRGSTNYNPSLKS

SEQ ID NO: 13791 - DNA, 51 bp, Artificial Sequence; identical to SEQ ID NO: 12103
  Description of Artificial Sequence: Synthetic oligonucleotide

SEQ ID NO: 13792 - protein, 17 aa, Artificial Sequence
  Description of Artificial Sequence: Synthetic peptide
WMNPNSGNTGYAQKFQG

SEQ ID NO: 13793 - DNA, 51 bp, Artificial Sequence; identical to SEQ ID NO: 13745
  Description of Artificial Sequence: Synthetic oligonucleotide

SEQ ID NO: 13794 - protein, 17 aa, Artificial Sequence
  Description of Artificial Sequence: Synthetic peptide
VIWYDGSNKNYADSVKG

SEQ ID NO: 13795 - DNA, 51 bp, Artificial Sequence
  Description of Artificial Sequence: Synthetic oligonucleotide
tggatgcaccctaatagtggtaacacaggctatgcacagaagttccagggc

SEQ ID NO: 13796 - protein, 17 aa, Artificial Sequence
  Description of Artificial Sequence: Synthetic peptide
WMHPNSGNTGYAQKFQG

SEQ ID NO: 13797 - DNA, 51 bp, Artificial Sequence; identical to SEQ ID NO: 12161
  Description of Artificial Sequence: Synthetic oligonucleotide

SEQ ID NO: 13798 - protein, 17 aa, Artificial Sequence
  Description of Artificial Sequence: Synthetic peptide
WMHPNSGNTGYAQKFQG

SEQ ID NO: 13799 - DNA, 51 bp, Artificial Sequence; identical to SEQ ID NO: 13557
  Description of Artificial Sequence: Synthetic oligonucleotide

SEQ ID NO: 13800 - protein, 17 aa, Artificial Sequence
  Description of Artificial Sequence: Synthetic peptide
VIWYDGSNKYHADSVKG

SEQ ID NO: 13801 - DNA, 51 bp, Artificial Sequence
  Description of Artificial Sequence: Synthetic oligonucleotide
gctatttggtatgatggaagtaataaatactgtgcagactccgtgaagggc

SEQ ID NO: 13802 - protein, 17 aa, Artificial Sequence
  Description of Artificial Sequence: Synthetic peptide
AIWYDGSNKYCADSVKG

SEQ ID NO: 13803 - DNA, 57 bp, Artificial Sequence
  Description of Artificial Sequence: Synthetic oligonucleotide
cgtattaaaaacaaagctgatggtgggacaacagactacgctgcacccgtgaaaggc

SEQ ID NO: 13804 - protein, 19 aa, Artificial Sequence
  Description of Artificial Sequence: Synthetic peptide
RIKNKADGGTTDYAAPVKG

SEQ ID NO: 13805 - DNA, 51 bp, Artificial Sequence; identical to SEQ ID NO: 12161
  Description of Artificial Sequence: Synthetic oligonucleotide

SEQ ID NO: 13806 - protein, 17 aa, Artificial Sequence
  Description of Artificial Sequence: Synthetic peptide
WMHPNSGNTGYAQKFQG

SEQ ID NO: 13807 - DNA, 48 bp, Artificial Sequence; identical to SEQ ID NO: 13733
  Description of Artificial Sequence: Synthetic oligonucleotide

SEQ ID NO: 13808 - protein, 16 aa, Artificial Sequence
  Description of Artificial Sequence: Synthetic peptide
EINLSGSTNYNPSLKS

SEQ ID NO: 13809 - DNA, 51 bp, Artificial Sequence; identical to SEQ ID NO: 12103
  Description of Artificial Sequence: Synthetic oligonucleotide

SEQ ID NO: 13810 - protein, 17 aa, Artificial Sequence
  Description of Artificial Sequence: Synthetic peptide
WMNPNSGNTGYAQKFQG

SEQ ID NO: 13811 - DNA, 51 bp, Artificial Sequence; identical to SEQ ID NO: 13695
  Description of Artificial Sequence: Synthetic oligonucleotide

SEQ ID NO: 13812 - protein, 17 aa, Artificial Sequence
  Description of Artificial Sequence: Synthetic peptide
WMNPNSGNTGCAQKFQG

SEQ ID NO: 13813 - DNA, 51 bp, Artificial Sequence; identical to SEQ ID NO: 12103
  Description of Artificial Sequence: Synthetic oligonucleotide

SEQ ID NO: 13814 - protein, 17 aa, Artificial Sequence
  Description of Artificial Sequence: Synthetic peptide
WMNPNSGNTGYAQKFQG

SEQ ID NO: 13815 - DNA, 51 bp, Artificial Sequence; identical to SEQ ID NO: 12103
  Description of Artificial Sequence: Synthetic oligonucleotide

SEQ ID NO: 13816 - protein, 17 aa, Artificial Sequence
  Description of Artificial Sequence: Synthetic peptide
WMNPNSGNTGYAQKFQG

SEQ ID NO: 13817 - DNA, 48 bp, Artificial Sequence; identical to SEQ ID NO: 13715
  Description of Artificial Sequence: Synthetic oligonucleotide

SEQ ID NO: 13818 - protein, 16 aa, Artificial Sequence
  Description of Artificial Sequence: Synthetic peptide
EINHSGSTNYNPSLKS

SEQ ID NO: 13819 - DNA, 48 bp, Artificial Sequence; identical to SEQ ID NO: 13715
  Description of Artificial Sequence: Synthetic oligonucleotide

SEQ ID NO: 13820 - protein, 16 aa, Artificial Sequence
  Description of Artificial Sequence: Synthetic peptide
EINHSGSTNYNPSLKS

SEQ ID NO: 13821 - DNA, 51 bp, Artificial Sequence; identical to SEQ ID NO: 12161
  Description of Artificial Sequence: Synthetic oligonucleotide

SEQ ID NO: 13822 - protein, 17 aa, Artificial Sequence
  Description of Artificial Sequence: Synthetic peptide
WMHPNSGNTGYAQKFQG

SEQ ID NO: 13823 - DNA, 51 bp, Artificial Sequence; identical to SEQ ID NO: 13769
  Description of Artificial Sequence: Synthetic oligonucleotide

SEQ ID NO: 13824 - protein, 17 aa, Artificial Sequence
  Description of Artificial Sequence: Synthetic peptide
VIWYDGSNQNYADSVKG

SEQ ID NO: 13825 - DNA, 57 bp, Artificial Sequence
  Description of Artificial Sequence: Synthetic oligonucleotide
cgaattaaaaacaaaattgatggtgggacaacagactacgctgcacccgtgaaaggc

SEQ ID NO: 13826 - protein, 19 aa, Artificial Sequence
  Description of Artificial Sequence: Synthetic peptide
RIKNKIDGGTTDYAAPVKG

SEQ ID NO: 13827 - DNA, 51 bp, Artificial Sequence; identical to SEQ ID NO: 13705
  Description of Artificial Sequence: Synthetic oligonucleotide

SEQ ID NO: 13828 - protein, 17 aa, Artificial Sequence
  Description of Artificial Sequence: Synthetic peptide
VIWYDGSNKYYADSVKG

SEQ ID NO: 13829 - DNA, 51 bp, Artificial Sequence; identical to SEQ ID NO: 13701
  Description of Artificial Sequence: Synthetic oligonucleotide

SEQ ID NO: 13830 - protein, 17 aa, Artificial Sequence
  Description of Artificial Sequence: Synthetic peptide
WMHPNSGNTGFAQKFQG

SEQ ID NO: 13831 - DNA, 51 bp, Artificial Sequence; identical to SEQ ID NO: 12161
  Description of Artificial Sequence: Synthetic oligonucleotide

SEQ ID NO: 13832 - protein, 17 aa, Artificial Sequence
  Description of Artificial Sequence: Synthetic peptide
WMHPNSGNTGYAQKFQG

SEQ ID NO: 13833 - DNA, 51 bp, Artificial Sequence; identical to SEQ ID NO: 13755
  Description of Artificial Sequence: Synthetic oligonucleotide

SEQ ID NO: 13834 - protein, 17 aa, Artificial Sequence
  Description of Artificial Sequence: Synthetic peptide
WMHPNSGNTGYAQKFQG

SEQ ID NO: 13835 - DNA, 48 bp, Artificial Sequence; identical to SEQ ID NO: 13715
  Description of Artificial Sequence: Synthetic oligonucleotide

SEQ ID NO: 13836 - protein, 16 aa, Artificial Sequence
  Description of Artificial Sequence: Synthetic peptide
EINHSGSTNYNPSLKS

SEQ ID NO: 13837 - DNA, 51 bp, Artificial Sequence; identical to SEQ ID NO: 12103
  Description of Artificial Sequence: Synthetic oligonucleotide

SEQ ID NO: 13838 - protein, 17 aa, Artificial Sequence
  Description of Artificial Sequence: Synthetic peptide
WMNPNSGNTGYAQKFQG

SEQ ID NO: 13839 - DNA, 48 bp, Artificial Sequence; identical to SEQ ID NO: 13789
  Description of Artificial Sequence: Synthetic oligonucleotide

SEQ ID NO: 13840 - protein, 16 aa, Artificial Sequence
  Description of Artificial Sequence: Synthetic peptide
EINYRGSTNYNPSLKS

SEQ ID NO: 13841 - DNA, 48 bp, Artificial Sequence; identical to SEQ ID NO: 13715
  Description of Artificial Sequence: Synthetic oligonucleotide

SEQ ID NO: 13842 - protein, 16 aa, Artificial Sequence
  Description of Artificial Sequence: Synthetic peptide
EINHSGSTNYNPSLKS

SEQ ID NO: 13843 - DNA, 51 bp, Artificial Sequence; identical to SEQ ID NO: 12103
  Description of Artificial Sequence: Synthetic oligonucleotide

SEQ ID NO: 13844 - protein, 17 aa, Artificial Sequence
  Description of Artificial Sequence: Synthetic peptide
WMNPNSGNTGYAQKFQG

SEQ ID NO: 13845 - DNA, 48 bp, Artificial Sequence; identical to SEQ ID NO: 13715
  Description of Artificial Sequence: Synthetic oligonucleotide

SEQ ID NO: 13846 - protein, 16 aa, Artificial Sequence
  Description of Artificial Sequence: Synthetic peptide
EINHSGSTNYNPSLKS

SEQ ID NO: 13847 - DNA, 48 bp, Artificial Sequence; identical to SEQ ID NO: 13715
  Description of Artificial Sequence: Synthetic oligonucleotide

SEQ ID NO: 13848 - protein, 16 aa, Artificial Sequence
  Description of Artificial Sequence: Synthetic peptide
EINHSGSTNYNPSLKS

SEQ ID NO: 13849 - DNA, 48 bp, Artificial Sequence; identical to SEQ ID NO: 13715
  Description of Artificial Sequence: Synthetic oligonucleotide

SEQ ID NO: 13850 - protein, 16 aa, Artificial Sequence
  Description of Artificial Sequence: Synthetic peptide
EINHSGSTNYNPSLKS

SEQ ID NO: 13851 - DNA, 51 bp, Artificial Sequence; identical to SEQ ID NO: 12161
  Description of Artificial Sequence: Synthetic oligonucleotide

SEQ ID NO: 13852 - protein, 17 aa, Artificial Sequence
  Description of Artificial Sequence: Synthetic peptide
WMHPNSGNTGYAQKFQG

SEQ ID NO: 13853 - DNA, 51 bp, Artificial Sequence; identical to SEQ ID NO: 12161
  Description of Artificial Sequence: Synthetic oligonucleotide

SEQ ID NO: 13854 - protein, 17 aa, Artificial Sequence
  Description of Artificial Sequence: Synthetic peptide
WMHPNSGNTGYAQKFQG

SEQ ID NO: 13855 - DNA, 48 bp, Artificial Sequence; identical to SEQ ID NO: 13715
  Description of Artificial Sequence: Synthetic oligonucleotide

SEQ ID NO: 13856 - protein, 16 aa, Artificial Sequence
  Description of Artificial Sequence: Synthetic peptide
EINHSGSTNYNPSLKS

SEQ ID NO: 13857 - DNA, 51 bp, Artificial Sequence; identical to SEQ ID NO: 12103
  Description of Artificial Sequence: Synthetic oligonucleotide

SEQ ID NO: 13858 - protein, 17 aa, Artificial Sequence
  Description of Artificial Sequence: Synthetic peptide
WMNPNSGNTGYAQKFQG

SEQ ID NO: 13859 - DNA, 48 bp, Artificial Sequence; identical to SEQ ID NO: 13715
  Description of Artificial Sequence: Synthetic oligonucleotide

SEQ ID NO: 13860 - protein, 16 aa, Artificial Sequence
  Description of Artificial Sequence: Synthetic peptide
EINHSGSTNYNPSLKS

SEQ ID NO: 13861 - DNA, 48 bp, Artificial Sequence; identical to SEQ ID NO: 13731
  Description of Artificial Sequence: Synthetic oligonucleotide

SEQ ID NO: 13862 - protein, 16 aa, Artificial Sequence
  Description of Artificial Sequence: Synthetic peptide
EINHSGRTNYNPSLKS

SEQ ID NO: 13863 - DNA, 48 bp, Artificial Sequence
  Description of Artificial Sequence: Synthetic oligonucleotide
gaaatcaatcaaagtggacgcaccaactacaacccgtccctcaagagt

SEQ ID NO: 13864 - protein, 16 aa, Artificial Sequence
  Description of Artificial Sequence: Synthetic peptide
EINQSGRTNYNPSLKS

SEQ ID NO: 13865 - DNA, 51 bp, Artificial Sequence
  Description of Artificial Sequence: Synthetic oligonucleotide
tggatgaaccctaacagtggtaacacaggctatgcacagaagttccaggtc

SEQ ID NO: 13866 - protein, 17 aa, Artificial Sequence
  Description of Artificial Sequence: Synthetic peptide
WMNPNSGNTGYAQKFQV

SEQ ID NO: 13867 - DNA, 51 bp, Artificial Sequence; identical to SEQ ID NO: 12161
  Description of Artificial Sequence: Synthetic oligonucleotide

SEQ ID NO: 13868 - protein, 17 aa, Artificial Sequence
  Description of Artificial Sequence: Synthetic peptide
WMHPNSGNTGYAQKFQG

SEQ ID NO: 13869 - DNA, 48 bp, Artificial Sequence; identical to SEQ ID NO: 13715
  Description of Artificial Sequence: Synthetic oligonucleotide

SEQ ID NO: 13870 - protein, 16 aa, Artificial Sequence
  Description of Artificial Sequence: Synthetic peptide
EINHSGSTNYNPSLKS

SEQ ID NO: 13871 - DNA, 51 bp, Artificial Sequence; identical to SEQ ID NO: 13745
  Description of Artificial Sequence: Synthetic oligonucleotide

SEQ ID NO: 13872 - protein, 17 aa, Artificial Sequence
  Description of Artificial Sequence: Synthetic peptide
VIWYDGSNKNYADSVKG

SEQ ID NO: 13873 - DNA, 51 bp, Artificial Sequence; identical to SEQ ID NO: 13745
  Description of Artificial Sequence: Synthetic oligonucleotide

SEQ ID NO: 13874 - protein, 17 aa, Artificial Sequence
  Description of Artificial Sequence: Synthetic peptide
VIWYDGSNKNYADSVKG

SEQ ID NO: 13875 - DNA, 48 bp, Artificial Sequence; identical to SEQ ID NO: 13715
  Description of Artificial Sequence: Synthetic oligonucleotide

SEQ ID NO: 13876 - protein, 16 aa, Artificial Sequence
  Description of Artificial Sequence: Synthetic peptide
EINHSGSTNYNPSLKS

SEQ ID NO: 13877 - DNA, 51 bp, Artificial Sequence; identical to SEQ ID NO: 13727
  Description of Artificial Sequence: Synthetic oligonucleotide

SEQ ID NO: 13878 - protein, 17 aa, Artificial Sequence
  Description of Artificial Sequence: Synthetic peptide
WMHPNNGNTGYAQKFQG

SEQ ID NO: 13879 - DNA, 48 bp, Artificial Sequence; identical to SEQ ID NO: 13715
  Description of Artificial Sequence: Synthetic oligonucleotide

SEQ ID NO: 13880 - protein, 16 aa, Artificial Sequence
  Description of Artificial Sequence: Synthetic peptide
EINHSGSTNYNPSLKS

SEQ ID NO: 13881 - DNA, 48 bp, Artificial Sequence; identical to SEQ ID NO: 13715
  Description of Artificial Sequence: Synthetic oligonucleotide

SEQ ID NO: 13882 - protein, 16 aa, Artificial Sequence
  Description of Artificial Sequence: Synthetic peptide
EINHSGSTNYNPSLKS

SEQ ID NO: 13883 - DNA, 51 bp, Artificial Sequence; identical to SEQ ID NO: 12103
  Description of Artificial Sequence: Synthetic oligonucleotide

SEQ ID NO: 13884 - protein, 17 aa, Artificial Sequence
  Description of Artificial Sequence: Synthetic peptide
WMNPNSGNTGYAQKFQG

SEQ ID NO: 13885 - DNA, 51 bp, Artificial Sequence; identical to SEQ ID NO: 12161
  Description of Artificial Sequence: Synthetic oligonucleotide

SEQ ID NO: 13886 - protein, 17 aa, Artificial Sequence
  Description of Artificial Sequence: Synthetic peptide
WMHPNSGNTGYAQKFQG

SEQ ID NO: 13887 - DNA, 48 bp, Artificial Sequence; identical to SEQ ID NO: 13789
  Description of Artificial Sequence: Synthetic oligonucleotide

SEQ ID NO: 13888 - protein, 16 aa, Artificial Sequence
  Description of Artificial Sequence: Synthetic peptide
EINYRGSTNYNPSLKS

SEQ ID NO: 13889 - DNA, 48 bp, Artificial Sequence; identical to SEQ ID NO: 13715
  Description of Artificial Sequence: Synthetic oligonucleotide

SEQ ID NO: 13890 - protein, 16 aa, Artificial Sequence
  Description of Artificial Sequence: Synthetic peptide
EINHSGSTNYNPSLKS

SEQ ID NO: 13891 - DNA, 51 bp, Artificial Sequence; identical to SEQ ID NO: 13727
  Description of Artificial Sequence: Synthetic oligonucleotide

SEQ ID NO: 13892 - protein, 17 aa, Artificial Sequence
  Description of Artificial Sequence: Synthetic peptide
WMHPNNGNTGYAQKFQG

SEQ ID NO: 13893 - DNA, 51 bp, Artificial Sequence; identical to SEQ ID NO: 12161
  Description of Artificial Sequence: Synthetic oligonucleotide

SEQ ID NO: 13894 - protein, 17 aa, Artificial Sequence
  Description of Artificial Sequence: Synthetic peptide
WMHPNSGNTGYAQKFQG

SEQ ID NO: 13895 - DNA, 51 bp, Artificial Sequence; identical to SEQ ID NO: 12161
  Description of Artificial Sequence: Synthetic oligonucleotide

SEQ ID NO: 13896 - protein, 17 aa, Artificial Sequence
  Description of Artificial Sequence: Synthetic peptide
WMHPNSGNTGYAQKFQG

SEQ ID NO: 13897 - DNA, 48 bp, Artificial Sequence; identical to SEQ ID NO: 13715
  Description of Artificial Sequence: Synthetic oligonucleotide

SEQ ID NO: 13898 - protein, 16 aa, Artificial Sequence
  Description of Artificial Sequence: Synthetic peptide
EINHSGSTNYNPSLKS

SEQ ID NO: 13899 - DNA, 51 bp, Artificial Sequence; identical to SEQ ID NO: 13727
  Description of Artificial Sequence: Synthetic oligonucleotide

SEQ ID NO: 13900 - protein, 17 aa, Artificial Sequence
  Description of Artificial Sequence: Synthetic peptide
WMHPNNGNTGYAQKFQG

SEQ ID NO: 13901 - DNA, 51 bp, Artificial Sequence; identical to SEQ ID NO: 12103
  Description of Artificial Sequence: Synthetic oligonucleotide

SEQ ID NO: 13902 - protein, 17 aa, Artificial Sequence
  Description of Artificial Sequence: Synthetic peptide
WMNPNSGNTGYAQKFQG

SEQ ID NO: 13903 - DNA, 48 bp, Artificial Sequence; identical to SEQ ID NO: 13715
  Description of Artificial Sequence: Synthetic oligonucleotide

SEQ ID NO: 13904 - protein, 16 aa, Artificial Sequence
  Description of Artificial Sequence: Synthetic peptide
EINHSGSTNYNPSLKS

SEQ ID NO: 13905 - DNA, 51 bp, Artificial Sequence; identical to SEQ ID NO: 12161
  Description of Artificial Sequence: Synthetic oligonucleotide

SEQ ID NO: 13906 - protein, 17 aa, Artificial Sequence
  Description of Artificial Sequence: Synthetic peptide
WMHPNSGNTGYAQKFQG

SEQ ID NO: 13907 - DNA, 51 bp, Artificial Sequence; identical to SEQ ID NO: 12161
  Description of Artificial Sequence: Synthetic oligonucleotide

SEQ ID NO: 13908 - protein, 17 aa, Artificial Sequence
  Description of Artificial Sequence: Synthetic peptide
WMHPNSGNTGYAQKFQG

SEQ ID NO: 13909 - DNA, 51 bp, Artificial Sequence; identical to SEQ ID NO: 12161
  Description of Artificial Sequence: Synthetic oligonucleotide

SEQ ID NO: 13910 - protein, 17 aa, Artificial Sequence
  Description of Artificial Sequence: Synthetic peptide
WMHPNSGNTGYAQKFQG

SEQ ID NO: 13911 - DNA, 51 bp, Artificial Sequence; identical to SEQ ID NO: 12161
  Description of Artificial Sequence: Synthetic oligonucleotide

SEQ ID NO: 13912 - protein, 17 aa, Artificial Sequence
  Description of Artificial Sequence: Synthetic peptide
WMHPNSGNTGYAQKFQG

SEQ ID NO: 13913 - DNA, 48 bp, Artificial Sequence
  Description of Artificial Sequence: Synthetic oligonucleotide
gaaatcaatcatagtggaaggaccaactacaacccctccctcaagagt

SEQ ID NO: 13914 - protein, 16 aa, Artificial Sequence
  Description of Artificial Sequence: Synthetic peptide
EINHSGRTNYNPSLKS

SEQ ID NO: 13915 - DNA, 48 bp, Artificial Sequence; identical to SEQ ID NO: 13715
  Description of Artificial Sequence: Synthetic oligonucleotide

SEQ ID NO: 13916 - protein, 16 aa, Artificial Sequence
  Description of Artificial Sequence: Synthetic peptide
EINHSGSTNYNPSLKS

SEQ ID NO: 13917 - DNA, 51 bp, Artificial Sequence; identical to SEQ ID NO: 12103
  Description of Artificial Sequence: Synthetic oligonucleotide

SEQ ID NO: 13918 - protein, 17 aa, Artificial Sequence
  Description of Artificial Sequence: Synthetic peptide
WMNPNSGNTGYAQKFQG

SEQ ID NO: 13919 - DNA, 48 bp, Artificial Sequence
  Description of Artificial Sequence: Synthetic oligonucleotide
gaaatcaatcatagtggaagcaccaacttcaacccgtccctcaagagt

SEQ ID NO: 13920 - protein, 16 aa, Artificial Sequence
  Description of Artificial Sequence: Synthetic peptide
EINHSGSTNFNPSLKS

SEQ ID NO: 13921 - DNA, 51 bp, Artificial Sequence; identical to SEQ ID NO: 12103
  Description of Artificial Sequence: Synthetic oligonucleotide

SEQ ID NO: 13922 - protein, 17 aa, Artificial Sequence
  Description of Artificial Sequence: Synthetic peptide
WMNPNSGNTGYAQKFQG

SEQ ID NO: 13923 - DNA, 51 bp, Artificial Sequence
  Description of Artificial Sequence: Synthetic oligonucleotide
tggatgaaccctaacagtggtaacacaggctatgcacagaagttccaggac

SEQ ID NO: 13924 - protein, 17 aa, Artificial Sequence
  Description of Artificial Sequence: Synthetic peptide
WMNPNSGNTGYAQKFQD

SEQ ID NO: 13925 - DNA, 51 bp, Artificial Sequence; identical to SEQ ID NO: 13745
  Description of Artificial Sequence: Synthetic oligonucleotide

SEQ ID NO: 13926 - protein, 17 aa, Artificial Sequence
  Description of Artificial Sequence: Synthetic peptide
VIWYDGSNKNYADSVKG

SEQ ID NO: 13927 - DNA, 48 bp, Artificial Sequence; identical to SEQ ID NO: 13863
  Description of Artificial Sequence: Synthetic oligonucleotide

SEQ ID NO: 13928 - protein, 16 aa, Artificial Sequence
  Description of Artificial Sequence: Synthetic peptide
EINQSGRTNYNPSLKS

SEQ ID NO: 13929 - DNA, 51 bp, Artificial Sequence; identical to SEQ ID NO: 12123
  Description of Artificial Sequence: Synthetic oligonucleotide

SEQ ID NO: 13930 - protein, 17 aa, Artificial Sequence
  Description of Artificial Sequence: Synthetic peptide
VIWYDGSNKYYADSVKG

SEQ ID NO: 13931 - DNA, 51 bp, Artificial Sequence; identical to SEQ ID NO: 13795
  Description of Artificial Sequence: Synthetic oligonucleotide

SEQ ID NO: 13932 - protein, 17 aa, Artificial Sequence
  Description of Artificial Sequence: Synthetic peptide
WMHPNSGNTGYAQKFQG

SEQ ID NO: 13933 - DNA, 48 bp, Artificial Sequence; identical to SEQ ID NO: 13715
  Description of Artificial Sequence: Synthetic oligonucleotide

SEQ ID NO: 13934 - protein, 16 aa, Artificial Sequence
  Description of Artificial Sequence: Synthetic peptide
EINHSGSTNYNPSLKS

SEQ ID NO: 13935 - DNA, 48 bp, Artificial Sequence; identical to SEQ ID NO: 13715
  Description of Artificial Sequence: Synthetic oligonucleotide

SEQ ID NO: 13936 - protein, 16 aa, Artificial Sequence
  Description of Artificial Sequence: Synthetic peptide
EINHSGSTNYNPSLKS

SEQ ID NO: 13937 - DNA, 51 bp, Artificial Sequence; identical to SEQ ID NO: 12161
  Description of Artificial Sequence: Synthetic oligonucleotide

SEQ ID NO: 13938 - protein, 17 aa, Artificial Sequence
  Description of Artificial Sequence: Synthetic peptide
WMHPNSGNTGYAQKFQG

SEQ ID NO: 13939 - DNA, 48 bp, Artificial Sequence; identical to SEQ ID NO: 13735
  Description of Artificial Sequence: Synthetic oligonucleotide

SEQ ID NO: 13940 - protein, 16 aa, Artificial Sequence
  Description of Artificial Sequence: Synthetic peptide
EINYSGRTNYNPSLKS

SEQ ID NO: 13941 - DNA, 48 bp, Artificial Sequence; identical to SEQ ID NO: 13731
  Description of Artificial Sequence: Synthetic oligonucleotide

SEQ ID NO: 13942 - protein, 16 aa, Artificial Sequence
  Description of Artificial Sequence: Synthetic peptide
EINHSGRTNYNPSLKS

SEQ ID NO: 13943 - DNA, 48 bp, Artificial Sequence; identical to SEQ ID NO: 13715
  Description of Artificial Sequence: Synthetic oligonucleotide

SEQ ID NO: 13944 - protein, 16 aa, Artificial Sequence
  Description of Artificial Sequence: Synthetic peptide
EINHSGSTNYNPSLKS

SEQ ID NO: 13945 - DNA, 48 bp, Artificial Sequence; identical to SEQ ID NO: 13751
  Description of Artificial Sequence: Synthetic oligonucleotide

SEQ ID NO: 13946 - protein, 16 aa, Artificial Sequence
  Description of Artificial Sequence: Synthetic peptide
EINHSGRTNFNPSLKS

SEQ ID NO: 13947 - DNA, 51 bp, Artificial Sequence; identical to SEQ ID NO: 12103
  Description of Artificial Sequence: Synthetic oligonucleotide

SEQ ID NO: 13948 - protein, 17 aa, Artificial Sequence
  Description of Artificial Sequence: Synthetic peptide
WMNPNSGNTGYAQKFQG

SEQ ID NO: 13949 - DNA, 48 bp, Artificial Sequence
  Description of Artificial Sequence: Synthetic oligonucleotide
gaaatcaatcatagtggaatcaccaactacaacccgtccctcaagagt

SEQ ID NO: 13950 - protein, 16 aa, Artificial Sequence
  Description of Artificial Sequence: Synthetic peptide
EINHSGITNYNPSLKS

SEQ ID NO: 13951 - DNA, 51 bp, Artificial Sequence; identical to SEQ ID NO: 12161
  Description of Artificial Sequence: Synthetic oligonucleotide

SEQ ID NO: 13952 - protein, 17 aa, Artificial Sequence
  Description of Artificial Sequence: Synthetic peptide
WMHPNSGNTGYAQKFQG

SEQ ID NO: 13953 - DNA, 51 bp, Artificial Sequence; identical to SEQ ID NO: 12161
  Description of Artificial Sequence: Synthetic oligonucleotide

SEQ ID NO: 13954 - protein, 17 aa, Artificial Sequence
  Description of Artificial Sequence: Synthetic peptide
WMHPNSGNTGYAQKFQG

SEQ ID NO: 13955 - DNA, 48 bp, Artificial Sequence; identical to SEQ ID NO: 13715
  Description of Artificial Sequence: Synthetic oligonucleotide

SEQ ID NO: 13956 - protein, 16 aa, Artificial Sequence
  Description of Artificial Sequence: Synthetic peptide
EINHSGSTNYNPSLKS

SEQ ID NO: 13957 - DNA, 48 bp, Artificial Sequence; identical to SEQ ID NO: 13715
  Description of Artificial Sequence: Synthetic oligonucleotide

SEQ ID NO: 13958 - protein, 16 aa, Artificial Sequence
  Description of Artificial Sequence: Synthetic peptide
EINHSGSTNYNPSLKS

SEQ ID NO: 13959 - DNA, 51 bp, Artificial Sequence; identical to SEQ ID NO: 12103
  Description of Artificial Sequence: Synthetic oligonucleotide

SEQ ID NO: 13960 - protein, 17 aa, Artificial Sequence
  Description of Artificial Sequence: Synthetic peptide
WMNPNSGNTGYAQKFQG

SEQ ID NO: 13961 - DNA, 48 bp, Artificial Sequence; identical to SEQ ID NO: 13715
  Description of Artificial Sequence: Synthetic oligonucleotide

SEQ ID NO: 13962 - protein, 16 aa, Artificial Sequence
  Description of Artificial Sequence: Synthetic peptide
EINHSGSTNYNPSLKS

SEQ ID NO: 13963 - DNA, 48 bp, Artificial Sequence
  Description of Artificial Sequence: Synthetic oligonucleotide
gaaatcaatcatagtggacgcaccaactacaacccgtccctcaagagt

SEQ ID NO: 13964 - protein, 16 aa, Artificial Sequence
  Description of Artificial Sequence: Synthetic peptide
EINHSGRTNYNPSLKS

SEQ ID NO: 13965 - DNA, 48 bp, Artificial Sequence; identical to SEQ ID NO: 13715
  Description of Artificial Sequence: Synthetic oligonucleotide

SEQ ID NO: 13966 - protein, 16 aa, Artificial Sequence
  Description of Artificial Sequence: Synthetic peptide
EINHSGSTNYNPSLKS

SEQ ID NO: 13967 - DNA, 51 bp, Artificial Sequence; identical to SEQ ID NO: 13745
  Description of Artificial Sequence: Synthetic oligonucleotide

SEQ ID NO: 13968 - protein, 17 aa, Artificial Sequence
  Description of Artificial Sequence: Synthetic peptide
VIWYDGSNKNYADSVKG

SEQ ID NO: 13969 - DNA, 48 bp, Artificial Sequence; identical to SEQ ID NO: 13715
  Description of Artificial Sequence: Synthetic oligonucleotide

SEQ ID NO: 13970 - protein, 16 aa, Artificial Sequence
  Description of Artificial Sequence: Synthetic peptide
EINHSGSTNYNPSLKS

SEQ ID NO: 13971 - DNA, 51 bp, Artificial Sequence; identical to SEQ ID NO: 13727
  Description of Artificial Sequence: Synthetic oligonucleotide

SEQ ID NO: 13972 - protein, 17 aa, Artificial Sequence
  Description of Artificial Sequence: Synthetic peptide
WMHPNNGNTGYAQKFQG

SEQ ID NO: 13973 - DNA, 51 bp, Artificial Sequence; identical to SEQ ID NO: 12103
  Description of Artificial Sequence: Synthetic oligonucleotide

SEQ ID NO: 13974 - protein, 17 aa, Artificial Sequence
  Description of Artificial Sequence: Synthetic peptide
WMNPNSGNTGYAQKFQG

SEQ ID NO: 13975 - DNA, 48 bp, Artificial Sequence; identical to SEQ ID NO: 13715
  Description of Artificial Sequence: Synthetic oligonucleotide

SEQ ID NO: 13976 - protein, 16 aa, Artificial Sequence
  Description of Artificial Sequence: Synthetic peptide
EINHSGSTNYNPSLKS

SEQ ID NO: 13977 - DNA, 51 bp, Artificial Sequence; identical to SEQ ID NO: 12103
  Description of Artificial Sequence: Synthetic oligonucleotide

SEQ ID NO: 13978 - protein, 17 aa, Artificial Sequence
  Description of Artificial Sequence: Synthetic peptide
WMNPNSGNTGYAQKFQG

SEQ ID NO: 13979 - DNA, 48 bp, Artificial Sequence; identical to SEQ ID NO: 13715
  Description of Artificial Sequence: Synthetic oligonucleotide

SEQ ID NO: 13980 - protein, 16 aa, Artificial Sequence
  Description of Artificial Sequence: Synthetic peptide
EINHSGSTNYNPSLKS

SEQ ID NO: 13981 - DNA, 51 bp, Artificial Sequence; identical to SEQ ID NO: 12161
  Description of Artificial Sequence: Synthetic oligonucleotide

SEQ ID NO: 13982 - protein, 17 aa, Artificial Sequence
  Description of Artificial Sequence: Synthetic peptide
WMHPNSGNTGYAQKFQG

SEQ ID NO: 13983 - DNA, 51 bp, Artificial Sequence
  Description of Artificial Sequence: Synthetic oligonucleotide
tggatgaaccctaacagtggtgacacaggctatgcacagaagttccagggc

SEQ ID NO: 13984 - protein, 17 aa, Artificial Sequence
  Description of Artificial Sequence: Synthetic peptide
WMNPNSGDTGYAQKFQG

SEQ ID NO: 13985 - DNA, 51 bp, Artificial Sequence; identical to SEQ ID NO: 12103
  Description of Artificial Sequence: Synthetic oligonucleotide

SEQ ID NO: 13986 - protein, 17 aa, Artificial Sequence
  Description of Artificial Sequence: Synthetic peptide
WMNPNSGNTGYAQKFQG

SEQ ID NO: 13987 - DNA, 48 bp, Artificial Sequence; identical to SEQ ID NO: 13715
  Description of Artificial Sequence: Synthetic oligonucleotide

SEQ ID NO: 13988 - protein, 16 aa, Artificial Sequence
  Description of Artificial Sequence: Synthetic peptide
EINHSGSTNYNPSLKS

SEQ ID NO: 13989 - DNA, 48 bp, Artificial Sequence; identical to SEQ ID NO: 13715
  Description of Artificial Sequence: Synthetic oligonucleotide

SEQ ID NO: 13990 - protein, 16 aa, Artificial Sequence
  Description of Artificial Sequence: Synthetic peptide
EINHSGSTNYNPSLKS

SEQ ID NO: 13991 - DNA, 48 bp, Artificial Sequence; identical to SEQ ID NO: 13715
  Description of Artificial Sequence: Synthetic oligonucleotide

SEQ ID NO: 13992 - protein, 16 aa, Artificial Sequence
  Description of Artificial Sequence: Synthetic peptide
EINHSGSTNYNPSLKS

SEQ ID NO: 13993 - DNA, 51 bp, Artificial Sequence; identical to SEQ ID NO: 12101
  Description of Artificial Sequence: Synthetic oligonucleotide

SEQ ID NO: 13994 - protein, 17 aa, Artificial Sequence
  Description of Artificial Sequence: Synthetic peptide
WMTPNSGNTGYAQKFQG

SEQ ID NO: 13995 - DNA, 48 bp, Artificial Sequence; identical to SEQ ID NO: 13715
  Description of Artificial Sequence: Synthetic oligonucleotide

SEQ ID NO: 13996 - protein, 16 aa, Artificial Sequence
  Description of Artificial Sequence: Synthetic peptide
EINHSGSTNYNPSLKS

SEQ ID NO: 13997 - DNA, 48 bp, Artificial Sequence; identical to SEQ ID NO: 13761
  Description of Artificial Sequence: Synthetic oligonucleotide

SEQ ID NO: 13998 - protein, 16 aa, Artificial Sequence
  Description of Artificial Sequence: Synthetic peptide
AIGTAGDTYYPGSVKG

SEQ ID NO: 13999 - DNA, 48 bp, Artificial Sequence; identical to SEQ ID NO: 13715
  Description of Artificial Sequence: Synthetic oligonucleotide

SEQ ID NO: 14000 - protein, 16 aa, Artificial Sequence
  Description of Artificial Sequence: Synthetic peptide
EINHSGSTNYNPSLKS

SEQ ID NO: 14001 - DNA, 48 bp, Artificial Sequence
  Description of Artificial Sequence: Synthetic oligonucleotide
gaaatcaattatagtggaagcaccaacttcaacccgtccctcaagagt

SEQ ID NO: 14002 - protein, 16 aa, Artificial Sequence
  Description of Artificial Sequence: Synthetic peptide
EINYSGSTNFNPSLKS

SEQ ID NO: 14003 - DNA, 48 bp, Artificial Sequence; identical to SEQ ID NO: 13715
  Description of Artificial Sequence: Synthetic oligonucleotide

SEQ ID NO: 14004 - protein, 16 aa, Artificial Sequence
  Description of Artificial Sequence: Synthetic peptide
EINHSGSTNYNPSLKS

SEQ ID NO: 14005 - DNA, 48 bp, Artificial Sequence
  Description of Artificial Sequence: Synthetic oligonucleotide
gaaatcaatcatagtggacgcaccagctacaacccgtccctcaagagt

SEQ ID NO: 14006 - protein, 16 aa, Artificial Sequence
  Description of Artificial Sequence: Synthetic peptide
EINHSGRTSYNPSLKS

SEQ ID NO: 14007 - DNA, 48 bp, Artificial Sequence; identical to SEQ ID NO: 13715
  Description of Artificial Sequence: Synthetic oligonucleotide

SEQ ID NO: 14008 - protein, 16 aa, Artificial Sequence
  Description of Artificial Sequence: Synthetic peptide
EINHSGSTNYNPSLKS

SEQ ID NO: 14009 - DNA, 48 bp, Artificial Sequence; identical to SEQ ID NO: 13715
  Description of Artificial Sequence: Synthetic oligonucleotide

SEQ ID NO: 14010 - protein, 16 aa, Artificial Sequence
  Description of Artificial Sequence: Synthetic peptide
EINHSGSTNYNPSLKS

SEQ ID NO: 14011 - DNA, 48 bp, Artificial Sequence; identical to SEQ ID NO: 13715
  Description of Artificial Sequence: Synthetic oligonucleotide

SEQ ID NO: 14012 - protein, 16 aa, Artificial Sequence
  Description of Artificial Sequence: Synthetic peptide
EINHSGSTNYNPSLKS

SEQ ID NO: 14013 - DNA, 51 bp, Artificial Sequence
  Description of Artificial Sequence: Synthetic oligonucleotide
gttatatggtatgaaggaagtaatacatactatgcagactccgtgaagggc

SEQ ID NO: 14014 - protein, 17 aa, Artificial Sequence
  Description of Artificial Sequence: Synthetic peptide
VIWYEGSNTYYADSVKG

SEQ ID NO: 14015 - DNA, 51 bp, Artificial Sequence; identical to SEQ ID NO: 12103
  Description of Artificial Sequence: Synthetic oligonucleotide

SEQ ID NO: 14016 - protein, 17 aa, Artificial Sequence
  Description of Artificial Sequence: Synthetic peptide
WMNPNSGNTGYAQKFQG

SEQ ID NO: 14017 - DNA, 51 bp, Artificial Sequence; identical to SEQ ID NO: 12161
  Description of Artificial Sequence: Synthetic oligonucleotide

SEQ ID NO: 14018 - protein, 17 aa, Artificial Sequence
  Description of Artificial Sequence: Synthetic peptide
WMHPNSGNTGYAQKFQG

SEQ ID NO: 14019 - DNA, 48 bp, Artificial Sequence; identical to SEQ ID NO: 13715
  Description of Artificial Sequence: Synthetic oligonucleotide

SEQ ID NO: 14020 - protein, 16 aa, Artificial Sequence
  Description of Artificial Sequence: Synthetic peptide
EINHSGSTNYNPSLKS

SEQ ID NO: 14021 - DNA, 48 bp, Artificial Sequence; identical to SEQ ID NO: 13761
  Description of Artificial Sequence: Synthetic oligonucleotide

SEQ ID NO: 14022 - protein, 16 aa, Artificial Sequence
  Description of Artificial Sequence: Synthetic peptide
AIGTAGDTYYPGSVKG

SEQ ID NO: 14023 - DNA, 51 bp, Artificial Sequence; identical to SEQ ID NO: 12161
  Description of Artificial Sequence: Synthetic oligonucleotide

SEQ ID NO: 14024 - protein, 17 aa, Artificial Sequence
  Description of Artificial Sequence: Synthetic peptide
WMHPNSGNTGYAQKFQG

SEQ ID NO: 14025 - DNA, 48 bp, Artificial Sequence; identical to SEQ ID NO: 13715
  Description of Artificial Sequence: Synthetic oligonucleotide

SEQ ID NO: 14026 - protein, 16 aa, Artificial Sequence
  Description of Artificial Sequence: Synthetic peptide
EINHSGSTNYNPSLKS

SEQ ID NO: 14027 - DNA, 48 bp, Artificial Sequence; identical to SEQ ID NO: 13715
  Description of Artificial Sequence: Synthetic oligonucleotide

SEQ ID NO: 14028 - protein, 16 aa, Artificial Sequence
  Description of Artificial Sequence: Synthetic peptide
EINHSGSTNYNPSLKS

SEQ ID NO: 14029 - DNA, 48 bp, Artificial Sequence; identical to SEQ ID NO: 13715
  Description of Artificial Sequence: Synthetic oligonucleotide

SEQ ID NO: 14030 - protein, 16 aa, Artificial Sequence
  Description of Artificial Sequence: Synthetic peptide
EINHSGSTNYNPSLKS

SEQ ID NO: 14031 - DNA, 48 bp, Artificial Sequence; identical to SEQ ID NO: 13715
  Description of Artificial Sequence: Synthetic oligonucleotide

SEQ ID NO: 14032 - protein, 16 aa, Artificial Sequence
  Description of Artificial Sequence: Synthetic peptide
EINHSGSTNYNPSLKS

SEQ ID NO: 14033 - DNA, 51 bp, Artificial Sequence; identical to SEQ ID NO: 12161
  Description of Artificial Sequence: Synthetic oligonucleotide

SEQ ID NO: 14034 - protein, 17 aa, Artificial Sequence
  Description of Artificial Sequence: Synthetic peptide
WMHPNSGNTGYAQKFQG

SEQ ID NO: 14035 - DNA, 48 bp, Artificial Sequence; identical to SEQ ID NO: 13715
  Description of Artificial Sequence: Synthetic oligonucleotide

SEQ ID NO: 14036 - protein, 16 aa, Artificial Sequence
  Description of Artificial Sequence: Synthetic peptide
EINHSGSTNYNPSLKS

SEQ ID NO: 14037 - DNA, 48 bp, Artificial Sequence; identical to SEQ ID NO: 13789
  Description of Artificial Sequence: Synthetic oligonucleotide

SEQ ID NO: 14038 - protein, 16 aa, Artificial Sequence
  Description of Artificial Sequence: Synthetic peptide
EINYRGSTNYNPSLKS

SEQ ID NO: 14039 - DNA, 48 bp, Artificial Sequence; identical to SEQ ID NO: 13761
  Description of Artificial Sequence: Synthetic oligonucleotide

SEQ ID NO: 14040 - protein, 16 aa, Artificial Sequence
  Description of Artificial Sequence: Synthetic peptide
AIGTAGDTYYPGSVKG

SEQ ID NO: 14041 - DNA, 51 bp, Artificial Sequence; identical to SEQ ID NO: 12123
  Description of Artificial Sequence: Synthetic oligonucleotide

SEQ ID NO: 14042 - protein, 17 aa, Artificial Sequence
  Description of Artificial Sequence: Synthetic peptide
VIWYDGSNKYYADSVKG

SEQ ID NO: 14043 - DNA, 48 bp, Artificial Sequence; identical to SEQ ID NO: 13715
  Description of Artificial Sequence: Synthetic oligonucleotide

SEQ ID NO: 14044 - protein, 16 aa, Artificial Sequence
  Description of Artificial Sequence: Synthetic peptide
EINHSGSTNYNPSLKS

SEQ ID NO: 14045 - DNA, 51 bp, Artificial Sequence; identical to SEQ ID NO: 12161
  Description of Artificial Sequence: Synthetic oligonucleotide

SEQ ID NO: 14046 - protein, 17 aa, Artificial Sequence
  Description of Artificial Sequence: Synthetic peptide
WMHPNSGNTGYAQKFQG

SEQ ID NO: 14047 - DNA, 48 bp, Artificial Sequence; identical to SEQ ID NO: 13715
  Description of Artificial Sequence: Synthetic oligonucleotide

SEQ ID NO: 14048 - protein, 16 aa, Artificial Sequence
  Description of Artificial Sequence: Synthetic peptide
EINHSGSTNYNPSLKS

SEQ ID NO: 14049 - DNA, 51 bp, Artificial Sequence; identical to SEQ ID NO: 12103
  Description of Artificial Sequence: Synthetic oligonucleotide

SEQ ID NO: 14050 - protein, 17 aa, Artificial Sequence
  Description of Artificial Sequence: Synthetic peptide
WMNPNSGNTGYAQKFQG

SEQ ID NO: 14051 - DNA, 48 bp, Artificial Sequence; identical to SEQ ID NO: 13715
  Description of Artificial Sequence: Synthetic oligonucleotide

SEQ ID NO: 14052 - protein, 16 aa, Artificial Sequence
  Description of Artificial Sequence: Synthetic peptide
EINHSGSTNYNPSLKS

SEQ ID NO: 14053 - DNA, 48 bp, Artificial Sequence; identical to SEQ ID NO: 13715
  Description of Artificial Sequence: Synthetic oligonucleotide

SEQ ID NO: 14054 - protein, 16 aa, Artificial Sequence
  Description of Artificial Sequence: Synthetic peptide
EINHSGSTNYNPSLKS

SEQ ID NO: 14055 - DNA, 48 bp, Artificial Sequence; identical to SEQ ID NO: 13731
  Description of Artificial Sequence: Synthetic oligonucleotide

SEQ ID NO: 14056 - protein, 16 aa, Artificial Sequence
  Description of Artificial Sequence: Synthetic peptide
EINHSGRTNYNPSLKS

SEQ ID NO: 14057 - DNA, 48 bp, Artificial Sequence; identical to SEQ ID NO: 13735
  Description of Artificial Sequence: Synthetic oligonucleotide

SEQ ID NO: 14058 - protein, 16 aa, Artificial Sequence
  Description of Artificial Sequence: Synthetic peptide
EINYSGRTNYNPSLKS

SEQ ID NO: 14059 - DNA, 51 bp, Artificial Sequence; identical to SEQ ID NO: 12123
  Description of Artificial Sequence: Synthetic oligonucleotide

SEQ ID NO: 14060 - protein, 17 aa, Artificial Sequence
  Description of Artificial Sequence: Synthetic peptide
VIWYDGSNKYYADSVKG

SEQ ID NO: 14061 - DNA, 51 bp, Artificial Sequence; identical to SEQ ID NO: 13923
  Description of Artificial Sequence: Synthetic oligonucleotide

SEQ ID NO: 14062 - protein, 17 aa, Artificial Sequence
  Description of Artificial Sequence: Synthetic peptide
WMNPNSGNTGYAQKFQD

SEQ ID NO: 14063 - DNA, 51 bp, Artificial Sequence; identical to SEQ ID NO: 12103
  Description of Artificial Sequence: Synthetic oligonucleotide

SEQ ID NO: 14064 - protein, 17 aa, Artificial Sequence
  Description of Artificial Sequence: Synthetic peptide
WMNPNSGNTGYAQKFQG

SEQ ID NO: 14065 - DNA, 51 bp, Artificial Sequence; identical to SEQ ID NO: 12103
  Description of Artificial Sequence: Synthetic oligonucleotide

SEQ ID NO: 14066 - protein, 17 aa, Artificial Sequence
  Description of Artificial Sequence: Synthetic peptide
WMNPNSGNTGYAQKFQG

SEQ ID NO: 14067 - DNA, 51 bp, Artificial Sequence; identical to SEQ ID NO: 12103
  Description of Artificial Sequence: Synthetic oligonucleotide

SEQ ID NO: 14068 - protein, 17 aa, Artificial Sequence
  Description of Artificial Sequence: Synthetic peptide
WMNPNSGNTGYAQKFQG

SEQ ID NO: 14069 - DNA, 48 bp, Artificial Sequence; identical to SEQ ID NO: 13715
  Description of Artificial Sequence: Synthetic oligonucleotide

SEQ ID NO: 14070 - protein, 16 aa, Artificial Sequence
  Description of Artificial Sequence: Synthetic peptide
EINHSGSTNYNPSLKS

SEQ ID NO: 14071 - DNA, 48 bp, Artificial Sequence; identical to SEQ ID NO: 13715
  Description of Artificial Sequence: Synthetic oligonucleotide

SEQ ID NO: 14072 - protein, 16 aa, Artificial Sequence
  Description of Artificial Sequence: Synthetic peptide
EINHSGSTNYNPSLKS

SEQ ID NO: 14073 - DNA, 51 bp, Artificial Sequence; identical to SEQ ID NO: 13705
  Description of Artificial Sequence: Synthetic oligonucleotide

SEQ ID NO: 14074 - protein, 17 aa, Artificial Sequence
  Description of Artificial Sequence: Synthetic peptide
VIWYDGSNKYYADSVKG

SEQ ID NO: 14075 - DNA, 51 bp, Artificial Sequence; identical to SEQ ID NO: 12103
  Description of Artificial Sequence: Synthetic oligonucleotide

SEQ ID NO: 14076 - protein, 17 aa, Artificial Sequence
  Description of Artificial Sequence: Synthetic peptide
WMNPNSGNTGYAQKFQG

SEQ ID NO: 14077 - DNA, 48 bp, Artificial Sequence; identical to SEQ ID NO: 13715
  Description of Artificial Sequence: Synthetic oligonucleotide

SEQ ID NO: 14078 - protein, 16 aa, Artificial Sequence
  Description of Artificial Sequence: Synthetic peptide
EINHSGSTNYNPSLKS

SEQ ID NO: 14079 - DNA, 48 bp, Artificial Sequence; identical to SEQ ID NO: 13715
  Description of Artificial Sequence: Synthetic oligonucleotide

SEQ ID NO: 14080 - protein, 16 aa, Artificial Sequence
  Description of Artificial Sequence: Synthetic peptide
EINHSGSTNYNPSLKS

SEQ ID NO: 14081 - DNA, 48 bp, Artificial Sequence; identical to SEQ ID NO: 13715
  Description of Artificial Sequence: Synthetic oligonucleotide

SEQ ID NO: 14082 - protein, 16 aa, Artificial Sequence
  Description of Artificial Sequence: Synthetic peptide
EINHSGSTNYNPSLKS

SEQ ID NO: 14083 - DNA, 51 bp, Artificial Sequence; identical to SEQ ID NO: 12103
  Description of Artificial Sequence: Synthetic oligonucleotide

SEQ ID NO: 14084 - protein, 17 aa, Artificial Sequence
  Description of Artificial Sequence: Synthetic peptide
WMNPNSGNTGYAQKFQG

SEQ ID NO: 14085 - DNA, 51 bp, Artificial Sequence; identical to SEQ ID NO: 13727
  Description of Artificial Sequence: Synthetic oligonucleotide

SEQ ID NO: 14086 - protein, 17 aa, Artificial Sequence
  Description of Artificial Sequence: Synthetic peptide
WMHPNNGNTGYAQKFQG

SEQ ID NO: 14087 - DNA, 51 bp, Artificial Sequence; identical to SEQ ID NO: 13795
  Description of Artificial Sequence: Synthetic oligonucleotide

SEQ ID NO: 14088 - protein, 17 aa, Artificial Sequence
  Description of Artificial Sequence: Synthetic peptide
WMHPNSGNTGYAQKFQG

SEQ ID NO: 14089 - DNA, 48 bp, Artificial Sequence; identical to SEQ ID NO: 13709
  Description of Artificial Sequence: Synthetic oligonucleotide

SEQ ID NO: 14090 - protein, 16 aa, Artificial Sequence
  Description of Artificial Sequence: Synthetic peptide
SIYYSGYTSYNPSLKS

SEQ ID NO: 14091 - DNA, 51 bp, Artificial Sequence; identical to SEQ ID NO: 12103
  Description of Artificial Sequence: Synthetic oligonucleotide

SEQ ID NO: 14092 - protein, 17 aa, Artificial Sequence
  Description of Artificial Sequence: Synthetic peptide
WMNPNSGNTGYAQKFQG

SEQ ID NO: 14093 - DNA, 51 bp, Artificial Sequence; identical to SEQ ID NO: 12103
  Description of Artificial Sequence: Synthetic oligonucleotide

SEQ ID NO: 14094 - protein, 17 aa, Artificial Sequence
  Description of Artificial Sequence: Synthetic peptide
WMNPNSGNTGYAQKFQG

SEQ ID NO: 14095 - DNA, 51 bp, Artificial Sequence; identical to SEQ ID NO: 12161
  Description of Artificial Sequence: Synthetic oligonucleotide

SEQ ID NO: 14096 - protein, 17 aa, Artificial Sequence
  Description of Artificial Sequence: Synthetic peptide
WMHPNSGNTGYAQKFQG

SEQ ID NO: 14097 - DNA, 51 bp, Artificial Sequence
  Description of Artificial Sequence: Synthetic oligonucleotide
tggatgaaccctaacagtcgtaacacaggctatgcacagaagttccagggc

SEQ ID NO: 14098 - protein, 17 aa, Artificial Sequence
  Description of Artificial Sequence: Synthetic peptide
WMNPNSRNTGYAQKFQG

SEQ ID NO: 14099 - DNA, 51 bp, Artificial Sequence; identical to SEQ ID NO: 12161
  Description of Artificial Sequence: Synthetic oligonucleotide

SEQ ID NO: 14100 - protein, 17 aa, Artificial Sequence
  Description of Artificial Sequence: Synthetic peptide
WMHPNSGNTGYAQKFQG

SEQ ID NO: 14101 - DNA, 48 bp, Artificial Sequence; identical to SEQ ID NO: 13715
  Description of Artificial Sequence: Synthetic oligonucleotide

SEQ ID NO: 14102 - protein, 16 aa, Artificial Sequence
  Description of Artificial Sequence: Synthetic peptide
EINHSGSTNYNPSLKS

SEQ ID NO: 14103 - DNA, 51 bp, Artificial Sequence; identical to SEQ ID NO: 12161
  Description of Artificial Sequence: Synthetic oligonucleotide

SEQ ID NO: 14104 - protein, 17 aa, Artificial Sequence
  Description of Artificial Sequence: Synthetic peptide
WMHPNSGNTGYAQKFQG

SEQ ID NO: 14105 - DNA, 48 bp, Artificial Sequence; identical to SEQ ID NO: 13715
  Description of Artificial Sequence: Synthetic oligonucleotide

SEQ ID NO: 14106 - protein, 16 aa, Artificial Sequence
  Description of Artificial Sequence: Synthetic peptide
EINHSGSTNYNPSLKS

SEQ ID NO: 14107 - DNA, 51 bp, Artificial Sequence; identical to SEQ ID NO: 12127
  Description of Artificial Sequence: Synthetic oligonucleotide

SEQ ID NO: 14108 - protein, 17 aa, Artificial Sequence
  Description of Artificial Sequence: Synthetic peptide
IIWYDGSNKYYADSVKG

SEQ ID NO: 14109 - DNA, 48 bp, Artificial Sequence
  Description of Artificial Sequence: Synthetic oligonucleotide
agtatatattatagtgggagtacctcctacaacccgtccctcaagagt

SEQ ID NO: 14110 - protein, 16 aa, Artificial Sequence
  Description of Artificial Sequence: Synthetic peptide
SIYYSGSTSYNPSLKS

SEQ ID NO: 14111 - DNA, 51 bp, Artificial Sequence; identical to SEQ ID NO: 12619
  Description of Artificial Sequence: Synthetic oligonucleotide

SEQ ID NO: 14112 - protein, 17 aa, Artificial Sequence
  Description of Artificial Sequence: Synthetic peptide
AISGRGGNTFYADSVKG

SEQ ID NO: 14113 - DNA, 51 bp, Artificial Sequence
  Description of Artificial Sequence: Synthetic oligonucleotide
gttatatggtatgatggaagttataaatactatgcagactccgtgaagggc

SEQ ID NO: 14114 - protein, 17 aa, Artificial Sequence
  Description of Artificial Sequence: Synthetic peptide
VIWYDGSYKYYADSVKG

SEQ ID NO: 14115 - DNA, 51 bp, Artificial Sequence
  Description of Artificial Sequence: Synthetic oligonucleotide
tgggtgcaccctaacagtggtaacacaggctatgcacagaagttccagggc

SEQ ID NO: 14116 - protein, 17 aa, Artificial Sequence
  Description of Artificial Sequence: Synthetic peptide
WVHPNSGNTGYAQKFQG

SEQ ID NO: 14117 - DNA, 48 bp, Artificial Sequence
  Description of Artificial Sequence: Synthetic oligonucleotide
tacagctattacagtgggagcacctactacaacccgtccctcaagagt

SEQ ID NO: 14118 - protein, 16 aa, Artificial Sequence
  Description of Artificial Sequence: Synthetic peptide
YSYYSGSTYYNPSLKS

SEQ ID NO: 14119 - DNA, 51 bp, Artificial Sequence; identical to SEQ ID NO: 13377
  Description of Artificial Sequence: Synthetic oligonucleotide

SEQ ID NO: 14120 - protein, 17 aa, Artificial Sequence
  Description of Artificial Sequence: Synthetic peptide
AISGSGGNTFYADSVKG

SEQ ID NO: 14121 - DNA, 51 bp, Artificial Sequence; identical to SEQ ID NO: 12161
  Description of Artificial Sequence: Synthetic oligonucleotide

SEQ ID NO: 14122 - protein, 17 aa, Artificial Sequence
  Description of Artificial Sequence: Synthetic peptide
WMHPNSGNTGYAQKFQG

SEQ ID NO: 14123 - DNA, 51 bp, Artificial Sequence; identical to SEQ ID NO: 12619
  Description of Artificial Sequence: Synthetic oligonucleotide

SEQ ID NO: 14124 - protein, 17 aa, Artificial Sequence
  Description of Artificial Sequence: Synthetic peptide
AISGRGGNTFYADSVKG

SEQ ID NO: 14125 - DNA, 51 bp, Artificial Sequence; identical to SEQ ID NO: 12161
  Description of Artificial Sequence: Synthetic oligonucleotide

SEQ ID NO: 14126 - protein, 17 aa, Artificial Sequence
  Description of Artificial Sequence: Synthetic peptide
WMHPNSGNTGYAQKFQG

SEQ ID NO: 14127 - DNA, 51 bp, Artificial Sequence
  Description of Artificial Sequence: Synthetic oligonucleotide
gtgatatggtttgatgaaagtaataaacactatggagactccgtgaagggc

SEQ ID NO: 14128 - protein, 17 aa, Artificial Sequence
  Description of Artificial Sequence: Synthetic peptide
VIWFDESNKHYGDSVKG

SEQ ID NO: 14129 - DNA, 51 bp, Artificial Sequence
  Description of Artificial Sequence: Synthetic oligonucleotide
tccattagtggtagtggtagctacacatactacgcagactcagtgaagggc

SEQ ID NO: 14130 - protein, 17 aa, Artificial Sequence
  Description of Artificial Sequence: Synthetic peptide
SISGSGSYTYYADSVKG

SEQ ID NO: 14131 - DNA, 51 bp, Artificial Sequence; identical to SEQ ID NO: 12123
  Description of Artificial Sequence: Synthetic oligonucleotide

SEQ ID NO: 14132 - protein, 17 aa, Artificial Sequence
  Description of Artificial Sequence: Synthetic peptide
VIWYDGSNKYYADSVKG

SEQ ID NO: 14133 - DNA, 48 bp, Artificial Sequence
  Description of Artificial Sequence: Synthetic oligonucleotide
ttcatctattacactgggagcacctactacaacccgtccctcaagagt

SEQ ID NO: 14134 - protein, 16 aa, Artificial Sequence
  Description of Artificial Sequence: Synthetic peptide
FIYYTGSTYYNPSLKS

SEQ ID NO: 14135 - DNA, 48 bp, Artificial Sequence
  Description of Artificial Sequence: Synthetic oligonucleotide
tacatctattacagtgggggcacctactacaacccgtccctcaagagt

SEQ ID NO: 14136 - protein, 16 aa, Artificial Sequence
  Description of Artificial Sequence: Synthetic peptide
YIYYSGGTYYNPSLKS

SEQ ID NO: 14137 - DNA, 51 bp, Artificial Sequence; identical to SEQ ID NO: 12103
  Description of Artificial Sequence: Synthetic oligonucleotide

SEQ ID NO: 14138 - protein, 17 aa, Artificial Sequence
  Description of Artificial Sequence: Synthetic peptide
WMNPNSGNTGYAQKFQG

SEQ ID NO: 14139 - DNA, 51 bp, Artificial Sequence; identical to SEQ ID NO: 14115
  Description of Artificial Sequence: Synthetic oligonucleotide

SEQ ID NO: 14140 - protein, 17 aa, Artificial Sequence
  Description of Artificial Sequence: Synthetic peptide
WVHPNSGNTGYAQKFQG

SEQ ID NO: 14141 - DNA, 51 bp, Artificial Sequence; identical to SEQ ID NO: 12167
  Description of Artificial Sequence: Synthetic oligonucleotide

SEQ ID NO: 14142 - protein, 17 aa, Artificial Sequence
  Description of Artificial Sequence: Synthetic peptide
VIWYDGSNKYYADSVKG

SEQ ID NO: 14143 - DNA, 51 bp, Artificial Sequence
  Description of Artificial Sequence: Synthetic oligonucleotide
tggatgcaccccaacagtggtaacacaggctatgcacagaagttccagggc

SEQ ID NO: 14144 - protein, 17 aa, Artificial Sequence
  Description of Artificial Sequence: Synthetic peptide
WMHPNSGNTGYAQKFQG

SEQ ID NO: 14145 - DNA, 51 bp, Artificial Sequence; identical to SEQ ID NO: 12123
  Description of Artificial Sequence: Synthetic oligonucleotide

SEQ ID NO: 14146 - protein, 17 aa, Artificial Sequence
  Description of Artificial Sequence: Synthetic peptide
VIWYDGSNKYYADSVKG

SEQ ID NO: 14147 - DNA, 48 bp, Artificial Sequence
  Description of Artificial Sequence: Synthetic oligonucleotide
gaaatcaatcatagtggaagtaccaactacaaaccgtccctcaagagt

SEQ ID NO: 14148 - protein, 16 aa, Artificial Sequence
  Description of Artificial Sequence: Synthetic peptide
EINHSGSTNYKPSLKS

SEQ ID NO: 14149 - DNA, 51 bp, Artificial Sequence
  Description of Artificial Sequence: Synthetic oligonucleotide
tccattagtggtagaaacactaccatatactatgcagactctgtgaagggc

SEQ ID NO: 14150 - protein, 17 aa, Artificial Sequence
  Description of Artificial Sequence: Synthetic peptide
SISGRNTTIYYADSVKG

SEQ ID NO: 14151 - DNA, 51 bp, Artificial Sequence; identical to SEQ ID NO: 12619
  Description of Artificial Sequence: Synthetic oligonucleotide

SEQ ID NO: 14152 - protein, 17 aa, Artificial Sequence
  Description of Artificial Sequence: Synthetic peptide
AISGRGGNTFYADSVKG

SEQ ID NO: 14153 - DNA, 51 bp, Artificial Sequence; identical to SEQ ID NO: 12619
  Description of Artificial Sequence: Synthetic oligonucleotide

SEQ ID NO: 14154 - protein, 17 aa, Artificial Sequence
  Description of Artificial Sequence: Synthetic peptide
AISGRGGNTFYADSVKG

SEQ ID NO: 14155 - DNA, 51 bp, Artificial Sequence
  Description of Artificial Sequence: Synthetic oligonucleotide
attatctggtatgatggaagttataaatactatgcagactccgtgaagggc

SEQ ID NO: 14156 - protein, 17 aa, Artificial Sequence
  Description of Artificial Sequence: Synthetic peptide
IIWYDGSYKYYADSVKG

SEQ ID NO: 14157 - DNA, 51 bp, Artificial Sequence; identical to SEQ ID NO: 12619
  Description of Artificial Sequence: Synthetic oligonucleotide

SEQ ID NO: 14158 - protein, 17 aa, Artificial Sequence
  Description of Artificial Sequence: Synthetic peptide
AISGRGGNTFYADSVKG

SEQ ID NO: 14159 - DNA, 51 bp, Artificial Sequence
  Description of Artificial Sequence: Synthetic oligonucleotide
tggatgcaccctaacagtggtaacacaggctatgcacagaacttccagggc

SEQ ID NO: 14160 - protein, 17 aa, Artificial Sequence
  Description of Artificial Sequence: Synthetic peptide
WMHPNSGNTGYAQNFQG

SEQ ID NO: 14161 - DNA, 51 bp, Artificial Sequence; identical to SEQ ID NO: 13377
  Description of Artificial Sequence: Synthetic oligonucleotide

SEQ ID NO: 14162 - protein, 17 aa, Artificial Sequence
  Description of Artificial Sequence: Synthetic peptide
AISGSGGNTFYADSVKG

SEQ ID NO: 14163 - DNA, 51 bp, Artificial Sequence; identical to SEQ ID NO: 12123
  Description of Artificial Sequence: Synthetic oligonucleotide

SEQ ID NO: 14164 - protein, 17 aa, Artificial Sequence
  Description of Artificial Sequence: Synthetic peptide
VIWYDGSNKYYADSVKG

SEQ ID NO: 14165 - DNA, 51 bp, Artificial Sequence
  Description of Artificial Sequence: Synthetic oligonucleotide
tggatccaccctaacaatggtggcacaaactatgcacagacgtttcagggc

SEQ ID NO: 14166 - protein, 17 aa, Artificial Sequence
  Description of Artificial Sequence: Synthetic peptide
WIHPNNGGTNYAQTFQG

SEQ ID NO: 14167 - DNA, 51 bp, Artificial Sequence; identical to SEQ ID NO: 12103
  Description of Artificial Sequence: Synthetic oligonucleotide

SEQ ID NO: 14168 - protein, 17 aa, Artificial Sequence
  Description of Artificial Sequence: Synthetic peptide
WMNPNSGNTGYAQKFQG

SEQ ID NO: 14169 - DNA, 51 bp, Artificial Sequence; identical to SEQ ID NO: 12619
  Description of Artificial Sequence: Synthetic oligonucleotide

SEQ ID NO: 14170 - protein, 17 aa, Artificial Sequence
  Description of Artificial Sequence: Synthetic peptide
AISGRGGNTFYADSVKG

SEQ ID NO: 14171 - DNA, 51 bp, Artificial Sequence; identical to SEQ ID NO: 12127
  Description of Artificial Sequence: Synthetic oligonucleotide

SEQ ID NO: 14172 - protein, 17 aa, Artificial Sequence
  Description of Artificial Sequence: Synthetic peptide
IIWYDGSNKYYADSVKG

SEQ ID NO: 14173 - DNA, 51 bp, Artificial Sequence; identical to SEQ ID NO: 13611
  Description of Artificial Sequence: Synthetic oligonucleotide

SEQ ID NO: 14174 - protein, 17 aa, Artificial Sequence
  Description of Artificial Sequence: Synthetic peptide
VIWYDGSNKYYGDSVKG

SEQ ID NO: 14175 - DNA, 48 bp, Artificial Sequence
  Description of Artificial Sequence: Synthetic oligonucleotide
agtatctattatagtgggagcacctcctacaacccgtccctcaagagt

SEQ ID NO: 14176 - protein, 16 aa, Artificial Sequence
  Description of Artificial Sequence: Synthetic peptide
SIYYSGSTSYNPSLKS

SEQ ID NO: 14177 - DNA, 48 bp, Artificial Sequence; identical to SEQ ID NO: 12147
  Description of Artificial Sequence: Synthetic oligonucleotide

SEQ ID NO: 14178 - protein, 16 aa, Artificial Sequence
  Description of Artificial Sequence: Synthetic peptide
YIYYSGSTYYNPSLKS

SEQ ID NO: 14179 - DNA, 51 bp, Artificial Sequence; identical to SEQ ID NO: 14155
  Description of Artificial Sequence: Synthetic oligonucleotide

SEQ ID NO: 14180 - protein, 17 aa, Artificial Sequence
  Description of Artificial Sequence: Synthetic peptide
IIWYDGSYKYYADSVKG

SEQ ID NO: 14181 - DNA, 51 bp, Artificial Sequence; identical to SEQ ID NO: 13211
  Description of Artificial Sequence: Synthetic oligonucleotide

SEQ ID NO: 14182 - protein, 17 aa, Artificial Sequence
  Description of Artificial Sequence: Synthetic peptide
VIWYEGSNKYYADSVKG

SEQ ID NO: 14183 - DNA, 51 bp, Artificial Sequence; identical to SEQ ID NO: 14115
  Description of Artificial Sequence: Synthetic oligonucleotide

SEQ ID NO: 14184 - protein, 17 aa, Artificial Sequence
  Description of Artificial Sequence: Synthetic peptide
WVHPNSGNTGYAQKFQG

SEQ ID NO: 14185 - DNA, 51 bp, Artificial Sequence; identical to SEQ ID NO: 12619
  Description of Artificial Sequence: Synthetic oligonucleotide

SEQ ID NO: 14186 - protein, 17 aa, Artificial Sequence
  Description of Artificial Sequence: Synthetic peptide
AISGRGGNTFYADSVKG

SEQ ID NO: 14187 - DNA, 51 bp, Artificial Sequence; identical to SEQ ID NO: 12161
  Description of Artificial Sequence: Synthetic oligonucleotide

SEQ ID NO: 14188 - protein, 17 aa, Artificial Sequence
  Description of Artificial Sequence: Synthetic peptide
WMHPNSGNTGYAQKFQG

SEQ ID NO: 14189 - DNA, 51 bp, Artificial Sequence
  Description of Artificial Sequence: Synthetic oligonucleotide
tggatgcaccctaacagtggtaacacagactatgcacagaagttccagggc

SEQ ID NO: 14190 - protein, 17 aa, Artificial Sequence
  Description of Artificial Sequence: Synthetic peptide
WMHPNSGNTDYAQKFQG

SEQ ID NO: 14191 - DNA, 48 bp, Artificial Sequence; identical to SEQ ID NO: 12147
  Description of Artificial Sequence: Synthetic oligonucleotide

SEQ ID NO: 14192 - protein, 16 aa, Artificial Sequence
  Description of Artificial Sequence: Synthetic peptide
YIYYSGSTYYNPSLKS

SEQ ID NO: 14193 - DNA, 51 bp, Artificial Sequence; identical to SEQ ID NO: 12899
  Description of Artificial Sequence: Synthetic oligonucleotide

SEQ ID NO: 14194 - protein, 17 aa, Artificial Sequence
  Description of Artificial Sequence: Synthetic peptide
VISGSGGSTFYADSVKG

SEQ ID NO: 14195 - DNA, 51 bp, Artificial Sequence; identical to SEQ ID NO: 13377
  Description of Artificial Sequence: Synthetic oligonucleotide

SEQ ID NO: 14196 - protein, 17 aa, Artificial Sequence
  Description of Artificial Sequence: Synthetic peptide
AISGSGGNTFYADSVKG

SEQ ID NO: 14197 - DNA, 48 bp, Artificial Sequence; identical to SEQ ID NO: 14117
  Description of Artificial Sequence: Synthetic oligonucleotide

SEQ ID NO: 14198 - protein, 16 aa, Artificial Sequence
  Description of Artificial Sequence: Synthetic peptide
YSYYSGSTYYNPSLKS

SEQ ID NO: 14199 - DNA, 51 bp, Artificial Sequence; identical to SEQ ID NO: 12619
  Description of Artificial Sequence: Synthetic oligonucleotide

SEQ ID NO: 14200 - protein, 17 aa, Artificial Sequence
  Description of Artificial Sequence: Synthetic peptide
AISGRGGNTFYADSVKG

SEQ ID NO: 14201 - DNA, 51 bp, Artificial Sequence; identical to SEQ ID NO: 12167
  Description of Artificial Sequence: Synthetic oligonucleotide

SEQ ID NO: 14202 - protein, 17 aa, Artificial Sequence
  Description of Artificial Sequence: Synthetic peptide
VIWYDGSNKYYADSVKG

SEQ ID NO: 14203 - DNA, 51 bp, Artificial Sequence; identical to SEQ ID NO: 12619
  Description of Artificial Sequence: Synthetic oligonucleotide

SEQ ID NO: 14204 - protein, 17 aa, Artificial Sequence
  Description of Artificial Sequence: Synthetic peptide
AISGRGGNTFYADSVKG

SEQ ID NO: 14205 - DNA, 51 bp, Artificial Sequence
  Description of Artificial Sequence: Synthetic oligonucleotide
gttatatggtatgaagaaaataataaatactatgcagactccgtgaagggc

SEQ ID NO: 14206 - protein, 17 aa, Artificial Sequence
  Description of Artificial Sequence: Synthetic peptide
VIWYEENNKYYADSVKG

SEQ ID NO: 14207 - DNA, 51 bp, Artificial Sequence; identical to SEQ ID NO: 12161
  Description of Artificial Sequence: Synthetic oligonucleotide

SEQ ID NO: 14208 - protein, 17 aa, Artificial Sequence
  Description of Artificial Sequence: Synthetic peptide
WMHPNSGNTGYAQKFQG

SEQ ID NO: 14209 - DNA, 51 bp, Artificial Sequence; identical to SEQ ID NO: 12123
  Description of Artificial Sequence: Synthetic oligonucleotide

SEQ ID NO: 14210 - protein, 17 aa, Artificial Sequence
  Description of Artificial Sequence: Synthetic peptide
VIWYDGSNKYYADSVKG

SEQ ID NO: 14211 - DNA, 51 bp, Artificial Sequence; identical to SEQ ID NO: 13377
  Description of Artificial Sequence: Synthetic oligonucleotide

SEQ ID NO: 14212 - protein, 17 aa, Artificial Sequence
  Description of Artificial Sequence: Synthetic peptide
AISGSGGNTFYADSVKG

SEQ ID NO: 14213 - DNA, 51 bp, Artificial Sequence; identical to SEQ ID NO: 12161
  Description of Artificial Sequence: Synthetic oligonucleotide

SEQ ID NO: 14214 - protein, 17 aa, Artificial Sequence
  Description of Artificial Sequence: Synthetic peptide
WMHPNSGNTGYAQKFQG

SEQ ID NO: 14215 - DNA, 51 bp, Artificial Sequence; identical to SEQ ID NO: 14205
  Description of Artificial Sequence: Synthetic oligonucleotide

SEQ ID NO: 14216 - protein, 17 aa, Artificial Sequence
  Description of Artificial Sequence: Synthetic peptide
VIWYEENNKYYADSVKG

SEQ ID NO: 14217 - DNA, 51 bp, Artificial Sequence
  Description of Artificial Sequence: Synthetic oligonucleotide
tacattagtaggagtagtagtaccatatactacgcagactctgtgaagggc

SEQ ID NO: 14218 - protein, 17 aa, Artificial Sequence
  Description of Artificial Sequence: Synthetic peptide
YISRSSSTIYYADSVKG

SEQ ID NO: 14219 - DNA, 51 bp, Artificial Sequence; identical to SEQ ID NO: 12127
  Description of Artificial Sequence: Synthetic oligonucleotide

SEQ ID NO: 14220 - protein, 17 aa, Artificial Sequence
  Description of Artificial Sequence: Synthetic peptide
IIWYDGSNKYYADSVKG

SEQ ID NO: 14221 - DNA, 51 bp, Artificial Sequence; identical to SEQ ID NO: 13377
  Description of Artificial Sequence: Synthetic oligonucleotide

SEQ ID NO: 14222 - protein, 17 aa, Artificial Sequence
  Description of Artificial Sequence: Synthetic peptide
AISGSGGNTFYADSVKG

SEQ ID NO: 14223 - DNA, 51 bp, Artificial Sequence
  Description of Artificial Sequence: Synthetic oligonucleotide
gttatattctatgatggaagtaataaacactatgcagactccgtgaagggc

SEQ ID NO: 14224 - protein, 17 aa, Artificial Sequence
  Description of Artificial Sequence: Synthetic peptide
VIFYDGSNKHYADSVKG

SEQ ID NO: 14225 - DNA, 51 bp, Artificial Sequence; identical to SEQ ID NO: 12619
  Description of Artificial Sequence: Synthetic oligonucleotide

SEQ ID NO: 14226 - protein, 17 aa, Artificial Sequence
  Description of Artificial Sequence: Synthetic peptide
AISGRGGNTFYADSVKG

SEQ ID NO: 14227 - DNA, 51 bp, Artificial Sequence
  Description of Artificial Sequence: Synthetic oligonucleotide
tccattagtagtagtagttattacatatactacgcagactcagtgaagggc

SEQ ID NO: 14228 - protein, 17 aa, Artificial Sequence
  Description of Artificial Sequence: Synthetic peptide
SISSSSYYIYYADSVKG

SEQ ID NO: 14229 - DNA, 51 bp, Artificial Sequence; identical to SEQ ID NO: 12127
  Description of Artificial Sequence: Synthetic oligonucleotide

SEQ ID NO: 14230 - protein, 17 aa, Artificial Sequence
  Description of Artificial Sequence: Synthetic peptide
IIWYDGSNKYYADSVKG

SEQ ID NO: 14231 - DNA, 51 bp, Artificial Sequence
  Description of Artificial Sequence: Synthetic oligonucleotide
gctattagtggtagtggtaaaaacacattctacgcagactccgtgaagggc

SEQ ID NO: 14232 - protein, 17 aa, Artificial Sequence
  Description of Artificial Sequence: Synthetic peptide
AISGSGKNTFYADSVKG

SEQ ID NO: 14233 - DNA, 51 bp, Artificial Sequence; identical to SEQ ID NO: 12339
  Description of Artificial Sequence: Synthetic oligonucleotide

SEQ ID NO: 14234 - protein, 17 aa, Artificial Sequence
  Description of Artificial Sequence: Synthetic peptide
VISYDGSNKYYADSVKG

SEQ ID NO: 14235 - DNA, 51 bp, Artificial Sequence; identical to SEQ ID NO: 12127
  Description of Artificial Sequence: Synthetic oligonucleotide

SEQ ID NO: 14236 - protein, 17 aa, Artificial Sequence
  Description of Artificial Sequence: Synthetic peptide
IIWYDGSNKYYADSVKG

SEQ ID NO: 14237 - DNA, 51 bp, Artificial Sequence; identical to SEQ ID NO: 12619
  Description of Artificial Sequence: Synthetic oligonucleotide

SEQ ID NO: 14238 - protein, 17 aa, Artificial Sequence
  Description of Artificial Sequence: Synthetic peptide
AISGRGGNTFYADSVKG

SEQ ID NO: 14239 - DNA, 51 bp, Artificial Sequence; identical to SEQ ID NO: 12161
  Description of Artificial Sequence: Synthetic oligonucleotide

SEQ ID NO: 14240 - protein, 17 aa, Artificial Sequence
  Description of Artificial Sequence: Synthetic peptide
WMHPNSGNTGYAQKFQG

SEQ ID NO: 14241 - DNA, 51 bp, Artificial Sequence; identical to SEQ ID NO: 12161
  Description of Artificial Sequence: Synthetic oligonucleotide

SEQ ID NO: 14242 - protein, 17 aa, Artificial Sequence
  Description of Artificial Sequence: Synthetic peptide
WMHPNSGNTGYAQKFQG

SEQ ID NO: 14243 - DNA, 51 bp, Artificial Sequence; identical to SEQ ID NO: 12161
  Description of Artificial Sequence: Synthetic oligonucleotide

SEQ ID NO: 14244 - protein, 17 aa, Artificial Sequence
  Description of Artificial Sequence: Synthetic peptide
WMHPNSGNTGYAQKFQG

SEQ ID NO: 14245 - DNA, 51 bp, Artificial Sequence; identical to SEQ ID NO: 12619
  Description of Artificial Sequence: Synthetic oligonucleotide

SEQ ID NO: 14246 - protein, 17 aa, Artificial Sequence
  Description of Artificial Sequence: Synthetic peptide
AISGRGGNTFYADSVKG

SEQ ID NO: 14247 - DNA, 51 bp, Artificial Sequence; identical to SEQ ID NO: 12501
  Description of Artificial Sequence: Synthetic oligonucleotide

SEQ ID NO: 14248 - protein, 17 aa, Artificial Sequence
  Description of Artificial Sequence: Synthetic peptide
IIWYDGSYKYYADSVKG

SEQ ID NO: 14249 - DNA, 48 bp, Artificial Sequence
  Description of Artificial Sequence: Synthetic oligonucleotide
tacagttattacagtgggagcacctactacaacccgtccctcaagagt

SEQ ID NO: 14250 - protein, 16 aa, Artificial Sequence
  Description of Artificial Sequence: Synthetic peptide
YSYYSGSTYYNPSLKS

SEQ ID NO: 14251 - DNA, 51 bp, Artificial Sequence; identical to SEQ ID NO: 12123
  Description of Artificial Sequence: Synthetic oligonucleotide

SEQ ID NO: 14252 - protein, 17 aa, Artificial Sequence
  Description of Artificial Sequence: Synthetic peptide
VIWYDGSNKYYADSVKG

SEQ ID NO: 14253 - DNA, 51 bp, Artificial Sequence; identical to SEQ ID NO: 13377
  Description of Artificial Sequence: Synthetic oligonucleotide

SEQ ID NO: 14254 - protein, 17 aa, Artificial Sequence
  Description of Artificial Sequence: Synthetic peptide
AISGSGGNTFYADSVKG

SEQ ID NO: 14255 - DNA, 48 bp, Artificial Sequence; identical to SEQ ID NO: 13471
  Description of Artificial Sequence: Synthetic oligonucleotide

SEQ ID NO: 14256 - protein, 16 aa, Artificial Sequence
  Description of Artificial Sequence: Synthetic peptide
SIYYSGSASYNPSLKS

SEQ ID NO: 14257 - DNA, 48 bp, Artificial Sequence
  Description of Artificial Sequence: Synthetic oligonucleotide
cgtatcgataccagtgggatcaccaactacaacccctccctcaagagt

SEQ ID NO: 14258 - protein, 16 aa, Artificial Sequence
  Description of Artificial Sequence: Synthetic peptide
RIDTSGITNYNPSLKS

SEQ ID NO: 14259 - DNA, 51 bp, Artificial Sequence; identical to SEQ ID NO: 12619
  Description of Artificial Sequence: Synthetic oligonucleotide

SEQ ID NO: 14260 - protein, 17 aa, Artificial Sequence
  Description of Artificial Sequence: Synthetic peptide
AISGRGGNTFYADSVKG

SEQ ID NO: 14261 - DNA, 51 bp, Artificial Sequence; identical to SEQ ID NO: 12619
  Description of Artificial Sequence: Synthetic oligonucleotide

SEQ ID NO: 14262 - protein, 17 aa, Artificial Sequence
  Description of Artificial Sequence: Synthetic peptide
AISGRGGNTFYADSVKG

SEQ ID NO: 14263 - DNA, 51 bp, Artificial Sequence; identical to SEQ ID NO: 12127
  Description of Artificial Sequence: Synthetic oligonucleotide

SEQ ID NO: 14264 - protein, 17 aa, Artificial Sequence
  Description of Artificial Sequence: Synthetic peptide
IIWYDGSNKYYADSVKG

SEQ ID NO: 14265 - DNA, 51 bp, Artificial Sequence; identical to SEQ ID NO: 12103
  Description of Artificial Sequence: Synthetic oligonucleotide

SEQ ID NO: 14266 - protein, 17 aa, Artificial Sequence
  Description of Artificial Sequence: Synthetic peptide
WMNPNSGNTGYAQKFQG

SEQ ID NO: 14267 - DNA, 51 bp, Artificial Sequence
  Description of Artificial Sequence: Synthetic oligonucleotide
gctattagtggaagtggtgatagaacatactacgcagactccgtgaagggc

SEQ ID NO: 14268 - protein, 17 aa, Artificial Sequence
  Description of Artificial Sequence: Synthetic peptide
AISGSGDRTYYADSVKG

SEQ ID NO: 14269 - DNA, 51 bp, Artificial Sequence; identical to SEQ ID NO: 12501
  Description of Artificial Sequence: Synthetic oligonucleotide

SEQ ID NO: 14270 - protein, 17 aa, Artificial Sequence
  Description of Artificial Sequence: Synthetic peptide
IIWYDGSYKYYADSVKG

SEQ ID NO: 14271 - DNA, 48 bp, Artificial Sequence; identical to SEQ ID NO: 14117
  Description of Artificial Sequence: Synthetic oligonucleotide

SEQ ID NO: 14272 - protein, 16 aa, Artificial Sequence
  Description of Artificial Sequence: Synthetic peptide
YSYYSGSTYYNPSLKS

SEQ ID NO: 14273 - DNA, 48 bp, Artificial Sequence; identical to SEQ ID NO: 14257
  Description of Artificial Sequence: Synthetic oligonucleotide

SEQ ID NO: 14274 - protein, 16 aa, Artificial Sequence
  Description of Artificial Sequence: Synthetic peptide
RIDTSGITNYNPSLKS

SEQ ID NO: 14275 - DNA, 51 bp, Artificial Sequence
  Description of Artificial Sequence: Synthetic oligonucleotide
cttatattctatgatggaagtaataaatactatgcagactccgtgaagggc

SEQ ID NO: 14276 - protein, 17 aa, Artificial Sequence
  Description of Artificial Sequence: Synthetic peptide
LIFYDGSNKYYADSVKG

SEQ ID NO: 14277 - DNA, 51 bp, Artificial Sequence; identical to SEQ ID NO: 12161
  Description of Artificial Sequence: Synthetic oligonucleotide

SEQ ID NO: 14278 - protein, 17 aa, Artificial Sequence
  Description of Artificial Sequence: Synthetic peptide
WMHPNSGNTGYAQKFQG

SEQ ID NO: 14279 - DNA, 51 bp, Artificial Sequence; identical to SEQ ID NO: 12103
  Description of Artificial Sequence: Synthetic oligonucleotide

SEQ ID NO: 14280 - protein, 17 aa, Artificial Sequence
  Description of Artificial Sequence: Synthetic peptide
WMNPNSGNTGYAQKFQG

SEQ ID NO: 14281 - DNA, 51 bp, Artificial Sequence; identical to SEQ ID NO: 12619
  Description of Artificial Sequence: Synthetic oligonucleotide

SEQ ID NO: 14282 - protein, 17 aa, Artificial Sequence
  Description of Artificial Sequence: Synthetic peptide
AISGRGGNTFYADSVKG

SEQ ID NO: 14283 - DNA, 51 bp, Artificial Sequence; identical to SEQ ID NO: 12103
  Description of Artificial Sequence: Synthetic oligonucleotide

SEQ ID NO: 14284 - protein, 17 aa, Artificial Sequence
  Description of Artificial Sequence: Synthetic peptide
WMNPNSGNTGYAQKFQG

SEQ ID NO: 14285 - DNA, 51 bp, Artificial Sequence; identical to SEQ ID NO: 13377
  Description of Artificial Sequence: Synthetic oligonucleotide

SEQ ID NO: 14286 - protein, 17 aa, Artificial Sequence
  Description of Artificial Sequence: Synthetic peptide
AISGSGGNTFYADSVKG

SEQ ID NO: 14287 - DNA, 51 bp, Artificial Sequence; identical to SEQ ID NO: 13377
  Description of Artificial Sequence: Synthetic oligonucleotide

SEQ ID NO: 14288 - protein, 17 aa, Artificial Sequence
  Description of Artificial Sequence: Synthetic peptide
AISGSGGNTFYADSVKG

SEQ ID NO: 14289 - DNA, 51 bp, Artificial Sequence; identical to SEQ ID NO: 12619
  Description of Artificial Sequence: Synthetic oligonucleotide

SEQ ID NO: 14290 - protein, 17 aa, Artificial Sequence
  Description of Artificial Sequence: Synthetic peptide
AISGRGGNTFYADSVKG

SEQ ID NO: 14291 - DNA, 51 bp, Artificial Sequence
  Description of Artificial Sequence: Synthetic oligonucleotide
attatatggtatgatggaagtagtaaatactatgcagactccgtgaagggc

SEQ ID NO: 14292 - protein, 17 aa, Artificial Sequence
  Description of Artificial Sequence: Synthetic peptide
IIWYDGSSKYYADSVKG

SEQ ID NO: 14293 - DNA, 51 bp, Artificial Sequence
  Description of Artificial Sequence: Synthetic oligonucleotide
tggatgcaccctaacagtggtagtacaggctatgcacagaggttccagggc

SEQ ID NO: 14294 - protein, 17 aa, Artificial Sequence
  Description of Artificial Sequence: Synthetic peptide
WMHPNSGSTGYAQRFQG

SEQ ID NO: 14295 - DNA, 51 bp, Artificial Sequence; identical to SEQ ID NO: 12103
  Description of Artificial Sequence: Synthetic oligonucleotide

SEQ ID NO: 14296 - protein, 17 aa, Artificial Sequence
  Description of Artificial Sequence: Synthetic peptide
WMNPNSGNTGYAQKFQG

SEQ ID NO: 14297 - DNA, 51 bp, Artificial Sequence
  Description of Artificial Sequence: Synthetic oligonucleotide
actattagtggtagaggtcttggcacatactacgcagactccgtgaagggc

SEQ ID NO: 14298 - protein, 17 aa, Artificial Sequence
  Description of Artificial Sequence: Synthetic peptide
TISGRGLGTYYADSVKG

SEQ ID NO: 14299 - DNA, 48 bp, Artificial Sequence; identical to SEQ ID NO: 13471
  Description of Artificial Sequence: Synthetic oligonucleotide

SEQ ID NO: 14300 - protein, 16 aa, Artificial Sequence
  Description of Artificial Sequence: Synthetic peptide
SIYYSGSASYNPSLKS

SEQ ID NO: 14301 - DNA, 51 bp, Artificial Sequence; identical to SEQ ID NO: 14115
  Description of Artificial Sequence: Synthetic oligonucleotide

SEQ ID NO: 14302 - protein, 17 aa, Artificial Sequence
  Description of Artificial Sequence: Synthetic peptide
WVHPNSGNTGYAQKFQG

SEQ ID NO: 14303 - DNA, 51 bp, Artificial Sequence; identical to SEQ ID NO: 12619
  Description of Artificial Sequence: Synthetic oligonucleotide

SEQ ID NO: 14304 - protein, 17 aa, Artificial Sequence
  Description of Artificial Sequence: Synthetic peptide
AISGRGGNTFYADSVKG

SEQ ID NO: 14305 - DNA, 51 bp, Artificial Sequence
  Description of Artificial Sequence: Synthetic oligonucleotide
tccatgagtaatagtagtagttccatatactacgcagactcagtgaagggc

SEQ ID NO: 14306 - protein, 17 aa, Artificial Sequence
  Description of Artificial Sequence: Synthetic peptide
SMSNSSSSIYYADSVKG

SEQ ID NO: 14307 - DNA, 51 bp, Artificial Sequence
  Description of Artificial Sequence: Synthetic oligonucleotide
gatattagtggtagtggtggtaccacatactacgcagactccgtgaagggc

SEQ ID NO: 14308 - protein, 17 aa, Artificial Sequence
  Description of Artificial Sequence: Synthetic peptide
DISGSGGTTYYADSVKG

SEQ ID NO: 14309 - DNA, 51 bp, Artificial Sequence
  Description of Artificial Sequence: Synthetic oligonucleotide
gttatatggtatgatgtaaataataaatactatgcagactccgtgaagggc

SEQ ID NO: 14310 - protein, 17 aa, Artificial Sequence
  Description of Artificial Sequence: Synthetic peptide
VIWYDVNNKYYADSVKG

SEQ ID NO: 14311 - DNA, 51 bp, Artificial Sequence; identical to SEQ ID NO: 12273
  Description of Artificial Sequence: Synthetic oligonucleotide

SEQ ID NO: 14312 - protein, 17 aa, Artificial Sequence
  Description of Artificial Sequence: Synthetic peptide
VISGSGGSTYYADSVKG

SEQ ID NO: 14313 - DNA, 51 bp, Artificial Sequence; identical to SEQ ID NO: 12153
  Description of Artificial Sequence: Synthetic oligonucleotide

SEQ ID NO: 14314 - protein, 17 aa, Artificial Sequence
  Description of Artificial Sequence: Synthetic peptide
SISGSSSYIYYADSVKG

SEQ ID NO: 14315 - DNA, 51 bp, Artificial Sequence; identical to SEQ ID NO: 12221
  Description of Artificial Sequence: Synthetic oligonucleotide

SEQ ID NO: 14316 - protein, 17 aa, Artificial Sequence
  Description of Artificial Sequence: Synthetic peptide
SISSSSTYIYYADSVKG

SEQ ID NO: 14317 - DNA, 51 bp, Artificial Sequence; identical to SEQ ID NO: 13515
  Description of Artificial Sequence: Synthetic oligonucleotide

SEQ ID NO: 14318 - protein, 17 aa, Artificial Sequence
  Description of Artificial Sequence: Synthetic peptide
AMSGSGGRTYYADSVKG

SEQ ID NO: 14319 - DNA, 48 bp, Artificial Sequence
  Description of Artificial Sequence: Synthetic oligonucleotide
agtatctactatagtgggagcacctactacaatccgtccctcaagagt

SEQ ID NO: 14320 - protein, 16 aa, Artificial Sequence
  Description of Artificial Sequence: Synthetic peptide
SIYYSGSTYYNPSLKS

SEQ ID NO: 14321 - DNA, 51 bp, Artificial Sequence
  Description of Artificial Sequence: Synthetic oligonucleotide
tccattagtggtagtagtacgtacatatactacgcagactcagtgaagggc

SEQ ID NO: 14322 - protein, 17 aa, Artificial Sequence
  Description of Artificial Sequence: Synthetic peptide
SISGSSTYIYYADSVKG

SEQ ID NO: 14323 - DNA, 51 bp, Artificial Sequence
  Description of Artificial Sequence: Synthetic oligonucleotide
tgcattagtggtagtagtagttacatatattatgcagactcagtgaagggc

SEQ ID NO: 14324 - protein, 17 aa, Artificial Sequence
  Description of Artificial Sequence: Synthetic peptide
CISGSSSYIYYADSVKG

SEQ ID NO: 14325 - DNA, 51 bp, Artificial Sequence; identical to SEQ ID NO: 12501
  Description of Artificial Sequence: Synthetic oligonucleotide

SEQ ID NO: 14326 - protein, 17 aa, Artificial Sequence
  Description of Artificial Sequence: Synthetic peptide
IIWYDGSYKYYADSVKG

SEQ ID NO: 14327 - DNA, 51 bp, Artificial Sequence; identical to SEQ ID NO: 14309
  Description of Artificial Sequence: Synthetic oligonucleotide

SEQ ID NO: 14328 - protein, 17 aa, Artificial Sequence
  Description of Artificial Sequence: Synthetic peptide
VIWYDVNNKYYADSVKG

SEQ ID NO: 14329 - DNA, 51 bp, Artificial Sequence
  Description of Artificial Sequence: Synthetic oligonucleotide
tccattagtggtagcagtagttacataaactacgcagactcagtgaagggc

SEQ ID NO: 14330 - protein, 17 aa, Artificial Sequence
  Description of Artificial Sequence: Synthetic peptide
SISGSSSYINYADSVKG

SEQ ID NO: 14331 - DNA, 51 bp, Artificial Sequence
  Description of Artificial Sequence: Synthetic oligonucleotide
tccattagtggtagtggtagttacataaactacgcagactcagtgaagggc

SEQ ID NO: 14332 - protein, 17 aa, Artificial Sequence
  Description of Artificial Sequence: Synthetic peptide
SISGSGSYINYADSVKG

SEQ ID NO: 14333 - DNA, 51 bp, Artificial Sequence; identical to SEQ ID NO: 12785
  Description of Artificial Sequence: Synthetic oligonucleotide

SEQ ID NO: 14334 - protein, 17 aa, Artificial Sequence
  Description of Artificial Sequence: Synthetic peptide
SISGSGSYIYYADSVKG

SEQ ID NO: 14335 - DNA, 51 bp, Artificial Sequence; identical to SEQ ID NO: 12123
  Description of Artificial Sequence: Synthetic oligonucleotide

SEQ ID NO: 14336 - protein, 17 aa, Artificial Sequence
  Description of Artificial Sequence: Synthetic peptide
VIWYDGSNKYYADSVKG

SEQ ID NO: 14337 - DNA, 48 bp, Artificial Sequence
  Description of Artificial Sequence: Synthetic oligonucleotide
cgtatctataccagtgggaccaccaactacaccccctccctcaagagt

SEQ ID NO: 14338 - protein, 16 aa, Artificial Sequence
  Description of Artificial Sequence: Synthetic peptide
RIYTSGTTNYTPSLKS

SEQ ID NO: 14339 - DNA, 51 bp, Artificial Sequence; identical to SEQ ID NO: 14321
  Description of Artificial Sequence: Synthetic oligonucleotide

SEQ ID NO: 14340 - protein, 17 aa, Artificial Sequence
  Description of Artificial Sequence: Synthetic peptide
SISGSSTYIYYADSVKG

SEQ ID NO: 14341 - DNA, 51 bp, Artificial Sequence
  Description of Artificial Sequence: Synthetic oligonucleotide
tccatcagtggtagtagtacttacatatactacgcagactcagtgaagggc

SEQ ID NO: 14342 - protein, 17 aa, Artificial Sequence
  Description of Artificial Sequence: Synthetic peptide
SISGSSTYIYYADSVKG

SEQ ID NO: 14343 - DNA, 51 bp, Artificial Sequence; identical to SEQ ID NO: 12269
  Description of Artificial Sequence: Synthetic oligonucleotide

SEQ ID NO: 14344 - protein, 17 aa, Artificial Sequence
  Description of Artificial Sequence: Synthetic peptide
VIWYDVTNKYYADSVKG

SEQ ID NO: 14345 - DNA, 51 bp, Artificial Sequence
  Description of Artificial Sequence: Synthetic oligonucleotide
ttgattagtggcagtagtagttacatatactacgcagactcagtgaagggc

SEQ ID NO: 14346 - protein, 17 aa, Artificial Sequence
  Description of Artificial Sequence: Synthetic peptide
LISGSSSYIYYADSVKG

SEQ ID NO: 14347 - DNA, 51 bp, Artificial Sequence; identical to SEQ ID NO: 12161
  Description of Artificial Sequence: Synthetic oligonucleotide

SEQ ID NO: 14348 - protein, 17 aa, Artificial Sequence
  Description of Artificial Sequence: Synthetic peptide
WMHPNSGNTGYAQKFQG

SEQ ID NO: 14349 - DNA, 51 bp, Artificial Sequence
  Description of Artificial Sequence: Synthetic oligonucleotide
gctattagtggtagtggtggtaggacagactacgcagactccgtaaagggc

SEQ ID NO: 14350 - protein, 17 aa, Artificial Sequence
  Description of Artificial Sequence: Synthetic peptide
AISGSGGRTDYADSVKG

SEQ ID NO: 14351 - DNA, 51 bp, Artificial Sequence
  Description of Artificial Sequence: Synthetic oligonucleotide
tccataagtggtagtggtaattacatagactacgcagactcagtgaagggc

SEQ ID NO: 14352 - protein, 17 aa, Artificial Sequence
  Description of Artificial Sequence: Synthetic peptide
SISGSGNYIDYADSVKG

SEQ ID NO: 14353 - DNA, 51 bp, Artificial Sequence
  Description of Artificial Sequence: Synthetic oligonucleotide
tggatgaaccctaacagtggtaacacaggctatgtacagaagttccagggc

SEQ ID NO: 14354 - protein, 17 aa, Artificial Sequence
  Description of Artificial Sequence: Synthetic peptide
WMNPNSGNTGYVQKFQG

SEQ ID NO: 14355 - DNA, 51 bp, Artificial Sequence
  Description of Artificial Sequence: Synthetic oligonucleotide
gttatatcatattctggaaacaataaatactatgcagactccgtgaagggc

SEQ ID NO: 14356 - protein, 17 aa, Artificial Sequence
  Description of Artificial Sequence: Synthetic peptide
VISYSGNNKYYADSVKG

SEQ ID NO: 14357 - DNA, 51 bp, Artificial Sequence
  Description of Artificial Sequence: Synthetic oligonucleotide
gttgtatggtatgatgtaaataataaatactatgcagactccgtgaagggc

SEQ ID NO: 14358 - protein, 17 aa, Artificial Sequence
  Description of Artificial Sequence: Synthetic peptide
VVWYDVNNKYYADSVKG

SEQ ID NO: 14359 - DNA, 51 bp, Artificial Sequence; identical to SEQ ID NO: 12123
  Description of Artificial Sequence: Synthetic oligonucleotide

SEQ ID NO: 14360 - protein, 17 aa, Artificial Sequence
  Description of Artificial Sequence: Synthetic peptide
VIWYDGSNKYYADSVKG

SEQ ID NO: 14361 - DNA, 51 bp, Artificial Sequence; identical to SEQ ID NO: 12123
  Description of Artificial Sequence: Synthetic oligonucleotide

SEQ ID NO: 14362 - protein, 17 aa, Artificial Sequence
  Description of Artificial Sequence: Synthetic peptide
VIWYDGSNKYYADSVKG

SEQ ID NO: 14363 - DNA, 51 bp, Artificial Sequence; identical to SEQ ID NO: 12153
  Description of Artificial Sequence: Synthetic oligonucleotide

SEQ ID NO: 14364 - protein, 17 aa, Artificial Sequence
  Description of Artificial Sequence: Synthetic peptide
SISGSSSYIYYADSVKG

SEQ ID NO: 14365 - DNA, 51 bp, Artificial Sequence; identical to SEQ ID NO: 14113
  Description of Artificial Sequence: Synthetic oligonucleotide

SEQ ID NO: 14366 - protein, 17 aa, Artificial Sequence
  Description of Artificial Sequence: Synthetic peptide
VIWYDGSYKYYADSVKG

SEQ ID NO: 14367 - DNA, 51 bp, Artificial Sequence
  Description of Artificial Sequence: Synthetic oligonucleotide
gctatgagtggtagtggtggtcacacatactacgcagactccgtgaagggc

SEQ ID NO: 14368 - protein, 17 aa, Artificial Sequence
  Description of Artificial Sequence: Synthetic peptide
AMSGSGGHTYYADSVKG

SEQ ID NO: 14369 - DNA, 51 bp, Artificial Sequence
  Description of Artificial Sequence: Synthetic oligonucleotide
tccattagtagtagtactggttacatgtactacgcagactcagtgaagggc

SEQ ID NO: 14370 - protein, 17 aa, Artificial Sequence
  Description of Artificial Sequence: Synthetic peptide
SISSSTGYMYYADSVKG

SEQ ID NO: 14371 - DNA, 51 bp, Artificial Sequence; identical to SEQ ID NO: 12785
  Description of Artificial Sequence: Synthetic oligonucleotide

SEQ ID NO: 14372 - protein, 17 aa, Artificial Sequence
  Description of Artificial Sequence: Synthetic peptide
SISGSGSYIYYADSVKG

SEQ ID NO: 14373 - DNA, 51 bp, Artificial Sequence; identical to SEQ ID NO: 14367
  Description of Artificial Sequence: Synthetic oligonucleotide

SEQ ID NO: 14374 - protein, 17 aa, Artificial Sequence
  Description of Artificial Sequence: Synthetic peptide
AMSGSGGHTYYADSVKG

SEQ ID NO: 14375 - DNA, 48 bp, Artificial Sequence
  Description of Artificial Sequence: Synthetic oligonucleotide
agtatctattatagtgggagtacctcctacaacccgtctctcgagagt

SEQ ID NO: 14376 - protein, 16 aa, Artificial Sequence
  Description of Artificial Sequence: Synthetic peptide
SIYYSGSTSYNPSLES

SEQ ID NO: 14377 - DNA, 51 bp, Artificial Sequence
  Description of Artificial Sequence: Synthetic oligonucleotide
tggatgcaccctaacagtggtaacacaggctatccacagaagttccagggc

SEQ ID NO: 14378 - protein, 17 aa, Artificial Sequence
  Description of Artificial Sequence: Synthetic peptide
WMHPNSGNTGYPQKFQG

SEQ ID NO: 14379 - DNA, 51 bp, Artificial Sequence; identical to SEQ ID NO: 12123
  Description of Artificial Sequence: Synthetic oligonucleotide

SEQ ID NO: 14380 - protein, 17 aa, Artificial Sequence
  Description of Artificial Sequence: Synthetic peptide
VIWYDGSNKYYADSVKG

SEQ ID NO: 14381 - DNA, 51 bp, Artificial Sequence; identical to SEQ ID NO: 14321
  Description of Artificial Sequence: Synthetic oligonucleotide

SEQ ID NO: 14382 - protein, 17 aa, Artificial Sequence
  Description of Artificial Sequence: Synthetic peptide
SISGSSTYIYYADSVKG

SEQ ID NO: 14383 - DNA, 51 bp, Artificial Sequence
  Description of Artificial Sequence: Synthetic oligonucleotide
tccattagtggtagtagtagttacatagactacgcagactcagtgaagggc

SEQ ID NO: 14384 - protein, 17 aa, Artificial Sequence
  Description of Artificial Sequence: Synthetic peptide
SISGSSSYIDYADSVKG

SEQ ID NO: 14385 - DNA, 48 bp, Artificial Sequence
  Description of Artificial Sequence: Synthetic oligonucleotide
aatatctattatagtgggagcgcctaccacattccgtccctcaagagt

SEQ ID NO: 14386 - protein, 16 aa, Artificial Sequence
  Description of Artificial Sequence: Synthetic peptide
NIYYSGSAYHIPSLKS

SEQ ID NO: 14387 - DNA, 51 bp, Artificial Sequence
  Description of Artificial Sequence: Synthetic oligonucleotide
gtcatatggtatgatggaagttataaatactatgcagactccgtgaagggc

SEQ ID NO: 14388 - protein, 17 aa, Artificial Sequence
  Description of Artificial Sequence: Synthetic peptide
VIWYDGSYKYYADSVKG

SEQ ID NO: 14389 - DNA, 48 bp, Artificial Sequence
  Description of Artificial Sequence: Synthetic oligonucleotide
gttatttataccggtggtagcacatacaacgcagactccgtgaagggc

SEQ ID NO: 14390 - protein, 16 aa, Artificial Sequence
  Description of Artificial Sequence: Synthetic peptide
VIYTGGSTYNADSVKG

SEQ ID NO: 14391 - DNA, 51 bp, Artificial Sequence; identical to SEQ ID NO: 13379
  Description of Artificial Sequence: Synthetic oligonucleotide

SEQ ID NO: 14392 - protein, 17 aa, Artificial Sequence
  Description of Artificial Sequence: Synthetic peptide
VISYGGSNKYHADSVKG

SEQ ID NO: 14393 - DNA, 51 bp, Artificial Sequence; identical to SEQ ID NO: 12227
  Description of Artificial Sequence: Synthetic oligonucleotide

SEQ ID NO: 14394 - protein, 17 aa, Artificial Sequence
  Description of Artificial Sequence: Synthetic peptide
VIWFDGSNKYYADSVKG

SEQ ID NO: 14395 - DNA, 51 bp, Artificial Sequence
  Description of Artificial Sequence: Synthetic oligonucleotide
attatatcatattctggaagaaatgatttctatgcagactccgtgaagggc

SEQ ID NO: 14396 - protein, 17 aa, Artificial Sequence
  Description of Artificial Sequence: Synthetic peptide
IISYSGRNDFYADSVKG

SEQ ID NO: 14397 - DNA, 51 bp, Artificial Sequence; identical to SEQ ID NO: 12227
  Description of Artificial Sequence: Synthetic oligonucleotide

SEQ ID NO: 14398 - protein, 17 aa, Artificial Sequence
  Description of Artificial Sequence: Synthetic peptide
VIWFDGSNKYYADSVKG

SEQ ID NO: 14399 - DNA, 51 bp, Artificial Sequence; identical to SEQ ID NO: 12123
  Description of Artificial Sequence: Synthetic oligonucleotide

SEQ ID NO: 14400 - protein, 17 aa, Artificial Sequence
  Description of Artificial Sequence: Synthetic peptide
VIWYDGSNKYYADSVKG

SEQ ID NO: 14401 - DNA, 51 bp, Artificial Sequence; identical to SEQ ID NO: 14321
  Description of Artificial Sequence: Synthetic oligonucleotide

SEQ ID NO: 14402 - protein, 17 aa, Artificial Sequence
  Description of Artificial Sequence: Synthetic peptide
SISGSSTYIYYADSVKG

SEQ ID NO: 14403 - DNA, 51 bp, Artificial Sequence; identical to SEQ ID NO: 14321
  Description of Artificial Sequence: Synthetic oligonucleotide

SEQ ID NO: 14404 - protein, 17 aa, Artificial Sequence
  Description of Artificial Sequence: Synthetic peptide
SISGSSTYIYYADSVKG

SEQ ID NO: 14405 - DNA, 51 bp, Artificial Sequence; identical to SEQ ID NO: 12161
  Description of Artificial Sequence: Synthetic oligonucleotide

SEQ ID NO: 14406 - protein, 17 aa, Artificial Sequence
  Description of Artificial Sequence: Synthetic peptide
WMHPNSGNTGYAQKFQG

SEQ ID NO: 14407 - DNA, 51 bp, Artificial Sequence; identical to SEQ ID NO: 12161
  Description of Artificial Sequence: Synthetic oligonucleotide

SEQ ID NO: 14408 - protein, 17 aa, Artificial Sequence
  Description of Artificial Sequence: Synthetic peptide
WMHPNSGNTGYAQKFQG

SEQ ID NO: 14409 - DNA, 51 bp, Artificial Sequence; identical to SEQ ID NO: 12123
  Description of Artificial Sequence: Synthetic oligonucleotide

SEQ ID NO: 14410 - protein, 17 aa, Artificial Sequence
  Description of Artificial Sequence: Synthetic peptide
VIWYDGSNKYYADSVKG

SEQ ID NO: 14411 - DNA, 51 bp, Artificial Sequence; identical to SEQ ID NO: 12785
  Description of Artificial Sequence: Synthetic oligonucleotide

SEQ ID NO: 14412 - protein, 17 aa, Artificial Sequence
  Description of Artificial Sequence: Synthetic peptide
SISGSGSYIYYADSVKG

SEQ ID NO: 14413 - DNA, 51 bp, Artificial Sequence
  Description of Artificial Sequence: Synthetic oligonucleotide
tccactagtgggagttctacttacatatactacgcagactcagtgaagggc

SEQ ID NO: 14414 - protein, 17 aa, Artificial Sequence
  Description of Artificial Sequence: Synthetic peptide
STSGSSTYIYYADSVKG

SEQ ID NO: 14415 - DNA, 51 bp, Artificial Sequence
  Description of Artificial Sequence: Synthetic oligonucleotide
tccattagtggtagtagtgcttacatatactacgcagactcagtgaagggc

SEQ ID NO: 14416 - protein, 17 aa, Artificial Sequence
  Description of Artificial Sequence: Synthetic peptide
SISGSSAYIYYADSVKG

SEQ ID NO: 14417 - DNA, 51 bp, Artificial Sequence; identical to SEQ ID NO: 12701
  Description of Artificial Sequence: Synthetic oligonucleotide

SEQ ID NO: 14418 - protein, 17 aa, Artificial Sequence
  Description of Artificial Sequence: Synthetic peptide
SISGSSTYIYYADSVKG

SEQ ID NO: 14419 - DNA, 51 bp, Artificial Sequence; identical to SEQ ID NO: 12701
  Description of Artificial Sequence: Synthetic oligonucleotide

SEQ ID NO: 14420 - protein, 17 aa, Artificial Sequence
  Description of Artificial Sequence: Synthetic peptide
SISGSSTYIYYADSVKG

SEQ ID NO: 14421 - DNA, 51 bp, Artificial Sequence
  Description of Artificial Sequence: Synthetic oligonucleotide
tggatgcaccctaacagtcataagacaggctatgcacagaagttccagggc

SEQ ID NO: 14422 - protein, 17 aa, Artificial Sequence
  Description of Artificial Sequence: Synthetic peptide
WMHPNSHKTGYAQKFQG

SEQ ID NO: 14423 - DNA, 51 bp, Artificial Sequence
  Description of Artificial Sequence: Synthetic oligonucleotide
tccattagtgggagtagtagttacagttactacgcagactcagtgaagggc

SEQ ID NO: 14424 - protein, 17 aa, Artificial Sequence
  Description of Artificial Sequence: Synthetic peptide
SISGSSSYSYYADSVKG

SEQ ID NO: 14425 - DNA, 51 bp, Artificial Sequence
  Description of Artificial Sequence: Synthetic oligonucleotide
gtcatatggtatgatggaacttataaatactatgcagactccgtgaagggc

SEQ ID NO: 14426 - protein, 17 aa, Artificial Sequence
  Description of Artificial Sequence: Synthetic peptide
VIWYDGTYKYYADSVKG

SEQ ID NO: 14427 - DNA, 51 bp, Artificial Sequence
  Description of Artificial Sequence: Synthetic oligonucleotide
gtcatatggtatgatggaagttataagtaccatgcagactccgtgaagggc

SEQ ID NO: 14428 - protein, 17 aa, Artificial Sequence
  Description of Artificial Sequence: Synthetic peptide
VIWYDGSYKYHADSVKG

SEQ ID NO: 14429 - DNA, 51 bp, Artificial Sequence; identical to SEQ ID NO: 13515
  Description of Artificial Sequence: Synthetic oligonucleotide

SEQ ID NO: 14430 - protein, 17 aa, Artificial Sequence
  Description of Artificial Sequence: Synthetic peptide
AMSGSGGRTYYADSVKG

SEQ ID NO: 14431 - DNA, 51 bp, Artificial Sequence
  Description of Artificial Sequence: Synthetic oligonucleotide
gttatatggtatgatggaagtaataaatactatgcagactccgtgaggggc

SEQ ID NO: 14432 - protein, 17 aa, Artificial Sequence
  Description of Artificial Sequence: Synthetic peptide
VIWYDGSNKYYADSVRG

SEQ ID NO: 14433 - DNA, 48 bp, Artificial Sequence; identical to SEQ ID NO: 14257
  Description of Artificial Sequence: Synthetic oligonucleotide

SEQ ID NO: 14434 - protein, 16 aa, Artificial Sequence
  Description of Artificial Sequence: Synthetic peptide
RIDTSGITNYNPSLKS

SEQ ID NO: 14435 - DNA, 51 bp, Artificial Sequence
  Description of Artificial Sequence: Synthetic oligonucleotide
tacattagccttagtggtagtaccataaagtacgcagactctgtgaagggc

SEQ ID NO: 14436 - protein, 17 aa, Artificial Sequence
  Description of Artificial Sequence: Synthetic peptide
YISLSGSTIKYADSVKG

SEQ ID NO: 14437 - DNA, 51 bp, Artificial Sequence
  Description of Artificial Sequence: Synthetic oligonucleotide
attatatggtatgatggaactaataaatactatgcagactccgtgaagggc

SEQ ID NO: 14438 - protein, 17 aa, Artificial Sequence
  Description of Artificial Sequence: Synthetic peptide
IIWYDGTNKYYADSVKG

SEQ ID NO: 14439 - DNA, 48 bp, Artificial Sequence; identical to SEQ ID NO: 14257
  Description of Artificial Sequence: Synthetic oligonucleotide

SEQ ID NO: 14440 - protein, 16 aa, Artificial Sequence
  Description of Artificial Sequence: Synthetic peptide
RIDTSGITNYNPSLKS

SEQ ID NO: 14441 - DNA, 51 bp, Artificial Sequence
  Description of Artificial Sequence: Synthetic oligonucleotide
tacattagcattagtagtagtaccataaagtacgcagactctgtgaagggc

SEQ ID NO: 14442 - protein, 17 aa, Artificial Sequence
  Description of Artificial Sequence: Synthetic peptide
YISISSSTIKYADSVKG

SEQ ID NO: 14443 - DNA, 48 bp, Artificial Sequence
  Description of Artificial Sequence: Synthetic oligonucleotide
cgtatctataccagtgggagcaccaactacaacccctccctcaagagt

SEQ ID NO: 14444 - protein, 16 aa, Artificial Sequence
  Description of Artificial Sequence: Synthetic peptide
RIYTSGSTNYNPSLKS

SEQ ID NO: 14445 - DNA, 51 bp, Artificial Sequence
  Description of Artificial Sequence: Synthetic oligonucleotide
tggatcaagcctaagagtggtggcacaaactctgcacagaggtttcagggc

SEQ ID NO: 14446 - protein, 17 aa, Artificial Sequence
  Description of Artificial Sequence: Synthetic peptide
WIKPKSGGTNSAQRFQG

SEQ ID NO: 14447 - DNA, 51 bp, Artificial Sequence
  Description of Artificial Sequence: Synthetic oligonucleotide
gctattagtggtagtggtagtagaatatactacgcggactccgtgaagggc

SEQ ID NO: 14448 - protein, 17 aa, Artificial Sequence
  Description of Artificial Sequence: Synthetic peptide
AISGSGSRIYYADSVKG

SEQ ID NO: 14449 - DNA, 51 bp, Artificial Sequence; identical to SEQ ID NO: 12123
  Description of Artificial Sequence: Synthetic oligonucleotide

SEQ ID NO: 14450 - protein, 17 aa, Artificial Sequence
  Description of Artificial Sequence: Synthetic peptide
VIWYDGSNKYYADSVKG

SEQ ID NO: 14451 - DNA, 51 bp, Artificial Sequence
  Description of Artificial Sequence: Synthetic oligonucleotide
attatatggtatgatggaagttataaatactatgcagattccgtgaagggc

SEQ ID NO: 14452 - protein, 17 aa, Artificial Sequence
  Description of Artificial Sequence: Synthetic peptide
IIWYDGSYKYYADSVKG

SEQ ID NO: 14453 - DNA, 51 bp, Artificial Sequence
  Description of Artificial Sequence: Synthetic oligonucleotide
gctattagtggtagtggtaatagaatatactacgcagactccgtgaagggc

SEQ ID NO: 14454 - protein, 17 aa, Artificial Sequence
  Description of Artificial Sequence: Synthetic peptide
AISGSGNRIYYADSVKG

SEQ ID NO: 14455 - DNA, 48 bp, Artificial Sequence; identical to SEQ ID NO: 14443
  Description of Artificial Sequence: Synthetic oligonucleotide

SEQ ID NO: 14456 - protein, 16 aa, Artificial Sequence
  Description of Artificial Sequence: Synthetic peptide
RIYTSGSTNYNPSLKS

SEQ ID NO: 14457 - DNA, 51 bp, Artificial Sequence
  Description of Artificial Sequence: Synthetic oligonucleotide
gttatatggtatgatggaagtaataaatactatgaagactccgtgaagggc

SEQ ID NO: 14458 - protein, 17 aa, Artificial Sequence
  Description of Artificial Sequence: Synthetic peptide
VIWYDGSNKYYEDSVKG

SEQ ID NO: 14459 - DNA, 51 bp, Artificial Sequence; identical to SEQ ID NO: 14437
  Description of Artificial Sequence: Synthetic oligonucleotide

SEQ ID NO: 14460 - protein, 17 aa, Artificial Sequence
  Description of Artificial Sequence: Synthetic peptide
IIWYDGTNKYYADSVKG

SEQ ID NO: 14461 - DNA, 51 bp, Artificial Sequence; identical to SEQ ID NO: 14437
  Description of Artificial Sequence: Synthetic oligonucleotide

SEQ ID NO: 14462 - protein, 17 aa, Artificial Sequence
  Description of Artificial Sequence: Synthetic peptide
IIWYDGTNKYYADSVKG

SEQ ID NO: 14463 - DNA, 51 bp, Artificial Sequence
  Description of Artificial Sequence: Synthetic oligonucleotide
attatatggtatgatgggactaataaatactatgcagactccgtgaagggc

SEQ ID NO: 14464 - protein, 17 aa, Artificial Sequence
  Description of Artificial Sequence: Synthetic peptide
IIWYDGTNKYYADSVKG

SEQ ID NO: 14465 - DNA, 51 bp, Artificial Sequence
  Description of Artificial Sequence: Synthetic oligonucleotide
tggatcaagcctaacagtggtggcacaaactctgcacagaggtttcagggc

SEQ ID NO: 14466 - protein, 17 aa, Artificial Sequence
  Description of Artificial Sequence: Synthetic peptide
WIKPNSGGTNSAQRFQG

SEQ ID NO: 14467 - DNA, 51 bp, Artificial Sequence; identical to SEQ ID NO: 13923
  Description of Artificial Sequence: Synthetic oligonucleotide

SEQ ID NO: 14468 - protein, 17 aa, Artificial Sequence
  Description of Artificial Sequence: Synthetic peptide
WMNPNSGNTGYAQKFQD

SEQ ID NO: 14469 - DNA, 51 bp, Artificial Sequence; identical to SEQ ID NO: 14437
  Description of Artificial Sequence: Synthetic oligonucleotide

SEQ ID NO: 14470 - protein, 17 aa, Artificial Sequence
  Description of Artificial Sequence: Synthetic peptide
IIWYDGTNKYYADSVKG

SEQ ID NO: 14471 - DNA, 51 bp, Artificial Sequence; identical to SEQ ID NO: 14463
  Description of Artificial Sequence: Synthetic oligonucleotide

SEQ ID NO: 14472 - protein, 17 aa, Artificial Sequence
  Description of Artificial Sequence: Synthetic peptide
IIWYDGTNKYYADSVKG

SEQ ID NO: 14473 - DNA, 51 bp, Artificial Sequence; identical to SEQ ID NO: 12127
  Description of Artificial Sequence: Synthetic oligonucleotide

SEQ ID NO: 14474 - protein, 17 aa, Artificial Sequence
  Description of Artificial Sequence: Synthetic peptide
IIWYDGSNKYYADSVKG

SEQ ID NO: 14475 - DNA, 51 bp, Artificial Sequence
  Description of Artificial Sequence: Synthetic oligonucleotide
gctattagtggtcgtggtggtaccacgttctacgcagactccgtgaggggc

SEQ ID NO: 14476 - protein, 17 aa, Artificial Sequence
  Description of Artificial Sequence: Synthetic peptide
AISGRGGTTFYADSVRG

SEQ ID NO: 14477 - DNA, 51 bp, Artificial Sequence
  Description of Artificial Sequence: Synthetic oligonucleotide
gttatatcatatgacggaaacaatagacactatgcagactccgtgcagggc

SEQ ID NO: 14478 - protein, 17 aa, Artificial Sequence
  Description of Artificial Sequence: Synthetic peptide
VISYDGNNRHYADSVQG

SEQ ID NO: 14479 - DNA, 51 bp, Artificial Sequence
  Description of Artificial Sequence: Synthetic oligonucleotide
gttattagtggtagtggtggtagcacattctacacagactccgtgaagggc

SEQ ID NO: 14480 - protein, 17 aa, Artificial Sequence
  Description of Artificial Sequence: Synthetic peptide
VISGSGGSTFYTDSVKG

SEQ ID NO: 14481 - DNA, 51 bp, Artificial Sequence
  Description of Artificial Sequence: Synthetic oligonucleotide
gctattagtggtagtggtggtaacacattcaacgcagactccgtgaagggc

SEQ ID NO: 14482 - protein, 17 aa, Artificial Sequence
  Description of Artificial Sequence: Synthetic peptide
AISGSGGNTFNADSVKG

SEQ ID NO: 14483 - DNA, 51 bp, Artificial Sequence; identical to SEQ ID NO: 12153
  Description of Artificial Sequence: Synthetic oligonucleotide

SEQ ID NO: 14484 - protein, 17 aa, Artificial Sequence
  Description of Artificial Sequence: Synthetic peptide
SISGSSSYIYYADSVKG

SEQ ID NO: 14485 - DNA, 51 bp, Artificial Sequence; identical to SEQ ID NO: 12123
  Description of Artificial Sequence: Synthetic oligonucleotide

SEQ ID NO: 14486 - protein, 17 aa, Artificial Sequence
  Description of Artificial Sequence: Synthetic peptide
VIWYDGSNKYYADSVKG

SEQ ID NO: 14487 - DNA, 51 bp, Artificial Sequence; identical to SEQ ID NO: 13243
  Description of Artificial Sequence: Synthetic oligonucleotide

SEQ ID NO: 14488 - protein, 17 aa, Artificial Sequence
  Description of Artificial Sequence: Synthetic peptide
IIWYDGSNKYYVDSVKG

SEQ ID NO: 14489 - DNA, 51 bp, Artificial Sequence; identical to SEQ ID NO: 14437
  Description of Artificial Sequence: Synthetic oligonucleotide

SEQ ID NO: 14490 - protein, 17 aa, Artificial Sequence
  Description of Artificial Sequence: Synthetic peptide
IIWYDGTNKYYADSVKG

SEQ ID NO: 14491 - DNA, 51 bp, Artificial Sequence; identical to SEQ ID NO: 12161
  Description of Artificial Sequence: Synthetic oligonucleotide

SEQ ID NO: 14492 - protein, 17 aa, Artificial Sequence
  Description of Artificial Sequence: Synthetic peptide
WMHPNSGNTGYAQKFQG

SEQ ID NO: 14493 - DNA, 51 bp, Artificial Sequence
  Description of Artificial Sequence: Synthetic oligonucleotide
tttattagtggtagtggtggtaacacattctacgcagactccgtgaagggc

SEQ ID NO: 14494 - protein, 17 aa, Artificial Sequence
  Description of Artificial Sequence: Synthetic peptide
FISGSGGNTFYADSVKG

SEQ ID NO: 14495 - DNA, 51 bp, Artificial Sequence; identical to SEQ ID NO: 12127
  Description of Artificial Sequence: Synthetic oligonucleotide

SEQ ID NO: 14496 - protein, 17 aa, Artificial Sequence
  Description of Artificial Sequence: Synthetic peptide
IIWYDGSNKYYADSVKG

SEQ ID NO: 14497 - DNA, 51 bp, Artificial Sequence
  Description of Artificial Sequence: Synthetic oligonucleotide
cttatattttatgatggaagtaataaatactatgcagactccgtgaagggc

SEQ ID NO: 14498 - protein, 17 aa, Artificial Sequence
  Description of Artificial Sequence: Synthetic peptide
LIFYDGSNKYYADSVKG

SEQ ID NO: 14499 - DNA, 51 bp, Artificial Sequence
  Description of Artificial Sequence: Synthetic oligonucleotide
attatatggtatgatggaactaacaaatactatgcagactccgtgaagggc

SEQ ID NO: 14500 - protein, 17 aa, Artificial Sequence
  Description of Artificial Sequence: Synthetic peptide
IIWYDGTNKYYADSVKG

SEQ ID NO: 14501 - DNA, 51 bp, Artificial Sequence; identical to SEQ ID NO: 12161
  Description of Artificial Sequence: Synthetic oligonucleotide

SEQ ID NO: 14502 - protein, 17 aa, Artificial Sequence
  Description of Artificial Sequence: Synthetic peptide
WMHPNSGNTGYAQKFQG

SEQ ID NO: 14503 - DNA, 51 bp, Artificial Sequence; identical to SEQ ID NO: 14479
  Description of Artificial Sequence: Synthetic oligonucleotide

SEQ ID NO: 14504 - protein, 17 aa, Artificial Sequence
  Description of Artificial Sequence: Synthetic peptide
VISGSGGSTFYTDSVKG

SEQ ID NO: 14505 - DNA, 51 bp, Artificial Sequence; identical to SEQ ID NO: 12123
  Description of Artificial Sequence: Synthetic oligonucleotide

SEQ ID NO: 14506 - protein, 17 aa, Artificial Sequence
  Description of Artificial Sequence: Synthetic peptide
VIWYDGSNKYYADSVKG

SEQ ID NO: 14507 - DNA, 51 bp, Artificial Sequence; identical to SEQ ID NO: 12123
  Description of Artificial Sequence: Synthetic oligonucleotide

SEQ ID NO: 14508 - protein, 17 aa, Artificial Sequence
  Description of Artificial Sequence: Synthetic peptide
VIWYDGSNKYYADSVKG

SEQ ID NO: 14509 - DNA, 51 bp, Artificial Sequence
  Description of Artificial Sequence: Synthetic oligonucleotide
tggatcaagcctaaaagtggtggcacaaactgtgcacagaggtttcagggc

SEQ ID NO: 14510 - protein, 17 aa, Artificial Sequence
  Description of Artificial Sequence: Synthetic peptide
WIKPKSGGTNCAQRFQG

SEQ ID NO: 14511 - DNA, 51 bp, Artificial Sequence
  Description of Artificial Sequence: Synthetic oligonucleotide
gctattagtggtagtggtgatagaacatactacgcagactccgtgaagggc

SEQ ID NO: 14512 - protein, 17 aa, Artificial Sequence
  Description of Artificial Sequence: Synthetic peptide
AISGSGDRTYYADSVKG

SEQ ID NO: 14513 - DNA, 51 bp, Artificial Sequence
  Description of Artificial Sequence: Synthetic oligonucleotide
tctattagtggtcgtggtggtagcacgttctacgcagactccgtgaagggc

SEQ ID NO: 14514 - protein, 17 aa, Artificial Sequence
  Description of Artificial Sequence: Synthetic peptide
SISGRGGSTFYADSVKG

SEQ ID NO: 14515 - DNA, 51 bp, Artificial Sequence; identical to SEQ ID NO: 12161
  Description of Artificial Sequence: Synthetic oligonucleotide

SEQ ID NO: 14516 - protein, 17 aa, Artificial Sequence
  Description of Artificial Sequence: Synthetic peptide
WMHPNSGNTGYAQKFQG

SEQ ID NO: 14517 - DNA, 51 bp, Artificial Sequence
  Description of Artificial Sequence: Synthetic oligonucleotide
attattagtggtagtggtggtaacacatactacgcagactccgtgaagggc

SEQ ID NO: 14518 - protein, 17 aa, Artificial Sequence
  Description of Artificial Sequence: Synthetic peptide
IISGSGGNTYYADSVKG

SEQ ID NO: 14519 - DNA, 51 bp, Artificial Sequence; identical to SEQ ID NO: 12501
  Description of Artificial Sequence: Synthetic oligonucleotide

SEQ ID NO: 14520 - protein, 17 aa, Artificial Sequence
  Description of Artificial Sequence: Synthetic peptide
IIWYDGSYKYYADSVKG

SEQ ID NO: 14521 - DNA, 51 bp, Artificial Sequence
  Description of Artificial Sequence: Synthetic oligonucleotide
tacattagcattagtggtagtaccataaagtacgcagactctgtgaagggc

SEQ ID NO: 14522 - protein, 17 aa, Artificial Sequence
  Description of Artificial Sequence: Synthetic peptide
YISISGSTIKYADSVKG

SEQ ID NO: 14523 - DNA, 51 bp, Artificial Sequence; identical to SEQ ID NO: 14437
  Description of Artificial Sequence: Synthetic oligonucleotide

SEQ ID NO: 14524 - protein, 17 aa, Artificial Sequence
  Description of Artificial Sequence: Synthetic peptide
IIWYDGTNKYYADSVKG

SEQ ID NO: 14525 - DNA, 51 bp, Artificial Sequence
  Description of Artificial Sequence: Synthetic oligonucleotide
gttatatggtatgatggaagtaataaatactatgccgactccgtgaagggc

SEQ ID NO: 14526 - protein, 17 aa, Artificial Sequence
  Description of Artificial Sequence: Synthetic peptide
VIWYDGSNKYYADSVKG

SEQ ID NO: 14527 - DNA, 51 bp, Artificial Sequence
  Description of Artificial Sequence: Synthetic oligonucleotide
ggtatgagcggtagtggtggtagaacatactacgcagactccgtgaaggac

SEQ ID NO: 14528 - protein, 17 aa, Artificial Sequence
  Description of Artificial Sequence: Synthetic peptide
GMSGSGGRTYYADSVKD

SEQ ID NO: 14529 - DNA, 51 bp, Artificial Sequence; identical to SEQ ID NO: 12123
  Description of Artificial Sequence: Synthetic oligonucleotide

SEQ ID NO: 14530 - protein, 17 aa, Artificial Sequence
  Description of Artificial Sequence: Synthetic peptide
VIWYDGSNKYYADSVKG

SEQ ID NO: 14531 - DNA, 51 bp, Artificial Sequence
  Description of Artificial Sequence: Synthetic oligonucleotide
gttattagtggtagtggtagtaacacatactacgtagactccgtgaagggc

SEQ ID NO: 14532 - protein, 17 aa, Artificial Sequence
  Description of Artificial Sequence: Synthetic peptide
VISGSGSNTYYVDSVKG

SEQ ID NO: 14533 - DNA, 51 bp, Artificial Sequence
  Description of Artificial Sequence: Synthetic oligonucleotide
attatatggtatgatggaagttataaatactatacagactccgtgaagggc

SEQ ID NO: 14534 - protein, 17 aa, Artificial Sequence
  Description of Artificial Sequence: Synthetic peptide
IIWYDGSYKYYTDSVKG

SEQ ID NO: 14535 - DNA, 51 bp, Artificial Sequence; identical to SEQ ID NO: 12161
  Description of Artificial Sequence: Synthetic oligonucleotide

SEQ ID NO: 14536 - protein, 17 aa, Artificial Sequence
  Description of Artificial Sequence: Synthetic peptide
WMHPNSGNTGYAQKFQG

SEQ ID NO: 14537 - DNA, 51 bp, Artificial Sequence
  Description of Artificial Sequence: Synthetic oligonucleotide
gttattagtggtagtggtggtaatacattctacgcagactccgtgaagggc

SEQ ID NO: 14538 - protein, 17 aa, Artificial Sequence
  Description of Artificial Sequence: Synthetic peptide
VISGSGGNTFYADSVKG

SEQ ID NO: 14539 - DNA, 51 bp, Artificial Sequence; identical to SEQ ID NO: 12347
  Description of Artificial Sequence: Synthetic oligonucleotide

SEQ ID NO: 14540 - protein, 17 aa, Artificial Sequence
  Description of Artificial Sequence: Synthetic peptide
VISGSGGNTFYADSVKG

SEQ ID NO: 14541 - DNA, 51 bp, Artificial Sequence; identical to SEQ ID NO: 14437
  Description of Artificial Sequence: Synthetic oligonucleotide

SEQ ID NO: 14542 - protein, 17 aa, Artificial Sequence
  Description of Artificial Sequence: Synthetic peptide
IIWYDGTNKYYADSVKG

SEQ ID NO: 14543 - DNA, 51 bp, Artificial Sequence
  Description of Artificial Sequence: Synthetic oligonucleotide
gttatatggtatgatggaagtaataaatactacgcagactccgtgaagggc

SEQ ID NO: 14544 - protein, 17 aa, Artificial Sequence
  Description of Artificial Sequence: Synthetic peptide
VIWYDGSNKYYADSVKG

SEQ ID NO: 14545 - DNA, 51 bp, Artificial Sequence
  Description of Artificial Sequence: Synthetic oligonucleotide
gttattagtggttttggtggtaacacattctacgcagactccgtgaagggc

SEQ ID NO: 14546 - protein, 17 aa, Artificial Sequence
  Description of Artificial Sequence: Synthetic peptide
VISGFGGNTFYADSVKG

SEQ ID NO: 14547 - DNA, 51 bp, Artificial Sequence; identical to SEQ ID NO: 14497
  Description of Artificial Sequence: Synthetic oligonucleotide

SEQ ID NO: 14548 - protein, 17 aa, Artificial Sequence
  Description of Artificial Sequence: Synthetic peptide
LIFYDGSNKYYADSVKG

SEQ ID NO: 14549 - DNA, 51 bp, Artificial Sequence
  Description of Artificial Sequence: Synthetic oligonucleotide
gttattagcggtcgcggtggtaacacattctacgcagactccgtgaagggc

SEQ ID NO: 14550 - protein, 17 aa, Artificial Sequence
  Description of Artificial Sequence: Synthetic peptide
VISGRGGNTFYADSVKG

SEQ ID NO: 14551 - DNA, 51 bp, Artificial Sequence
  Description of Artificial Sequence: Synthetic oligonucleotide
attatttggtatgatggaagttataaatactatgcagactccgtgaagggc

SEQ ID NO: 14552 - protein, 17 aa, Artificial Sequence
  Description of Artificial Sequence: Synthetic peptide
IIWYDGSYKYYADSVKG

SEQ ID NO: 14553 - DNA, 51 bp, Artificial Sequence
  Description of Artificial Sequence: Synthetic oligonucleotide
gttatatggtatgatgaaaataataaacactatgcagactccgcgaagggc

SEQ ID NO: 14554 - protein, 17 aa, Artificial Sequence
  Description of Artificial Sequence: Synthetic peptide
VIWYDENNKHYADSAKG

SEQ ID NO: 14555 - DNA, 51 bp, Artificial Sequence
  Description of Artificial Sequence: Synthetic oligonucleotide
gttatatggtatgatggaagtgataaatactatgaagactccgtgaagggc

SEQ ID NO: 14556 - protein, 17 aa, Artificial Sequence
  Description of Artificial Sequence: Synthetic peptide
VIWYDGSDKYYEDSVKG

SEQ ID NO: 14557 - DNA, 51 bp, Artificial Sequence; identical to SEQ ID NO: 12501
  Description of Artificial Sequence: Synthetic oligonucleotide

SEQ ID NO: 14558 - protein, 17 aa, Artificial Sequence
  Description of Artificial Sequence: Synthetic peptide
IIWYDGSYKYYADSVKG

SEQ ID NO: 14559 - DNA, 51 bp, Artificial Sequence
  Description of Artificial Sequence: Synthetic oligonucleotide
tggatcaaccctaacaatggtggctcaaactatacacagaagtttcagggc

SEQ ID NO: 14560 - protein, 17 aa, Artificial Sequence
  Description of Artificial Sequence: Synthetic peptide
WINPNNGGSNYTQKFQG

SEQ ID NO: 14561 - DNA, 51 bp, Artificial Sequence
  Description of Artificial Sequence: Synthetic oligonucleotide
gttattagtggtagtggtggtaacacattctacggagactccgtgaagggc

SEQ ID NO: 14562 - protein, 17 aa, Artificial Sequence
  Description of Artificial Sequence: Synthetic peptide
VISGSGGNTFYGDSVKG

SEQ ID NO: 14563 - DNA, 51 bp, Artificial Sequence; identical to SEQ ID NO: 12103
  Description of Artificial Sequence: Synthetic oligonucleotide

SEQ ID NO: 14564 - protein, 17 aa, Artificial Sequence
  Description of Artificial Sequence: Synthetic peptide
WMNPNSGNTGYAQKFQG

SEQ ID NO: 14565 - DNA, 51 bp, Artificial Sequence; identical to SEQ ID NO: 14553
  Description of Artificial Sequence: Synthetic oligonucleotide

SEQ ID NO: 14566 - protein, 17 aa, Artificial Sequence
  Description of Artificial Sequence: Synthetic peptide
VIWYDENNKHYADSAKG

SEQ ID NO: 14567 - DNA, 51 bp, Artificial Sequence; identical to SEQ ID NO: 12501
  Description of Artificial Sequence: Synthetic oligonucleotide

SEQ ID NO: 14568 - protein, 17 aa, Artificial Sequence
  Description of Artificial Sequence: Synthetic peptide
IIWYDGSYKYYADSVKG

SEQ ID NO: 14569 - DNA, 51 bp, Artificial Sequence
  Description of Artificial Sequence: Synthetic oligonucleotide
gttattagtggtagaggtggtaccacattctacgcagactccgtgaagggc

SEQ ID NO: 14570 - protein, 17 aa, Artificial Sequence
  Description of Artificial Sequence: Synthetic peptide
VISGRGGTTFYADSVKG

SEQ ID NO: 14571 - DNA, 51 bp, Artificial Sequence
  Description of Artificial Sequence: Synthetic oligonucleotide
attatatcatatgctggaagtactaaattctatgcagactccgtgaagggc

SEQ ID NO: 14572 - protein, 17 aa, Artificial Sequence
  Description of Artificial Sequence: Synthetic peptide
IISYAGSTKFYADSVKG

SEQ ID NO: 14573 - DNA, 51 bp, Artificial Sequence
  Description of Artificial Sequence: Synthetic oligonucleotide
gttatatcatctgctggaagtaataaatactatgcagactccgtgaagggc

SEQ ID NO: 14574 - protein, 17 aa, Artificial Sequence
  Description of Artificial Sequence: Synthetic peptide
VISSAGSNKYYADSVKG

SEQ ID NO: 14575 - DNA, 51 bp, Artificial Sequence
  Description of Artificial Sequence: Synthetic oligonucleotide
tctattagtagtggtagtggttacatacactacgcagactcagtgaagggc

SEQ ID NO: 14576 - protein, 17 aa, Artificial Sequence
  Description of Artificial Sequence: Synthetic peptide
SISSGSGYIHYADSVKG

SEQ ID NO: 14577 - DNA, 48 bp, Artificial Sequence; identical to SEQ ID NO: 14443
  Description of Artificial Sequence: Synthetic oligonucleotide

SEQ ID NO: 14578 - protein, 16 aa, Artificial Sequence
  Description of Artificial Sequence: Synthetic peptide
RIYTSGSTNYNPSLKS

SEQ ID NO: 14579 - DNA, 51 bp, Artificial Sequence; identical to SEQ ID NO: 13745
  Description of Artificial Sequence: Synthetic oligonucleotide

SEQ ID NO: 14580 - protein, 17 aa, Artificial Sequence
  Description of Artificial Sequence: Synthetic peptide
VIWYDGSNKNYADSVKG

SEQ ID NO: 14581 - DNA, 51 bp, Artificial Sequence
  Description of Artificial Sequence: Synthetic oligonucleotide
attatatggtttgatggaagtaataaatactatgcagactccgtgaagggc

SEQ ID NO: 14582 - protein, 17 aa, Artificial Sequence
  Description of Artificial Sequence: Synthetic peptide
IIWFDGSNKYYADSVKG

SEQ ID NO: 14583 - DNA, 51 bp, Artificial Sequence
  Description of Artificial Sequence: Synthetic oligonucleotide
actattagtggtactggtcgtaggacatactacgcagactccgtgaagggc

SEQ ID NO: 14584 - protein, 17 aa, Artificial Sequence
  Description of Artificial Sequence: Synthetic peptide
TISGTGRRTYYADSVKG

SEQ ID NO: 14585 - DNA, 51 bp, Artificial Sequence; identical to SEQ ID NO: 13745
  Description of Artificial Sequence: Synthetic oligonucleotide

SEQ ID NO: 14586 - protein, 17 aa, Artificial Sequence
  Description of Artificial Sequence: Synthetic peptide
VIWYDGSNKNYADSVKG

SEQ ID NO: 14587 - DNA, 48 bp, Artificial Sequence
  Description of Artificial Sequence: Synthetic oligonucleotide
cttatctataccagtaggagcaccatttacaacccctccctcaagagt

SEQ ID NO: 14588 - protein, 16 aa, Artificial Sequence
  Description of Artificial Sequence: Synthetic peptide
LIYTSRSTIYNPSLKS

SEQ ID NO: 14589 - DNA, 48 bp, Artificial Sequence
  Description of Artificial Sequence: Synthetic oligonucleotide
tatatctattacagtgggagcacctactacaacccgtccctcaagagt

SEQ ID NO: 14590 - protein, 16 aa, Artificial Sequence
  Description of Artificial Sequence: Synthetic peptide
YIYYSGSTYYNPSLKS

SEQ ID NO: 14591 - DNA, 51 bp, Artificial Sequence
  Description of Artificial Sequence: Synthetic oligonucleotide
gttatatcatatgatggaggttataaaaactatgtagactccgtgaagggc

SEQ ID NO: 14592 - protein, 17 aa, Artificial Sequence
  Description of Artificial Sequence: Synthetic peptide
VISYDGGYKNYVDSVKG

SEQ ID NO: 14593 - DNA, 51 bp, Artificial Sequence
  Description of Artificial Sequence: Synthetic oligonucleotide
gctattattggtaatggtggtaggacatactacgcagactccgtgaagggc

SEQ ID NO: 14594 - protein, 17 aa, Artificial Sequence
  Description of Artificial Sequence: Synthetic peptide
AIIGNGGRTYYADSVKG

SEQ ID NO: 14595 - DNA, 51 bp, Artificial Sequence
  Description of Artificial Sequence: Synthetic oligonucleotide
gttatatggtttgatggaagtaatgactactatgcagactccgtgaagggc

SEQ ID NO: 14596 - protein, 17 aa, Artificial Sequence
  Description of Artificial Sequence: Synthetic peptide
VIWFDGSNDYYADSVKG

SEQ ID NO: 14597 - DNA, 51 bp, Artificial Sequence
  Description of Artificial Sequence: Synthetic oligonucleotide
gttatatggtatgatggaactaataaaaactatgcagactccgtgaagggc

SEQ ID NO: 14598 - protein, 17 aa, Artificial Sequence
  Description of Artificial Sequence: Synthetic peptide
VIWYDGTNKNYADSVKG

SEQ ID NO: 14599 - DNA, 48 bp, Artificial Sequence
  Description of Artificial Sequence: Synthetic oligonucleotide
catatctataccagtgggagcaccaagtacaacccctccctcaagagt

SEQ ID NO: 14600 - protein, 16 aa, Artificial Sequence
  Description of Artificial Sequence: Synthetic peptide
HIYTSGSTKYNPSLKS

SEQ ID NO: 14601 - DNA, 51 bp, Artificial Sequence; identical to SEQ ID NO: 12161
  Description of Artificial Sequence: Synthetic oligonucleotide

SEQ ID NO: 14602 - protein, 17 aa, Artificial Sequence
  Description of Artificial Sequence: Synthetic peptide
WMHPNSGNTGYAQKFQG

SEQ ID NO: 14603 - DNA, 48 bp, Artificial Sequence
  Description of Artificial Sequence: Synthetic oligonucleotide
tacatcttttacagtgggagcacctactacaacccgtccctcaagagt

SEQ ID NO: 14604 - protein, 16 aa, Artificial Sequence
  Description of Artificial Sequence: Synthetic peptide
YIFYSGSTYYNPSLKS

SEQ ID NO: 14605 - DNA, 51 bp, Artificial Sequence
  Description of Artificial Sequence: Synthetic oligonucleotide
gttatatggtatgatggaagtaatgaacactatgcagactccgtgaagggc

SEQ ID NO: 14606 - protein, 17 aa, Artificial Sequence
  Description of Artificial Sequence: Synthetic peptide
VIWYDGSNEHYADSVKG

SEQ ID NO: 14607 - DNA, 48 bp, Artificial Sequence; identical to SEQ ID NO: 14603
  Description of Artificial Sequence: Synthetic oligonucleotide

SEQ ID NO: 14608 - protein, 16 aa, Artificial Sequence
  Description of Artificial Sequence: Synthetic peptide
YIFYSGSTYYNPSLKS

SEQ ID NO: 14609 - DNA, 48 bp, Artificial Sequence; identical to SEQ ID NO: 14603
  Description of Artificial Sequence: Synthetic oligonucleotide

SEQ ID NO: 14610 - protein, 16 aa, Artificial Sequence
  Description of Artificial Sequence: Synthetic peptide
YIFYSGSTYYNPSLKS

SEQ ID NO: 14611 - DNA, 48 bp, Artificial Sequence; identical to SEQ ID NO: 14603
  Description of Artificial Sequence: Synthetic oligonucleotide

SEQ ID NO: 14612 - protein, 16 aa, Artificial Sequence
  Description of Artificial Sequence: Synthetic peptide
YIFYSGSTYYNPSLKS

SEQ ID NO: 14613 - DNA, 48 bp, Artificial Sequence
  Description of Artificial Sequence: Synthetic oligonucleotide
cttatctataccagtaggagcaccaattacaacccctccctcaagagt

SEQ ID NO: 14614 - protein, 16 aa, Artificial Sequence
  Description of Artificial Sequence: Synthetic peptide
LIYTSRSTNYNPSLKS

SEQ ID NO: 14615 - DNA, 51 bp, Artificial Sequence
  Description of Artificial Sequence: Synthetic oligonucleotide
cggatgaaccctaacagtggtaacacaggctatgcacagaagttccagggc

SEQ ID NO: 14616 - protein, 17 aa, Artificial Sequence
  Description of Artificial Sequence: Synthetic peptide
RMNPNSGNTGYAQKFQG

SEQ ID NO: 14617 - DNA, 51 bp, Artificial Sequence; identical to SEQ ID NO: 12143
  Description of Artificial Sequence: Synthetic oligonucleotide

SEQ ID NO: 14618 - protein, 17 aa, Artificial Sequence
  Description of Artificial Sequence: Synthetic peptide
VISYDGGYKNYADSVKG

SEQ ID NO: 14619 - DNA, 51 bp, Artificial Sequence; identical to SEQ ID NO: 13745
  Description of Artificial Sequence: Synthetic oligonucleotide

SEQ ID NO: 14620 - protein, 17 aa, Artificial Sequence
  Description of Artificial Sequence: Synthetic peptide
VIWYDGSNKNYADSVKG

SEQ ID NO: 14621 - DNA, 51 bp, Artificial Sequence; identical to SEQ ID NO: 13745
  Description of Artificial Sequence: Synthetic oligonucleotide

SEQ ID NO: 14622 - protein, 17 aa, Artificial Sequence
  Description of Artificial Sequence: Synthetic peptide
VIWYDGSNKNYADSVKG

SEQ ID NO: 14623 - DNA, 48 bp, Artificial Sequence
  Description of Artificial Sequence: Synthetic oligonucleotide
tacatcttttacagtgggagcacctactacaacccgtccctcaggagt

SEQ ID NO: 14624 - protein, 16 aa, Artificial Sequence
  Description of Artificial Sequence: Synthetic peptide
YIFYSGSTYYNPSLRS

SEQ ID NO: 14625 - DNA, 51 bp, Artificial Sequence
  Description of Artificial Sequence: Synthetic oligonucleotide
tccattagtagtggtagtggttacatatattatgcagactcagtgaagggc

SEQ ID NO: 14626 - protein, 17 aa, Artificial Sequence
  Description of Artificial Sequence: Synthetic peptide
SISSGSGYIYYADSVKG

SEQ ID NO: 14627 - DNA, 51 bp, Artificial Sequence; identical to SEQ ID NO: 14583
  Description of Artificial Sequence: Synthetic oligonucleotide

SEQ ID NO: 14628 - protein, 17 aa, Artificial Sequence
  Description of Artificial Sequence: Synthetic peptide
TISGTGRRTYYADSVKG

SEQ ID NO: 14629 - DNA, 51 bp, Artificial Sequence
  Description of Artificial Sequence: Synthetic oligonucleotide
gttatatggtatgatggaagtaataaacattatgcagactccgtgaagggc

SEQ ID NO: 14630 - protein, 17 aa, Artificial Sequence
  Description of Artificial Sequence: Synthetic peptide
VIWYDGSNKHYADSVKG

SEQ ID NO: 14631 - DNA, 48 bp, Artificial Sequence; identical to SEQ ID NO: 14613
  Description of Artificial Sequence: Synthetic oligonucleotide

SEQ ID NO: 14632 - protein, 16 aa, Artificial Sequence
  Description of Artificial Sequence: Synthetic peptide
LIYTSRSTNYNPSLKS

SEQ ID NO: 14633 - DNA, 51 bp, Artificial Sequence
  Description of Artificial Sequence: Synthetic oligonucleotide
gttatatggtatgatggaagtaataaaaactacgcagactccgtgaagggc

SEQ ID NO: 14634 - protein, 17 aa, Artificial Sequence
  Description of Artificial Sequence: Synthetic peptide
VIWYDGSNKNYADSVKG

SEQ ID NO: 14635 - DNA, 51 bp, Artificial Sequence
  Description of Artificial Sequence: Synthetic oligonucleotide
gctattagtcgtagtggtggtaacacacactacgcagactccgtgaagggc

SEQ ID NO: 14636 - protein, 17 aa, Artificial Sequence
  Description of Artificial Sequence: Synthetic peptide
AISRSGGNTHYADSVKG

SEQ ID NO: 14637 - DNA, 51 bp, Artificial Sequence; identical to SEQ ID NO: 14559
  Description of Artificial Sequence: Synthetic oligonucleotide

SEQ ID NO: 14638 - protein, 17 aa, Artificial Sequence
  Description of Artificial Sequence: Synthetic peptide
WINPNNGGSNYTQKFQG

SEQ ID NO: 14639 - DNA, 51 bp, Artificial Sequence
  Description of Artificial Sequence: Synthetic oligonucleotide
gttatttggtatgatgaaactaataaacactatggagactccgtgaagggc

SEQ ID NO: 14640 - protein, 17 aa, Artificial Sequence
  Description of Artificial Sequence: Synthetic peptide
VIWYDETNKHYGDSVKG

SEQ ID NO: 14641 - DNA, 51 bp, Artificial Sequence; identical to SEQ ID NO: 14639
  Description of Artificial Sequence: Synthetic oligonucleotide

SEQ ID NO: 14642 - protein, 17 aa, Artificial Sequence
  Description of Artificial Sequence: Synthetic peptide
VIWYDETNKHYGDSVKG

SEQ ID NO: 14643 - DNA, 51 bp, Artificial Sequence
  Description of Artificial Sequence: Synthetic oligonucleotide
tccattagcagtagtggtagttacatatattacgcagactcagtgaagggc

SEQ ID NO: 14644 - protein, 17 aa, Artificial Sequence
  Description of Artificial Sequence: Synthetic peptide
SISSSGSYIYYADSVKG

SEQ ID NO: 14645 - DNA, 51 bp, Artificial Sequence; identical to SEQ ID NO: 14559
  Description of Artificial Sequence: Synthetic oligonucleotide

SEQ ID NO: 14646 - protein, 17 aa, Artificial Sequence
  Description of Artificial Sequence: Synthetic peptide
WINPNNGGSNYTQKFQG

SEQ ID NO: 14647 - DNA, 51 bp, Artificial Sequence
  Description of Artificial Sequence: Synthetic oligonucleotide
attatatggtatgatggaagttataaatattatgcagactccgtgaagggc

SEQ ID NO: 14648 - protein, 17 aa, Artificial Sequence
  Description of Artificial Sequence: Synthetic peptide
IIWYDGSYKYYADSVKG

SEQ ID NO: 14649 - DNA, 51 bp, Artificial Sequence; identical to SEQ ID NO: 14569
  Description of Artificial Sequence: Synthetic oligonucleotide

SEQ ID NO: 14650 - protein, 17 aa, Artificial Sequence
  Description of Artificial Sequence: Synthetic peptide
VISGRGGTTFYADSVKG

SEQ ID NO: 14651 - DNA, 51 bp, Artificial Sequence
  Description of Artificial Sequence: Synthetic oligonucleotide
tggatcaaccctaacagtggtggctcaaactatacacagaagtttcagggc

SEQ ID NO: 14652 - protein, 17 aa, Artificial Sequence
  Description of Artificial Sequence: Synthetic peptide
WINPNSGGSNYTQKFQG

SEQ ID NO: 14653 - DNA, 51 bp, Artificial Sequence
  Description of Artificial Sequence: Synthetic oligonucleotide
gttattagtggtagtggtggttacacatactacgcagactccgtgaagggc

SEQ ID NO: 14654 - protein, 17 aa, Artificial Sequence
  Description of Artificial Sequence: Synthetic peptide
VISGSGGYTYYADSVKG

SEQ ID NO: 14655 - DNA, 51 bp, Artificial Sequence; identical to SEQ ID NO: 14651
  Description of Artificial Sequence: Synthetic oligonucleotide

SEQ ID NO: 14656 - protein, 17 aa, Artificial Sequence
  Description of Artificial Sequence: Synthetic peptide
WINPNSGGSNYTQKFQG

SEQ ID NO: 14657 - DNA, 51 bp, Artificial Sequence; identical to SEQ ID NO: 12501
  Description of Artificial Sequence: Synthetic oligonucleotide

SEQ ID NO: 14658 - protein, 17 aa, Artificial Sequence
  Description of Artificial Sequence: Synthetic peptide
IIWYDGSYKYYADSVKG

SEQ ID NO: 14659 - DNA, 51 bp, Artificial Sequence; identical to SEQ ID NO: 12501
  Description of Artificial Sequence: Synthetic oligonucleotide

SEQ ID NO: 14660 - protein, 17 aa, Artificial Sequence
  Description of Artificial Sequence: Synthetic peptide
IIWYDGSYKYYADSVKG

SEQ ID NO: 14661 - DNA, 51 bp, Artificial Sequence
  Description of Artificial Sequence: Synthetic oligonucleotide
tacattagtagtagtggtactaccgtattctacgcagactctgtgaagggc

SEQ ID NO: 14662 - protein, 17 aa, Artificial Sequence
  Description of Artificial Sequence: Synthetic peptide
YISSSGTTVFYADSVKG

SEQ ID NO: 14663 - DNA, 48 bp, Artificial Sequence
  Description of Artificial Sequence: Synthetic oligonucleotide
ttcatcttttatagtgggagcacctactacaacccgtccctcaagagt

SEQ ID NO: 14664 - protein, 16 aa, Artificial Sequence
  Description of Artificial Sequence: Synthetic peptide
FIFYSGSTYYNPSLKS

SEQ ID NO: 14665 - DNA, 51 bp, Artificial Sequence; identical to SEQ ID NO: 14591
  Description of Artificial Sequence: Synthetic oligonucleotide

SEQ ID NO: 14666 - protein, 17 aa, Artificial Sequence
  Description of Artificial Sequence: Synthetic peptide
VISYDGGYKNYVDSVKG

SEQ ID NO: 14667 - DNA, 51 bp, Artificial Sequence
  Description of Artificial Sequence: Synthetic oligonucleotide
gctattagtggtcgtggtggtaacacatactacgcagactccgtgaagggc

SEQ ID NO: 14668 - protein, 17 aa, Artificial Sequence
  Description of Artificial Sequence: Synthetic peptide
AISGRGGNTYYADSVKG

SEQ ID NO: 14669 - DNA, 48 bp, Artificial Sequence; identical to SEQ ID NO: 14603
  Description of Artificial Sequence: Synthetic oligonucleotide

SEQ ID NO: 14670 - protein, 16 aa, Artificial Sequence
  Description of Artificial Sequence: Synthetic peptide
YIFYSGSTYYNPSLKS

SEQ ID NO: 14671 - DNA, 48 bp, Artificial Sequence
  Description of Artificial Sequence: Synthetic oligonucleotide
aacatctattacagtgggagcacctacaacaacccgtccctcaagagt

SEQ ID NO: 14672 - protein, 16 aa, Artificial Sequence
  Description of Artificial Sequence: Synthetic peptide
NIYYSGSTYNNPSLKS

SEQ ID NO: 14673 - DNA, 51 bp, Artificial Sequence; identical to SEQ ID NO: 12103
  Description of Artificial Sequence: Synthetic oligonucleotide

SEQ ID NO: 14674 - protein, 17 aa, Artificial Sequence
  Description of Artificial Sequence: Synthetic peptide
WMNPNSGNTGYAQKFQG

SEQ ID NO: 14675 - DNA, 48 bp, Artificial Sequence
  Description of Artificial Sequence: Synthetic oligonucleotide
cgtatctatgccagtgggagcaccaactacaacccctccctcaagagt

SEQ ID NO: 14676 - protein, 16 aa, Artificial Sequence
  Description of Artificial Sequence: Synthetic peptide
RIYASGSTNYNPSLKS

SEQ ID NO: 14677 - DNA, 51 bp, Artificial Sequence; identical to SEQ ID NO: 12143
  Description of Artificial Sequence: Synthetic oligonucleotide

SEQ ID NO: 14678 - protein, 17 aa, Artificial Sequence
  Description of Artificial Sequence: Synthetic peptide
VISYDGGYKNYADSVKG

SEQ ID NO: 14679 - DNA, 51 bp, Artificial Sequence; identical to SEQ ID NO: 12123
  Description of Artificial Sequence: Synthetic oligonucleotide

SEQ ID NO: 14680 - protein, 17 aa, Artificial Sequence
  Description of Artificial Sequence: Synthetic peptide
VIWYDGSNKYYADSVKG

SEQ ID NO: 14681 - DNA, 51 bp, Artificial Sequence; identical to SEQ ID NO: 14661
  Description of Artificial Sequence: Synthetic oligonucleotide

SEQ ID NO: 14682 - protein, 17 aa, Artificial Sequence
  Description of Artificial Sequence: Synthetic peptide
YISSSGTTVFYADSVKG

SEQ ID NO: 14683 - DNA, 51 bp, Artificial Sequence
  Description of Artificial Sequence: Synthetic oligonucleotide
tggatgaaccctaatagtggtaatacaggctatgcacagaagttccagggc

SEQ ID NO: 14684 - protein, 17 aa, Artificial Sequence
  Description of Artificial Sequence: Synthetic peptide
WMNPNSGNTGYAQKFQG

SEQ ID NO: 14685 - DNA, 48 bp, Artificial Sequence
  Description of Artificial Sequence: Synthetic oligonucleotide
catatctataccagtaggagcaccaactacaacccctccctcaagagt

SEQ ID NO: 14686 - protein, 16 aa, Artificial Sequence
  Description of Artificial Sequence: Synthetic peptide
HIYTSRSTNYNPSLKS

SEQ ID NO: 14687 - DNA, 51 bp, Artificial Sequence; identical to SEQ ID NO: 14583
  Description of Artificial Sequence: Synthetic oligonucleotide

SEQ ID NO: 14688 - protein, 17 aa, Artificial Sequence
  Description of Artificial Sequence: Synthetic peptide
TISGTGRRTYYADSVKG

SEQ ID NO: 14689 - DNA, 51 bp, Artificial Sequence; identical to SEQ ID NO: 13745
  Description of Artificial Sequence: Synthetic oligonucleotide

SEQ ID NO: 14690 - protein, 17 aa, Artificial Sequence
  Description of Artificial Sequence: Synthetic peptide
VIWYDGSNKNYADSVKG

SEQ ID NO: 14691 - DNA, 51 bp, Artificial Sequence
  Description of Artificial Sequence: Synthetic oligonucleotide
actattagtggtactggtcgtaggacatattacgcagactccgtgaagggc

SEQ ID NO: 14692 - protein, 17 aa, Artificial Sequence
  Description of Artificial Sequence: Synthetic peptide
TISGTGRRTYYADSVKG

SEQ ID NO: 14693 - DNA, 51 bp, Artificial Sequence; identical to SEQ ID NO: 14595
  Description of Artificial Sequence: Synthetic oligonucleotide

SEQ ID NO: 14694 - protein, 17 aa, Artificial Sequence
  Description of Artificial Sequence: Synthetic peptide
VIWFDGSNDYYADSVKG

SEQ ID NO: 14695 - DNA, 48 bp, Artificial Sequence; identical to SEQ ID NO: 14603
  Description of Artificial Sequence: Synthetic oligonucleotide

SEQ ID NO: 14696 - protein, 16 aa, Artificial Sequence
  Description of Artificial Sequence: Synthetic peptide
YIFYSGSTYYNPSLKS

SEQ ID NO: 14697 - DNA, 51 bp, Artificial Sequence
  Description of Artificial Sequence: Synthetic oligonucleotide
attatatggtttgatggaagtaatcaatactatgccgactccgtgaagggc

SEQ ID NO: 14698 - protein, 17 aa, Artificial Sequence
  Description of Artificial Sequence: Synthetic peptide
IIWFDGSNQYYADSVKG

SEQ ID NO: 14699 - DNA, 48 bp, Artificial Sequence; identical to SEQ ID NO: 14589
  Description of Artificial Sequence: Synthetic oligonucleotide

SEQ ID NO: 14700 - protein, 16 aa, Artificial Sequence
  Description of Artificial Sequence: Synthetic peptide
YIYYSGSTYYNPSLKS

SEQ ID NO: 14701 - DNA, 51 bp, Artificial Sequence; identical to SEQ ID NO: 14633
  Description of Artificial Sequence: Synthetic oligonucleotide

SEQ ID NO: 14702 - protein, 17 aa, Artificial Sequence
  Description of Artificial Sequence: Synthetic peptide
VIWYDGSNKNYADSVKG

SEQ ID NO: 14703 - DNA, 51 bp, Artificial Sequence; identical to SEQ ID NO: 14633
  Description of Artificial Sequence: Synthetic oligonucleotide

SEQ ID NO: 14704 - protein, 17 aa, Artificial Sequence
  Description of Artificial Sequence: Synthetic peptide
VIWYDGSNKNYADSVKG

SEQ ID NO: 14705 - DNA, 51 bp, Artificial Sequence; identical to SEQ ID NO: 14661
  Description of Artificial Sequence: Synthetic oligonucleotide

SEQ ID NO: 14706 - protein, 17 aa, Artificial Sequence
  Description of Artificial Sequence: Synthetic peptide
YISSSGTTVFYADSVKG

SEQ ID NO: 14707 - DNA, 51 bp, Artificial Sequence; identical to SEQ ID NO: 13745
  Description of Artificial Sequence: Synthetic oligonucleotide

SEQ ID NO: 14708 - protein, 17 aa, Artificial Sequence
  Description of Artificial Sequence: Synthetic peptide
VIWYDGSNKNYADSVKG

SEQ ID NO: 14709 - DNA, 51 bp, Artificial Sequence; identical to SEQ ID NO: 14113
  Description of Artificial Sequence: Synthetic oligonucleotide

SEQ ID NO: 14710 - protein, 17 aa, Artificial Sequence
  Description of Artificial Sequence: Synthetic peptide
VIWYDGSYKYYADSVKG

SEQ ID NO: 14711 - DNA, 51 bp, Artificial Sequence; identical to SEQ ID NO: 13745
  Description of Artificial Sequence: Synthetic oligonucleotide

SEQ ID NO: 14712 - protein, 17 aa, Artificial Sequence
  Description of Artificial Sequence: Synthetic peptide
VIWYDGSNKNYADSVKG

SEQ ID NO: 14713 - DNA, 51 bp, Artificial Sequence
  Description of Artificial Sequence: Synthetic oligonucleotide
gccattagtggtagtggtggtaacacattctacgcagactccgtgaagggc

SEQ ID NO: 14714 - protein, 17 aa, Artificial Sequence
  Description of Artificial Sequence: Synthetic peptide
AISGSGGNTFYADSVKG

SEQ ID NO: 14715 - DNA, 48 bp, Artificial Sequence
  Description of Artificial Sequence: Synthetic oligonucleotide
ttcatcttttacagtgggagcacctactacaacccgtccctcaagagt

SEQ ID NO: 14716 - protein, 16 aa, Artificial Sequence
  Description of Artificial Sequence: Synthetic peptide
FIFYSGSTYYNPSLKS

SEQ ID NO: 14717 - DNA, 51 bp, Artificial Sequence; identical to SEQ ID NO: 14605
  Description of Artificial Sequence: Synthetic oligonucleotide

SEQ ID NO: 14718 - protein, 17 aa, Artificial Sequence
  Description of Artificial Sequence: Synthetic peptide
VIWYDGSNEHYADSVKG

SEQ ID NO: 14719 - DNA, 48 bp, Artificial Sequence
  Description of Artificial Sequence: Synthetic oligonucleotide
aacctctattacagtgggagcacctactacaacccgtccctcaggagt

SEQ ID NO: 14720 - protein, 16 aa, Artificial Sequence
  Description of Artificial Sequence: Synthetic peptide
NLYYSGSTYYNPSLRS

SEQ ID NO: 14721 - DNA, 51 bp, Artificial Sequence
  Description of Artificial Sequence: Synthetic oligonucleotide
gttatatggtatgatggaagtaacaaaaactatgtagactccgtgaggggc

SEQ ID NO: 14722 - protein, 17 aa, Artificial Sequence
  Description of Artificial Sequence: Synthetic peptide
VIWYDGSNKNYVDSVRG

SEQ ID NO: 14723 - DNA, 51 bp, Artificial Sequence
  Description of Artificial Sequence: Synthetic oligonucleotide
gttatatggtatgatggaagcaataaaaactatgcagactccgtgaagggc

SEQ ID NO: 14724 - protein, 17 aa, Artificial Sequence
  Description of Artificial Sequence: Synthetic peptide
VIWYDGSNKNYADSVKG

SEQ ID NO: 14725 - DNA, 48 bp, Artificial Sequence
  Description of Artificial Sequence: Synthetic oligonucleotide
tacatcttttacagcgggagcacctactacaacccgtccctcaagagt

SEQ ID NO: 14726 - protein, 16 aa, Artificial Sequence
  Description of Artificial Sequence: Synthetic peptide
YIFYSGSTYYNPSLKS

SEQ ID NO: 14727 - DNA, 51 bp, Artificial Sequence; identical to SEQ ID NO: 12133
  Description of Artificial Sequence: Synthetic oligonucleotide

SEQ ID NO: 14728 - protein, 17 aa, Artificial Sequence
  Description of Artificial Sequence: Synthetic peptide
VIWYDGSNKYYVDSVKG

SEQ ID NO: 14729 - DNA, 51 bp, Artificial Sequence
  Description of Artificial Sequence: Synthetic oligonucleotide
gttttatggtatgatggaactaataaaaactatgcagactccgtgaagggc

SEQ ID NO: 14730 - protein, 17 aa, Artificial Sequence
  Description of Artificial Sequence: Synthetic peptide
VLWYDGTNKNYADSVKG

SEQ ID NO: 14731 - DNA, 51 bp, Artificial Sequence; identical to SEQ ID NO: 12143
  Description of Artificial Sequence: Synthetic oligonucleotide

SEQ ID NO: 14732 - protein, 17 aa, Artificial Sequence
  Description of Artificial Sequence: Synthetic peptide
VISYDGGYKNYADSVKG

SEQ ID NO: 14733 - DNA, 51 bp, Artificial Sequence; identical to SEQ ID NO: 14605
  Description of Artificial Sequence: Synthetic oligonucleotide

SEQ ID NO: 14734 - protein, 17 aa, Artificial Sequence
  Description of Artificial Sequence: Synthetic peptide
VIWYDGSNEHYADSVKG

SEQ ID NO: 14735 - DNA, 48 bp, Artificial Sequence
  Description of Artificial Sequence: Synthetic oligonucleotide
gaaatcaatcaaagtggaaggtccaactacaacccgtccctcaagagt

SEQ ID NO: 14736 - protein, 16 aa, Artificial Sequence
  Description of Artificial Sequence: Synthetic peptide
EINQSGRSNYNPSLKS

SEQ ID NO: 14737 - DNA, 51 bp, Artificial Sequence; identical to SEQ ID NO: 13745
  Description of Artificial Sequence: Synthetic oligonucleotide

SEQ ID NO: 14738 - protein, 17 aa, Artificial Sequence
  Description of Artificial Sequence: Synthetic peptide
VIWYDGSNKNYADSVKG

SEQ ID NO: 14739 - DNA, 48 bp, Artificial Sequence; identical to SEQ ID NO: 14613
  Description of Artificial Sequence: Synthetic oligonucleotide

SEQ ID NO: 14740 - protein, 16 aa, Artificial Sequence
  Description of Artificial Sequence: Synthetic peptide
LIYTSRSTNYNPSLKS

SEQ ID NO: 14741 - DNA, 51 bp, Artificial Sequence; identical to SEQ ID NO: 14595
  Description of Artificial Sequence: Synthetic oligonucleotide

SEQ ID NO: 14742 - protein, 17 aa, Artificial Sequence
  Description of Artificial Sequence: Synthetic peptide
VIWFDGSNDYYADSVKG

SEQ ID NO: 14743 - DNA, 51 bp, Artificial Sequence
  Description of Artificial Sequence: Synthetic oligonucleotide
gctattagtggtagaggcggtagtacattctacgcagactccgtgaagggc

SEQ ID NO: 14744 - protein, 17 aa, Artificial Sequence
  Description of Artificial Sequence: Synthetic peptide
AISGRGGSTFYADSVKG

SEQ ID NO: 14745 - DNA, 51 bp, Artificial Sequence; identical to SEQ ID NO: 14633
  Description of Artificial Sequence: Synthetic oligonucleotide

SEQ ID NO: 14746 - protein, 17 aa, Artificial Sequence
  Description of Artificial Sequence: Synthetic peptide
VIWYDGSNKNYADSVKG

SEQ ID NO: 14747 - DNA, 48 bp, Artificial Sequence
  Description of Artificial Sequence: Synthetic oligonucleotide
aacatccattacagcgggagcacctacaacaacccgtccctcaagagt

SEQ ID NO: 14748 - protein, 16 aa, Artificial Sequence
  Description of Artificial Sequence: Synthetic peptide
NIHYSGSTYNNPSLKS

SEQ ID NO: 14749 - DNA, 48 bp, Artificial Sequence; identical to SEQ ID NO: 14671
  Description of Artificial Sequence: Synthetic oligonucleotide

SEQ ID NO: 14750 - protein, 16 aa, Artificial Sequence
  Description of Artificial Sequence: Synthetic peptide
NIYYSGSTYNNPSLKS

SEQ ID NO: 14751 - DNA, 48 bp, Artificial Sequence; identical to SEQ ID NO: 14671
  Description of Artificial Sequence: Synthetic oligonucleotide

SEQ ID NO: 14752 - protein, 16 aa, Artificial Sequence
  Description of Artificial Sequence: Synthetic peptide
NIYYSGSTYNNPSLKS

SEQ ID NO: 14753 - DNA, 51 bp, Artificial Sequence; identical to SEQ ID NO: 14635
  Description of Artificial Sequence: Synthetic oligonucleotide

SEQ ID NO: 14754 - protein, 17 aa, Artificial Sequence
  Description of Artificial Sequence: Synthetic peptide
AISRSGGNTHYADSVKG

SEQ ID NO: 14755 - DNA, 48 bp, Artificial Sequence; identical to SEQ ID NO: 14603
  Description of Artificial Sequence: Synthetic oligonucleotide

SEQ ID NO: 14756 - protein, 16 aa, Artificial Sequence
  Description of Artificial Sequence: Synthetic peptide
YIFYSGSTYYNPSLKS

SEQ ID NO: 14757 - DNA, 48 bp, Artificial Sequence; identical to SEQ ID NO: 14603
  Description of Artificial Sequence: Synthetic oligonucleotide

SEQ ID NO: 14758 - protein, 16 aa, Artificial Sequence
  Description of Artificial Sequence: Synthetic peptide
YIFYSGSTYYNPSLKS

SEQ ID NO: 14759 - DNA, 51 bp, Artificial Sequence
  Description of Artificial Sequence: Synthetic oligonucleotide
gctattattggtaatggtggtagaacatactacgcagactccgtgaagggc

SEQ ID NO: 14760 - protein, 17 aa, Artificial Sequence
  Description of Artificial Sequence: Synthetic peptide
AIIGNGGRTYYADSVKG

SEQ ID NO: 14761 - DNA, 51 bp, Artificial Sequence; identical to SEQ ID NO: 12103
  Description of Artificial Sequence: Synthetic oligonucleotide

SEQ ID NO: 14762 - protein, 17 aa, Artificial Sequence
  Description of Artificial Sequence: Synthetic peptide
WMNPNSGNTGYAQKFQG

SEQ ID NO: 14763 - DNA, 51 bp, Artificial Sequence; identical to SEQ ID NO: 12131
  Description of Artificial Sequence: Synthetic oligonucleotide

SEQ ID NO: 14764 - protein, 17 aa, Artificial Sequence
  Description of Artificial Sequence: Synthetic peptide
WMNPKRGNTGYAQKFQG

SEQ ID NO: 14765 - DNA, 48 bp, Artificial Sequence; identical to SEQ ID NO: 12147
  Description of Artificial Sequence: Synthetic oligonucleotide

SEQ ID NO: 14766 - protein, 16 aa, Artificial Sequence
  Description of Artificial Sequence: Synthetic peptide
YIYYSGSTYYNPSLKS

SEQ ID NO: 14767 - DNA, 48 bp, Artificial Sequence
  Description of Artificial Sequence: Synthetic oligonucleotide
gaatccaatcatagtggacgcaccaactacaacccgtccctcaagagt

SEQ ID NO: 14768 - protein, 16 aa, Artificial Sequence
  Description of Artificial Sequence: Synthetic peptide
ESNHSGRTNYNPSLKS

SEQ ID NO: 14769 - DNA, 48 bp, Artificial Sequence; identical to SEQ ID NO: 14603
  Description of Artificial Sequence: Synthetic oligonucleotide

SEQ ID NO: 14770 - protein, 16 aa, Artificial Sequence
  Description of Artificial Sequence: Synthetic peptide
YIFYSGSTYYNPSLKS

SEQ ID NO: 14771 - DNA, 51 bp, Artificial Sequence; identical to SEQ ID NO: 14633
  Description of Artificial Sequence: Synthetic oligonucleotide

SEQ ID NO: 14772 - protein, 17 aa, Artificial Sequence
  Description of Artificial Sequence: Synthetic peptide
VIWYDGSNKNYADSVKG

SEQ ID NO: 14773 - DNA, 48 bp, Artificial Sequence; identical to SEQ ID NO: 13715
  Description of Artificial Sequence: Synthetic oligonucleotide

SEQ ID NO: 14774 - protein, 16 aa, Artificial Sequence
  Description of Artificial Sequence: Synthetic peptide
EINHSGSTNYNPSLKS

SEQ ID NO: 14775 - DNA, 48 bp, Artificial Sequence; identical to SEQ ID NO: 14603
  Description of Artificial Sequence: Synthetic oligonucleotide

SEQ ID NO: 14776 - protein, 16 aa, Artificial Sequence
  Description of Artificial Sequence: Synthetic peptide
YIFYSGSTYYNPSLKS

SEQ ID NO: 14777 - DNA, 48 bp, Artificial Sequence; identical to SEQ ID NO: 14715
  Description of Artificial Sequence: Synthetic oligonucleotide

SEQ ID NO: 14778 - protein, 16 aa, Artificial Sequence
  Description of Artificial Sequence: Synthetic peptide
FIFYSGSTYYNPSLKS

SEQ ID NO: 14779 - DNA, 51 bp, Artificial Sequence; identical to SEQ ID NO: 14113
  Description of Artificial Sequence: Synthetic oligonucleotide

SEQ ID NO: 14780 - protein, 17 aa, Artificial Sequence
  Description of Artificial Sequence: Synthetic peptide
VIWYDGSYKYYADSVKG

SEQ ID NO: 14781 - DNA, 48 bp, Artificial Sequence; identical to SEQ ID NO: 14671
  Description of Artificial Sequence: Synthetic oligonucleotide

SEQ ID NO: 14782 - protein, 16 aa, Artificial Sequence
  Description of Artificial Sequence: Synthetic peptide
NIYYSGSTYNNPSLKS

SEQ ID NO: 14783 - DNA, 48 bp, Artificial Sequence; identical to SEQ ID NO: 14725
  Description of Artificial Sequence: Synthetic oligonucleotide

SEQ ID NO: 14784 - protein, 16 aa, Artificial Sequence
  Description of Artificial Sequence: Synthetic peptide
YIFYSGSTYYNPSLKS

SEQ ID NO: 14785 - DNA, 51 bp, Artificial Sequence; identical to SEQ ID NO: 14605
  Description of Artificial Sequence: Synthetic oligonucleotide

SEQ ID NO: 14786 - protein, 17 aa, Artificial Sequence
  Description of Artificial Sequence: Synthetic peptide
VIWYDGSNEHYADSVKG

SEQ ID NO: 14787 - DNA, 51 bp, Artificial Sequence
  Description of Artificial Sequence: Synthetic oligonucleotide
tccattagtagtgctggtggttacatatactacgcagactcactgaagggc

SEQ ID NO: 14788 - protein, 17 aa, Artificial Sequence
  Description of Artificial Sequence: Synthetic peptide
SISSAGGYIYYADSLKG

SEQ ID NO: 14789 - DNA, 48 bp, Artificial Sequence; identical to SEQ ID NO: 14603
  Description of Artificial Sequence: Synthetic oligonucleotide

SEQ ID NO: 14790 - protein, 16 aa, Artificial Sequence
  Description of Artificial Sequence: Synthetic peptide
YIFYSGSTYYNPSLKS

SEQ ID NO: 14791 - DNA, 51 bp, Artificial Sequence
  Description of Artificial Sequence: Synthetic oligonucleotide
gttatatggtatgatggaactaataaatactatggagactccgtgaagggc

SEQ ID NO: 14792 - protein, 17 aa, Artificial Sequence
  Description of Artificial Sequence: Synthetic peptide
VIWYDGTNKYYGDSVKG

SEQ ID NO: 14793 - DNA, 51 bp, Artificial Sequence; identical to SEQ ID NO: 14605
  Description of Artificial Sequence: Synthetic oligonucleotide

SEQ ID NO: 14794 - protein, 17 aa, Artificial Sequence
  Description of Artificial Sequence: Synthetic peptide
VIWYDGSNEHYADSVKG

SEQ ID NO: 14795 - DNA, 48 bp, Artificial Sequence; identical to SEQ ID NO: 14675
  Description of Artificial Sequence: Synthetic oligonucleotide

SEQ ID NO: 14796 - protein, 16 aa, Artificial Sequence
  Description of Artificial Sequence: Synthetic peptide
RIYASGSTNYNPSLKS

SEQ ID NO: 14797 - DNA, 51 bp, Artificial Sequence; identical to SEQ ID NO: 12197
  Description of Artificial Sequence: Synthetic oligonucleotide

SEQ ID NO: 14798 - protein, 17 aa, Artificial Sequence
  Description of Artificial Sequence: Synthetic peptide
WINPNSGGTNYAQKFQG

SEQ ID NO: 14799 - DNA, 48 bp, Artificial Sequence
  Description of Artificial Sequence: Synthetic oligonucleotide
cttatctataccagtaggagcaccaactacaacccctccctcaagagt

SEQ ID NO: 14800 - protein, 16 aa, Artificial Sequence
  Description of Artificial Sequence: Synthetic peptide
LIYTSRSTNYNPSLKS

SEQ ID NO: 14801 - DNA, 48 bp, Artificial Sequence; identical to SEQ ID NO: 14603
  Description of Artificial Sequence: Synthetic oligonucleotide

SEQ ID NO: 14802 - protein, 16 aa, Artificial Sequence
  Description of Artificial Sequence: Synthetic peptide
YIFYSGSTYYNPSLKS

SEQ ID NO: 14803 - DNA, 48 bp, Artificial Sequence; identical to SEQ ID NO: 14715
  Description of Artificial Sequence: Synthetic oligonucleotide

SEQ ID NO: 14804 - protein, 16 aa, Artificial Sequence
  Description of Artificial Sequence: Synthetic peptide
FIFYSGSTYYNPSLKS

SEQ ID NO: 14805 - DNA, 51 bp, Artificial Sequence; identical to SEQ ID NO: 13745
  Description of Artificial Sequence: Synthetic oligonucleotide

SEQ ID NO: 14806 - protein, 17 aa, Artificial Sequence
  Description of Artificial Sequence: Synthetic peptide
VIWYDGSNKNYADSVKG

SEQ ID NO: 14807 - DNA, 51 bp, Artificial Sequence
  Description of Artificial Sequence: Synthetic oligonucleotide
tggatcaaccctaacaatggtggcacaaactatgcacagaaatttcagggc

SEQ ID NO: 14808 - protein, 17 aa, Artificial Sequence
  Description of Artificial Sequence: Synthetic peptide
WINPNNGGTNYAQKFQG

SEQ ID NO: 14809 - DNA, 48 bp, Artificial Sequence; identical to SEQ ID NO: 13715
  Description of Artificial Sequence: Synthetic oligonucleotide

SEQ ID NO: 14810 - protein, 16 aa, Artificial Sequence
  Description of Artificial Sequence: Synthetic peptide
EINHSGSTNYNPSLKS

SEQ ID NO: 14811 - DNA, 51 bp, Artificial Sequence; identical to SEQ ID NO: 12123
  Description of Artificial Sequence: Synthetic oligonucleotide

SEQ ID NO: 14812 - protein, 17 aa, Artificial Sequence
  Description of Artificial Sequence: Synthetic peptide
VIWYDGSNKYYADSVKG

SEQ ID NO: 14813 - DNA, 51 bp, Artificial Sequence; identical to SEQ ID NO: 14605
  Description of Artificial Sequence: Synthetic oligonucleotide

SEQ ID NO: 14814 - protein, 17 aa, Artificial Sequence
  Description of Artificial Sequence: Synthetic peptide
VIWYDGSNEHYADSVKG

SEQ ID NO: 14815 - DNA, 51 bp, Artificial Sequence; identical to SEQ ID NO: 14595
  Description of Artificial Sequence: Synthetic oligonucleotide

SEQ ID NO: 14816 - protein, 17 aa, Artificial Sequence
  Description of Artificial Sequence: Synthetic peptide
VIWFDGSNDYYADSVKG

SEQ ID NO: 14817 - DNA, 48 bp, Artificial Sequence; identical to SEQ ID NO: 13963
  Description of Artificial Sequence: Synthetic oligonucleotide

SEQ ID NO: 14818 - protein, 16 aa, Artificial Sequence
  Description of Artificial Sequence: Synthetic peptide
EINHSGRTNYNPSLKS

SEQ ID NO: 14819 - DNA, 51 bp, Artificial Sequence
  Description of Artificial Sequence: Synthetic oligonucleotide
gttatttggtatgatggaactaataaatactatgcagactccgtgaagggc

SEQ ID NO: 14820 - protein, 17 aa, Artificial Sequence
  Description of Artificial Sequence: Synthetic peptide
VIWYDGTNKYYADSVKG

SEQ ID NO: 14821 - DNA, 48 bp, Artificial Sequence
  Description of Artificial Sequence: Synthetic oligonucleotide
tacagctattacagtgggagcaccaactataacccgtccctcaagagt

SEQ ID NO: 14822 - protein, 16 aa, Artificial Sequence
  Description of Artificial Sequence: Synthetic peptide
YSYYSGSTNYNPSLKS

SEQ ID NO: 14823 - DNA, 51 bp, Artificial Sequence; identical to SEQ ID NO: 13745
  Description of Artificial Sequence: Synthetic oligonucleotide

SEQ ID NO: 14824 - protein, 17 aa, Artificial Sequence
  Description of Artificial Sequence: Synthetic peptide
VIWYDGSNKNYADSVKG

SEQ ID NO: 14825 - DNA, 48 bp, Artificial Sequence; identical to SEQ ID NO: 14603
  Description of Artificial Sequence: Synthetic oligonucleotide

SEQ ID NO: 14826 - protein, 16 aa, Artificial Sequence
  Description of Artificial Sequence: Synthetic peptide
YIFYSGSTYYNPSLKS

SEQ ID NO: 14827 - DNA, 51 bp, Artificial Sequence; identical to SEQ ID NO: 14605
  Description of Artificial Sequence: Synthetic oligonucleotide

SEQ ID NO: 14828 - protein, 17 aa, Artificial Sequence
  Description of Artificial Sequence: Synthetic peptide
VIWYDGSNEHYADSVKG

SEQ ID NO: 14829 - DNA, 51 bp, Artificial Sequence; identical to SEQ ID NO: 12123
  Description of Artificial Sequence: Synthetic oligonucleotide

SEQ ID NO: 14830 - protein, 17 aa, Artificial Sequence
  Description of Artificial Sequence: Synthetic peptide
VIWYDGSNKYYADSVKG

SEQ ID NO: 14831 - DNA, 48 bp, Artificial Sequence
  Description of Artificial Sequence: Synthetic oligonucleotide
tacatgtattacagtgggagcacctactacaacccgtccctcaagagt

SEQ ID NO: 14832 - protein, 16 aa, Artificial Sequence
  Description of Artificial Sequence: Synthetic peptide
YMYYSGSTYYNPSLKS

SEQ ID NO: 14833 - DNA, 48 bp, Artificial Sequence; identical to SEQ ID NO: 12147
  Description of Artificial Sequence: Synthetic oligonucleotide

SEQ ID NO: 14834 - protein, 16 aa, Artificial Sequence
  Description of Artificial Sequence: Synthetic peptide
YIYYSGSTYYNPSLKS

SEQ ID NO: 14835 - DNA, 51 bp, Artificial Sequence; identical to SEQ ID NO: 14661
  Description of Artificial Sequence: Synthetic oligonucleotide

SEQ ID NO: 14836 - protein, 17 aa, Artificial Sequence
  Description of Artificial Sequence: Synthetic peptide
YISSSGTTVFYADSVKG

SEQ ID NO: 14837 - DNA, 51 bp, Artificial Sequence; identical to SEQ ID NO: 14635
  Description of Artificial Sequence: Synthetic oligonucleotide

SEQ ID NO: 14838 - protein, 17 aa, Artificial Sequence
  Description of Artificial Sequence: Synthetic peptide
AISRSGGNTHYADSVKG

SEQ ID NO: 14839 - DNA, 51 bp, Artificial Sequence
  Description of Artificial Sequence: Synthetic oligonucleotide
tacattagtagtagtggtattaccatgtactacgcagactctgtgaagggc

SEQ ID NO: 14840 - protein, 17 aa, Artificial Sequence
  Description of Artificial Sequence: Synthetic peptide
YISSSGITMYYADSVKG

SEQ ID NO: 14841 - DNA, 51 bp, Artificial Sequence; identical to SEQ ID NO: 14661
  Description of Artificial Sequence: Synthetic oligonucleotide

SEQ ID NO: 14842 - protein, 17 aa, Artificial Sequence
  Description of Artificial Sequence: Synthetic peptide
YISSSGTTVFYADSVKG

SEQ ID NO: 14843 - DNA, 51 bp, Artificial Sequence
  Description of Artificial Sequence: Synthetic oligonucleotide
gttatattaaatgatggaagtaataaaaagtgtgcagactccgtgaagggc

SEQ ID NO: 14844 - protein, 17 aa, Artificial Sequence
  Description of Artificial Sequence: Synthetic peptide
VILNDGSNKKCADSVKG

SEQ ID NO: 14845 - DNA, 51 bp, Artificial Sequence; identical to SEQ ID NO: 12421
  Description of Artificial Sequence: Synthetic oligonucleotide

SEQ ID NO: 14846 - protein, 17 aa, Artificial Sequence
  Description of Artificial Sequence: Synthetic peptide
AISGSGGSTYYADSVKG

SEQ ID NO: 14847 - DNA, 51 bp, Artificial Sequence; identical to SEQ ID NO: 14605
  Description of Artificial Sequence: Synthetic oligonucleotide

SEQ ID NO: 14848 - protein, 17 aa, Artificial Sequence
  Description of Artificial Sequence: Synthetic peptide
VIWYDGSNEHYADSVKG

SEQ ID NO: 14849 - DNA, 51 bp, Artificial Sequence
  Description of Artificial Sequence: Synthetic oligonucleotide
tggatgcaccttaacagtggtaacacaggctatgcaccgaagttccagggc

SEQ ID NO: 14850 - protein, 17 aa, Artificial Sequence
  Description of Artificial Sequence: Synthetic peptide
WMHLNSGNTGYAPKFQG

SEQ ID NO: 14851 - DNA, 51 bp, Artificial Sequence
  Description of Artificial Sequence: Synthetic oligonucleotide
tggatcaaccctaacagtggtggcacaaactttgcacagaagtttcggggc

SEQ ID NO: 14852 - protein, 17 aa, Artificial Sequence
  Description of Artificial Sequence: Synthetic peptide
WINPNSGGTNFAQKFRG

SEQ ID NO: 14853 - DNA, 51 bp, Artificial Sequence; identical to SEQ ID NO: 14819
  Description of Artificial Sequence: Synthetic oligonucleotide

SEQ ID NO: 14854 - protein, 17 aa, Artificial Sequence
  Description of Artificial Sequence: Synthetic peptide
VIWYDGTNKYYADSVKG

SEQ ID NO: 14855 - DNA, 48 bp, Artificial Sequence
  Description of Artificial Sequence: Synthetic oligonucleotide
ttcatctattacagtgggagcacctactacaatccgtccctcaagagt

SEQ ID NO: 14856 - protein, 16 aa, Artificial Sequence
  Description of Artificial Sequence: Synthetic peptide
FIYYSGSTYYNPSLKS

SEQ ID NO: 14857 - DNA, 51 bp, Artificial Sequence; identical to SEQ ID NO: 14575
  Description of Artificial Sequence: Synthetic oligonucleotide

SEQ ID NO: 14858 - protein, 17 aa, Artificial Sequence
  Description of Artificial Sequence: Synthetic peptide
SISSGSGYIHYADSVKG

SEQ ID NO: 14859 - DNA, 51 bp, Artificial Sequence; identical to SEQ ID NO: 12131
  Description of Artificial Sequence: Synthetic oligonucleotide

SEQ ID NO: 14860 - protein, 17 aa, Artificial Sequence
  Description of Artificial Sequence: Synthetic peptide
WMNPKRGNTGYAQKFQG

SEQ ID NO: 14861 - DNA, 48 bp, Artificial Sequence; identical to SEQ ID NO: 14671
  Description of Artificial Sequence: Synthetic oligonucleotide

SEQ ID NO: 14862 - protein, 16 aa, Artificial Sequence
  Description of Artificial Sequence: Synthetic peptide
NIYYSGSTYNNPSLKS

SEQ ID NO: 14863 - DNA, 51 bp, Artificial Sequence; identical to SEQ ID NO: 13745
  Description of Artificial Sequence: Synthetic oligonucleotide

SEQ ID NO: 14864 - protein, 17 aa, Artificial Sequence
  Description of Artificial Sequence: Synthetic peptide
VIWYDGSNKNYADSVKG

SEQ ID NO: 14865 - DNA, 51 bp, Artificial Sequence; identical to SEQ ID NO: 13745
  Description of Artificial Sequence: Synthetic oligonucleotide

SEQ ID NO: 14866 - protein, 17 aa, Artificial Sequence
  Description of Artificial Sequence: Synthetic peptide
VIWYDGSNKNYADSVKG

SEQ ID NO: 14867 - DNA, 48 bp, Artificial Sequence; identical to SEQ ID NO: 14603
  Description of Artificial Sequence: Synthetic oligonucleotide

SEQ ID NO: 14868 - protein, 16 aa, Artificial Sequence
  Description of Artificial Sequence: Synthetic peptide
YIFYSGSTYYNPSLKS

SEQ ID NO: 14869 - DNA, 51 bp, Artificial Sequence; identical to SEQ ID NO: 12161
  Description of Artificial Sequence: Synthetic oligonucleotide

SEQ ID NO: 14870 - protein, 17 aa, Artificial Sequence
  Description of Artificial Sequence: Synthetic peptide
WMHPNSGNTGYAQKFQG

SEQ ID NO: 14871 - DNA, 51 bp, Artificial Sequence; identical to SEQ ID NO: 14633
  Description of Artificial Sequence: Synthetic oligonucleotide

SEQ ID NO: 14872 - protein, 17 aa, Artificial Sequence
  Description of Artificial Sequence: Synthetic peptide
VIWYDGSNKNYADSVKG

SEQ ID NO: 14873 - DNA, 51 bp, Artificial Sequence; identical to SEQ ID NO: 12161
  Description of Artificial Sequence: Synthetic oligonucleotide

SEQ ID NO: 14874 - protein, 17 aa, Artificial Sequence
  Description of Artificial Sequence: Synthetic peptide
WMHPNSGNTGYAQKFQG

SEQ ID NO: 14875 - DNA, 51 bp, Artificial Sequence
  Description of Artificial Sequence: Synthetic oligonucleotide
gctatcattggtaatggtggtagagcatactacgcagactccgtgaagggc

SEQ ID NO: 14876 - protein, 17 aa, Artificial Sequence
  Description of Artificial Sequence: Synthetic peptide
AIIGNGGRAYYADSVKG

SEQ ID NO: 14877 - DNA, 48 bp, Artificial Sequence
  Description of Artificial Sequence: Synthetic oligonucleotide
cgtctctctcctggtgggagcaccaacttcaacccctccctcaagagt

SEQ ID NO: 14878 - protein, 16 aa, Artificial Sequence
  Description of Artificial Sequence: Synthetic peptide
RLSPGGSTNFNPSLKS

SEQ ID NO: 14879 - DNA, 51 bp, Artificial Sequence
  Description of Artificial Sequence: Synthetic oligonucleotide
gttattagtggtagaggtggtaacacatactacgcagactccgtgaagggc

SEQ ID NO: 14880 - protein, 17 aa, Artificial Sequence
  Description of Artificial Sequence: Synthetic peptide
VISGRGGNTYYADSVKG

SEQ ID NO: 14881 - DNA, 51 bp, Artificial Sequence
  Description of Artificial Sequence: Synthetic oligonucleotide
gttacatggtatgatggaagtaataaatactatgcagactccgtgaagggc

SEQ ID NO: 14882 - protein, 17 aa, Artificial Sequence
  Description of Artificial Sequence: Synthetic peptide
VTWYDGSNKYYADSVKG

SEQ ID NO: 14883 - DNA, 51 bp, Artificial Sequence; identical to SEQ ID NO: 14595
  Description of Artificial Sequence: Synthetic oligonucleotide

SEQ ID NO: 14884 - protein, 17 aa, Artificial Sequence
  Description of Artificial Sequence: Synthetic peptide
VIWFDGSNDYYADSVKG

SEQ ID NO: 14885 - DNA, 51 bp, Artificial Sequence; identical to SEQ ID NO: 13745
  Description of Artificial Sequence: Synthetic oligonucleotide

SEQ ID NO: 14886 - protein, 17 aa, Artificial Sequence
  Description of Artificial Sequence: Synthetic peptide
VIWYDGSNKNYADSVKG

SEQ ID NO: 14887 - DNA, 48 bp, Artificial Sequence
  Description of Artificial Sequence: Synthetic oligonucleotide
tacatcttccacagtgggagcacctactacaacccgtccctcaagagt

SEQ ID NO: 14888 - protein, 16 aa, Artificial Sequence
  Description of Artificial Sequence: Synthetic peptide
YIFHSGSTYYNPSLKS

SEQ ID NO: 14889 - DNA, 48 bp, Artificial Sequence; identical to SEQ ID NO: 14715
  Description of Artificial Sequence: Synthetic oligonucleotide

SEQ ID NO: 14890 - protein, 16 aa, Artificial Sequence
  Description of Artificial Sequence: Synthetic peptide
FIFYSGSTYYNPSLKS

SEQ ID NO: 14891 - DNA, 48 bp, Artificial Sequence
  Description of Artificial Sequence: Synthetic oligonucleotide
aacatctattacagtgggagcacctactacaacccgtccctcaagagt

SEQ ID NO: 14892 - protein, 16 aa, Artificial Sequence
  Description of Artificial Sequence: Synthetic peptide
NIYYSGSTYYNPSLKS

SEQ ID NO: 14893 - DNA, 51 bp, Artificial Sequence
  Description of Artificial Sequence: Synthetic oligonucleotide
gttatatggtatgatggaagtaataaacactatgcagactccgtgaagggc

SEQ ID NO: 14894 - protein, 17 aa, Artificial Sequence
  Description of Artificial Sequence: Synthetic peptide
VIWYDGSNKHYADSVKG

SEQ ID NO: 14895 - DNA, 51 bp, Artificial Sequence
  Description of Artificial Sequence: Synthetic oligonucleotide
attatatggtttgatggaagtaataaatactatgtagactccgtgaagggc

SEQ ID NO: 14896 - protein, 17 aa, Artificial Sequence
  Description of Artificial Sequence: Synthetic peptide
IIWFDGSNKYYVDSVKG

SEQ ID NO: 14897 - DNA, 48 bp, Artificial Sequence; identical to SEQ ID NO: 14685
  Description of Artificial Sequence: Synthetic oligonucleotide

SEQ ID NO: 14898 - protein, 16 aa, Artificial Sequence
  Description of Artificial Sequence: Synthetic peptide
HIYTSRSTNYNPSLKS

SEQ ID NO: 14899 - DNA, 48 bp, Artificial Sequence; identical to SEQ ID NO: 14603
  Description of Artificial Sequence: Synthetic oligonucleotide

SEQ ID NO: 14900 - protein, 16 aa, Artificial Sequence
  Description of Artificial Sequence: Synthetic peptide
YIFYSGSTYYNPSLKS

SEQ ID NO: 14901 - DNA, 48 bp, Artificial Sequence; identical to SEQ ID NO: 14603
  Description of Artificial Sequence: Synthetic oligonucleotide

SEQ ID NO: 14902 - protein, 16 aa, Artificial Sequence
  Description of Artificial Sequence: Synthetic peptide
YIFYSGSTYYNPSLKS

SEQ ID NO: 14903 - DNA, 48 bp, Artificial Sequence; identical to SEQ ID NO: 13715
  Description of Artificial Sequence: Synthetic oligonucleotide

SEQ ID NO: 14904 - protein, 16 aa, Artificial Sequence
  Description of Artificial Sequence: Synthetic peptide
EINHSGSTNYNPSLKS

SEQ ID NO: 14905 - DNA, 51 bp, Artificial Sequence; identical to SEQ ID NO: 13745
  Description of Artificial Sequence: Synthetic oligonucleotide

SEQ ID NO: 14906 - protein, 17 aa, Artificial Sequence
  Description of Artificial Sequence: Synthetic peptide
VIWYDGSNKNYADSVKG

SEQ ID NO: 14907 - DNA, 51 bp, Artificial Sequence; identical to SEQ ID NO: 14697
  Description of Artificial Sequence: Synthetic oligonucleotide

SEQ ID NO: 14908 - protein, 17 aa, Artificial Sequence
  Description of Artificial Sequence: Synthetic peptide
IIWFDGSNQYYADSVKG

SEQ ID NO: 14909 - DNA, 51 bp, Artificial Sequence; identical to SEQ ID NO: 14581
  Description of Artificial Sequence: Synthetic oligonucleotide

SEQ ID NO: 14910 - protein, 17 aa, Artificial Sequence
  Description of Artificial Sequence: Synthetic peptide
IIWFDGSNKYYADSVKG

SEQ ID NO: 14911 - DNA, 48 bp, Artificial Sequence; identical to SEQ ID NO: 14715
  Description of Artificial Sequence: Synthetic oligonucleotide

SEQ ID NO: 14912 - protein, 16 aa, Artificial Sequence
  Description of Artificial Sequence: Synthetic peptide
FIFYSGSTYYNPSLKS

SEQ ID NO: 14913 - DNA, 48 bp, Artificial Sequence; identical to SEQ ID NO: 14891
  Description of Artificial Sequence: Synthetic oligonucleotide

SEQ ID NO: 14914 - protein, 16 aa, Artificial Sequence
  Description of Artificial Sequence: Synthetic peptide
NIYYSGSTYYNPSLKS

SEQ ID NO: 14915 - DNA, 51 bp, Artificial Sequence
  Description of Artificial Sequence: Synthetic oligonucleotide
gctattagtggtagaggcggtaatacattctacgcagactccgtgaggggc

SEQ ID NO: 14916 - protein, 17 aa, Artificial Sequence
  Description of Artificial Sequence: Synthetic peptide
AISGRGGNTFYADSVRG

SEQ ID NO: 14917 - DNA, 51 bp, Artificial Sequence; identical to SEQ ID NO: 12123
  Description of Artificial Sequence: Synthetic oligonucleotide

SEQ ID NO: 14918 - protein, 17 aa, Artificial Sequence
  Description of Artificial Sequence: Synthetic peptide
VIWYDGSNKYYADSVKG

SEQ ID NO: 14919 - DNA, 48 bp, Artificial Sequence
  Description of Artificial Sequence: Synthetic oligonucleotide
tacatcttttacagtgggagcaccaactacaacccgtccctcaggagt

SEQ ID NO: 14920 - protein, 16 aa, Artificial Sequence
  Description of Artificial Sequence: Synthetic peptide
YIFYSGSTNYNPSLRS

SEQ ID NO: 14921 - DNA, 51 bp, Artificial Sequence; identical to SEQ ID NO: 14849
  Description of Artificial Sequence: Synthetic oligonucleotide

SEQ ID NO: 14922 - protein, 17 aa, Artificial Sequence
  Description of Artificial Sequence: Synthetic peptide
WMHLNSGNTGYAPKFQG

SEQ ID NO: 14923 - DNA, 48 bp, Artificial Sequence; identical to SEQ ID NO: 14443
  Description of Artificial Sequence: Synthetic oligonucleotide

SEQ ID NO: 14924 - protein, 16 aa, Artificial Sequence
  Description of Artificial Sequence: Synthetic peptide
RIYTSGSTNYNPSLKS

SEQ ID NO: 14925 - DNA, 51 bp, Artificial Sequence
  Description of Artificial Sequence: Synthetic oligonucleotide
gttatatcatatgatggaggttataaaaactatatagactccgtgaagggc

SEQ ID NO: 14926 - protein, 17 aa, Artificial Sequence
  Description of Artificial Sequence: Synthetic peptide
VISYDGGYKNYIDSVKG

SEQ ID NO: 14927 - DNA, 48 bp, Artificial Sequence; identical to SEQ ID NO: 14603
  Description of Artificial Sequence: Synthetic oligonucleotide

SEQ ID NO: 14928 - protein, 16 aa, Artificial Sequence
  Description of Artificial Sequence: Synthetic peptide
YIFYSGSTYYNPSLKS

SEQ ID NO: 14929 - DNA, 48 bp, Artificial Sequence
  Description of Artificial Sequence: Synthetic oligonucleotide
gaaatcagtcatagtggaagcaccaactacaacccgtccctcaagagt

SEQ ID NO: 14930 - protein, 16 aa, Artificial Sequence
  Description of Artificial Sequence: Synthetic peptide
EISHSGSTNYNPSLKS

SEQ ID NO: 14931 - DNA, 48 bp, Artificial Sequence
  Description of Artificial Sequence: Synthetic oligonucleotide
gaaatcagtcatagtggacgcaccaactacaacccgtccctcaagagt

SEQ ID NO: 14932 - protein, 16 aa, Artificial Sequence
  Description of Artificial Sequence: Synthetic peptide
EISHSGRTNYNPSLKS

SEQ ID NO: 14933 - DNA, 48 bp, Artificial Sequence
  Description of Artificial Sequence: Synthetic oligonucleotide
gaagtcaatcatagtggaagcaccaactacaacccgtccctcaagagt

SEQ ID NO: 14934 - protein, 16 aa, Artificial Sequence
  Description of Artificial Sequence: Synthetic peptide
EVNHSGSTNYNPSLKS

SEQ ID NO: 14935 - DNA, 51 bp, Artificial Sequence
  Description of Artificial Sequence: Synthetic oligonucleotide
tggatcagcgcttataatggtaacacaaagaatgcacagaggttccagggc

SEQ ID NO: 14936 - protein, 17 aa, Artificial Sequence
  Description of Artificial Sequence: Synthetic peptide
WISAYNGNTKNAQRFQG

SEQ ID NO: 14937 - DNA, 54 bp, Artificial Sequence
  Description of Artificial Sequence: Synthetic oligonucleotide
aggacatactacaggtccaagtggtataattattatgaagtatctgtgagaagt

SEQ ID NO: 14938 - protein, 18 aa, Artificial Sequence
  Description of Artificial Sequence: Synthetic peptide
RTYYRSKWYNYYEVSVRS

SEQ ID NO: 14939 - DNA, 48 bp, Artificial Sequence; identical to SEQ ID NO: 13715
  Description of Artificial Sequence: Synthetic oligonucleotide

SEQ ID NO: 14940 - protein, 16 aa, Artificial Sequence
  Description of Artificial Sequence: Synthetic peptide
EINHSGSTNYNPSLKS

SEQ ID NO: 14941 - DNA, 51 bp, Artificial Sequence
  Description of Artificial Sequence: Synthetic oligonucleotide
tggatcgaccctaacagtggtggcacaaactatccacagaagtttcagggc

SEQ ID NO: 14942 - protein, 17 aa, Artificial Sequence
  Description of Artificial Sequence: Synthetic peptide
WIDPNSGGTNYPQKFQG

SEQ ID NO: 14943 - DNA, 48 bp, Artificial Sequence; identical to SEQ ID NO: 14929
  Description of Artificial Sequence: Synthetic oligonucleotide

SEQ ID NO: 14944 - protein, 16 aa, Artificial Sequence
  Description of Artificial Sequence: Synthetic peptide
EISHSGSTNYNPSLKS

SEQ ID NO: 14945 - DNA, 51 bp, Artificial Sequence; identical to SEQ ID NO: 12207
  Description of Artificial Sequence: Synthetic oligonucleotide

SEQ ID NO: 14946 - protein, 17 aa, Artificial Sequence
  Description of Artificial Sequence: Synthetic peptide
WINPNSGGTNYAQKFQG

SEQ ID NO: 14947 - DNA, 51 bp, Artificial Sequence
  Description of Artificial Sequence: Synthetic oligonucleotide
actattagtggtagtggtgttagaacatactacgcagactccgtgaagggc

SEQ ID NO: 14948 - protein, 17 aa, Artificial Sequence
  Description of Artificial Sequence: Synthetic peptide
TISGSGVRTYYADSVKG

SEQ ID NO: 14949 - DNA, 51 bp, Artificial Sequence
  Description of Artificial Sequence: Synthetic oligonucleotide
tggatgaaccctaagagaggtaacacaggctatgcacagaagttccagggc

SEQ ID NO: 14950 - protein, 17 aa, Artificial Sequence
  Description of Artificial Sequence: Synthetic peptide
WMNPKRGNTGYAQKFQG

SEQ ID NO: 14951 - DNA, 54 bp, Artificial Sequence
  Description of Artificial Sequence: Synthetic oligonucleotide
aggacatactacaggtccaagtggtataattattatgaagtatctgtgaaaagt

SEQ ID NO: 14952 - protein, 18 aa, Artificial Sequence
  Description of Artificial Sequence: Synthetic peptide
RTYYRSKWYNYYEVSVKS

SEQ ID NO: 14953 - DNA, 54 bp, Artificial Sequence
  Description of Artificial Sequence: Synthetic oligonucleotide
aggacatactacaggtccaagtggtataatgagtatgcagtatctgtgagaagt

SEQ ID NO: 14954 - protein, 18 aa, Artificial Sequence
  Description of Artificial Sequence: Synthetic peptide
RTYYRSKWYNEYAVSVRS

SEQ ID NO: 14955 - DNA, 51 bp, Artificial Sequence; identical to SEQ ID NO: 14947
  Description of Artificial Sequence: Synthetic oligonucleotide

SEQ ID NO: 14956 - protein, 17 aa, Artificial Sequence
  Description of Artificial Sequence: Synthetic peptide
TISGSGVRTYYADSVKG

SEQ ID NO: 14957 - DNA, 48 bp, Artificial Sequence
  Description of Artificial Sequence: Synthetic oligonucleotide
gaaatcaatcatagtggaagcaccaactacaatccgtccctcaagagt

SEQ ID NO: 14958 - protein, 16 aa, Artificial Sequence
  Description of Artificial Sequence: Synthetic peptide
EINHSGSTNYNPSLKS

SEQ ID NO: 14959 - DNA, 51 bp, Artificial Sequence
  Description of Artificial Sequence: Synthetic oligonucleotide
attatatggtatgatggaagtaataaattctatgcagactccgtgaagggc

SEQ ID NO: 14960 - protein, 17 aa, Artificial Sequence
  Description of Artificial Sequence: Synthetic peptide
IIWYDGSNKFYADSVKG

SEQ ID NO: 14961 - DNA, 51 bp, Artificial Sequence; identical to SEQ ID NO: 13745
  Description of Artificial Sequence: Synthetic oligonucleotide

SEQ ID NO: 14962 - protein, 17 aa, Artificial Sequence
  Description of Artificial Sequence: Synthetic peptide
VIWYDGSNKNYADSVKG

SEQ ID NO: 14963 - DNA, 51 bp, Artificial Sequence; identical to SEQ ID NO: 12207
  Description of Artificial Sequence: Synthetic oligonucleotide

SEQ ID NO: 14964 - protein, 17 aa, Artificial Sequence
  Description of Artificial Sequence: Synthetic peptide
WINPNSGGTNYAQKFQG

SEQ ID NO: 14965 - DNA, 51 bp, Artificial Sequence; identical to SEQ ID NO: 12133
  Description of Artificial Sequence: Synthetic oligonucleotide

SEQ ID NO: 14966 - protein, 17 aa, Artificial Sequence
  Description of Artificial Sequence: Synthetic peptide
VIWYDGSNKYYVDSVKG

SEQ ID NO: 14967 - DNA, 51 bp, Artificial Sequence; identical to SEQ ID NO: 14309
  Description of Artificial Sequence: Synthetic oligonucleotide

SEQ ID NO: 14968 - protein, 17 aa, Artificial Sequence
  Description of Artificial Sequence: Synthetic peptide
VIWYDVNNKYYADSVKG

SEQ ID NO: 14969 - DNA, 51 bp, Artificial Sequence
  Description of Artificial Sequence: Synthetic oligonucleotide
tacattagtggtagtggtactaccacatactacgcagactctgtgaagggc

SEQ ID NO: 14970 - protein, 17 aa, Artificial Sequence
  Description of Artificial Sequence: Synthetic peptide
YISGSGTTTYYADSVKG

SEQ ID NO: 14971 - DNA, 51 bp, Artificial Sequence; identical to SEQ ID NO: 12161
  Description of Artificial Sequence: Synthetic oligonucleotide

SEQ ID NO: 14972 - protein, 17 aa, Artificial Sequence
  Description of Artificial Sequence: Synthetic peptide
WMHPNSGNTGYAQKFQG

SEQ ID NO: 14973 - DNA, 51 bp, Artificial Sequence
  Description of Artificial Sequence: Synthetic oligonucleotide
gttatatggtatgatggaagtaataaatataatgcagactccgtgaagggc

SEQ ID NO: 14974 - protein, 17 aa, Artificial Sequence
  Description of Artificial Sequence: Synthetic peptide
VIWYDGSNKYNADSVKG

SEQ ID NO: 14975 - DNA, 51 bp, Artificial Sequence; identical to SEQ ID NO: 12207
  Description of Artificial Sequence: Synthetic oligonucleotide

SEQ ID NO: 14976 - protein, 17 aa, Artificial Sequence
  Description of Artificial Sequence: Synthetic peptide
WINPNSGGTNYAQKFQG

SEQ ID NO: 14977 - DNA, 54 bp, Artificial Sequence; identical to SEQ ID NO: 14937
  Description of Artificial Sequence: Synthetic oligonucleotide

SEQ ID NO: 14978 - protein, 18 aa, Artificial Sequence
  Description of Artificial Sequence: Synthetic peptide
RTYYRSKWYNYYEVSVRS

SEQ ID NO: 14979 - DNA, 51 bp, Artificial Sequence
  Description of Artificial Sequence: Synthetic oligonucleotide
gctattagtggtagtggtggtagcacatattacgcagactccgtgaagggc

SEQ ID NO: 14980 - protein, 17 aa, Artificial Sequence
  Description of Artificial Sequence: Synthetic peptide
AISGSGGSTYYADSVKG

SEQ ID NO: 14981 - DNA, 51 bp, Artificial Sequence; identical to SEQ ID NO: 13745
  Description of Artificial Sequence: Synthetic oligonucleotide

SEQ ID NO: 14982 - protein, 17 aa, Artificial Sequence
  Description of Artificial Sequence: Synthetic peptide
VIWYDGSNKNYADSVKG

SEQ ID NO: 14983 - DNA, 51 bp, Artificial Sequence
  Description of Artificial Sequence: Synthetic oligonucleotide
gttatatggtatgatggtagcaatgaaaattatgtagcctccgtgaagggc

SEQ ID NO: 14984 - protein, 17 aa, Artificial Sequence
  Description of Artificial Sequence: Synthetic peptide
VIWYDGSNENYVASVKG

SEQ ID NO: 14985 - DNA, 48 bp, Artificial Sequence
  Description of Artificial Sequence: Synthetic oligonucleotide
gaaatcagtcatagtggaagcaccagttacaacccgtccctcaagagt

SEQ ID NO: 14986 - protein, 16 aa, Artificial Sequence
  Description of Artificial Sequence: Synthetic peptide
EISHSGSTSYNPSLKS

SEQ ID NO: 14987 - DNA, 48 bp, Artificial Sequence
  Description of Artificial Sequence: Synthetic oligonucleotide
gaaatgtatcattttggaaacaccaactacaacccgtccctcaagagt

SEQ ID NO: 14988 - protein, 16 aa, Artificial Sequence
  Description of Artificial Sequence: Synthetic peptide
EMYHFGNTNYNPSLKS

SEQ ID NO: 14989 - DNA, 51 bp, Artificial Sequence; identical to SEQ ID NO: 12123
  Description of Artificial Sequence: Synthetic oligonucleotide

SEQ ID NO: 14990 - protein, 17 aa, Artificial Sequence
  Description of Artificial Sequence: Synthetic peptide
VIWYDGSNKYYADSVKG

SEQ ID NO: 14991 - DNA, 54 bp, Artificial Sequence
  Description of Artificial Sequence: Synthetic oligonucleotide
aggacatattacaggtccaagtggtataattattatgaagtatctgtgagaagt

SEQ ID NO: 14992 - protein, 18 aa, Artificial Sequence
  Description of Artificial Sequence: Synthetic peptide
RTYYRSKWYNYYEVSVRS

SEQ ID NO: 14993 - DNA, 51 bp, Artificial Sequence
  Description of Artificial Sequence: Synthetic oligonucleotide
gttatatggtatgatggaagtaatgagaattatgtagactccgtgaagggc

SEQ ID NO: 14994 - protein, 17 aa, Artificial Sequence
  Description of Artificial Sequence: Synthetic peptide
VIWYDGSNENYVDSVKG

SEQ ID NO: 14995 - DNA, 48 bp, Artificial Sequence
  Description of Artificial Sequence: Synthetic oligonucleotide
gaaagcaatcagagtggacgcaccacctacaacccgtccctcaagagt

SEQ ID NO: 14996 - protein, 16 aa, Artificial Sequence
  Description of Artificial Sequence: Synthetic peptide
ESNQSGRTTYNPSLKS

SEQ ID NO: 14997 - DNA, 51 bp, Artificial Sequence; identical to SEQ ID NO: 14947
  Description of Artificial Sequence: Synthetic oligonucleotide

SEQ ID NO: 14998 - protein, 17 aa, Artificial Sequence
  Description of Artificial Sequence: Synthetic peptide
TISGSGVRTYYADSVKG

SEQ ID NO: 14999 - DNA, 51 bp, Artificial Sequence
  Description of Artificial Sequence: Synthetic oligonucleotide
gctatatggtatgatggaagtaataaatacaatgcagactccgtgaagggc

SEQ ID NO: 15000 - protein, 17 aa, Artificial Sequence
  Description of Artificial Sequence: Synthetic peptide
AIWYDGSNKYNADSVKG

SEQ ID NO: 15001 - DNA, 48 bp, Artificial Sequence
  Description of Artificial Sequence: Synthetic oligonucleotide
gaaatcagtcatagtggacgcaccaactacaacccgtccctcaagagc

SEQ ID NO: 15002 - protein, 16 aa, Artificial Sequence
  Description of Artificial Sequence: Synthetic peptide
EISHSGRTNYNPSLKS

SEQ ID NO: 15003 - DNA, 48 bp, Artificial Sequence; identical to SEQ ID NO: 13715
  Description of Artificial Sequence: Synthetic oligonucleotide

SEQ ID NO: 15004 - protein, 16 aa, Artificial Sequence
  Description of Artificial Sequence: Synthetic peptide
EINHSGSTNYNPSLKS

SEQ ID NO: 15005 - DNA, 51 bp, Artificial Sequence; identical to SEQ ID NO: 12207
  Description of Artificial Sequence: Synthetic oligonucleotide

SEQ ID NO: 15006 - protein, 17 aa, Artificial Sequence
  Description of Artificial Sequence: Synthetic peptide
WINPNSGGTNYAQKFQG

SEQ ID NO: 15007 - DNA, 51 bp, Artificial Sequence
  Description of Artificial Sequence: Synthetic oligonucleotide
tggatcgaccctaatagtggtggcacaaactatgcacagaagtttcagggc

SEQ ID NO: 15008 - protein, 17 aa, Artificial Sequence
  Description of Artificial Sequence: Synthetic peptide
WIDPNSGGTNYAQKFQG

SEQ ID NO: 15009 - DNA, 51 bp, Artificial Sequence; identical to SEQ ID NO: 12207
  Description of Artificial Sequence: Synthetic oligonucleotide

SEQ ID NO: 15010 - protein, 17 aa, Artificial Sequence
  Description of Artificial Sequence: Synthetic peptide
WINPNSGGTNYAQKFQG

SEQ ID NO: 15011 - DNA, 51 bp, Artificial Sequence
  Description of Artificial Sequence: Synthetic oligonucleotide
gttatatggtatgatggaagtaataaaaactatgcagagtccgtgaagggc

SEQ ID NO: 15012 - protein, 17 aa, Artificial Sequence
  Description of Artificial Sequence: Synthetic peptide
VIWYDGSNKNYAESVKG

SEQ ID NO: 15013 - DNA, 51 bp, Artificial Sequence
  Description of Artificial Sequence: Synthetic oligonucleotide
gttatatggtatgatagaaataataaatactatggtgactccgtgaagggc

SEQ ID NO: 15014 - protein, 17 aa, Artificial Sequence
  Description of Artificial Sequence: Synthetic peptide
VIWYDRNNKYYGDSVKG

SEQ ID NO: 15015 - DNA, 51 bp, Artificial Sequence; identical to SEQ ID NO: 12133
  Description of Artificial Sequence: Synthetic oligonucleotide

SEQ ID NO: 15016 - protein, 17 aa, Artificial Sequence
  Description of Artificial Sequence: Synthetic peptide
VIWYDGSNKYYVDSVKG

SEQ ID NO: 15017 - DNA, 51 bp, Artificial Sequence; identical to SEQ ID NO: 14947
  Description of Artificial Sequence: Synthetic oligonucleotide

SEQ ID NO: 15018 - protein, 17 aa, Artificial Sequence
  Description of Artificial Sequence: Synthetic peptide
TISGSGVRTYYADSVKG

SEQ ID NO: 15019 - DNA, 48 bp, Artificial Sequence; identical to SEQ ID NO: 13715
  Description of Artificial Sequence: Synthetic oligonucleotide

SEQ ID NO: 15020 - protein, 16 aa, Artificial Sequence
  Description of Artificial Sequence: Synthetic peptide
EINHSGSTNYNPSLKS

SEQ ID NO: 15021 - DNA, 51 bp, Artificial Sequence; identical to SEQ ID NO: 12207
  Description of Artificial Sequence: Synthetic oligonucleotide

SEQ ID NO: 15022 - protein, 17 aa, Artificial Sequence
  Description of Artificial Sequence: Synthetic peptide
WINPNSGGTNYAQKFQG

SEQ ID NO: 15023 - DNA, 48 bp, Artificial Sequence
  Description of Artificial Sequence: Synthetic oligonucleotide
gaaatcaatcatagtggacgcgccaactacaacccgtccctcaagagt

SEQ ID NO: 15024 - protein, 16 aa, Artificial Sequence
  Description of Artificial Sequence: Synthetic peptide
EINHSGRANYNPSLKS

SEQ ID NO: 15025 - DNA, 51 bp, Artificial Sequence; identical to SEQ ID NO: 12207
  Description of Artificial Sequence: Synthetic oligonucleotide

SEQ ID NO: 15026 - protein, 17 aa, Artificial Sequence
  Description of Artificial Sequence: Synthetic peptide
WINPNSGGTNYAQKFQG

SEQ ID NO: 15027 - DNA, 51 bp, Artificial Sequence; identical to SEQ ID NO: 12391
  Description of Artificial Sequence: Synthetic oligonucleotide

SEQ ID NO: 15028 - protein, 17 aa, Artificial Sequence
  Description of Artificial Sequence: Synthetic peptide
VIWYDENNKYYVDSVKG

SEQ ID NO: 15029 - DNA, 51 bp, Artificial Sequence; identical to SEQ ID NO: 12133
  Description of Artificial Sequence: Synthetic oligonucleotide

SEQ ID NO: 15030 - protein, 17 aa, Artificial Sequence
  Description of Artificial Sequence: Synthetic peptide
VIWYDGSNKYYVDSVKG

SEQ ID NO: 15031 - DNA, 48 bp, Artificial Sequence; identical to SEQ ID NO: 12113
  Description of Artificial Sequence: Synthetic oligonucleotide

SEQ ID NO: 15032 - protein, 16 aa, Artificial Sequence
  Description of Artificial Sequence: Synthetic peptide
RIYTSGSTDYNPSLKS

SEQ ID NO: 15033 - DNA, 54 bp, Artificial Sequence
  Description of Artificial Sequence: Synthetic oligonucleotide
aggacatactacaggtccaagtggtataattattatccagtatctgtgagaagt

SEQ ID NO: 15034 - protein, 18 aa, Artificial Sequence
  Description of Artificial Sequence: Synthetic peptide
RTYYRSKWYNYYPVSVRS

SEQ ID NO: 15035 - DNA, 51 bp, Artificial Sequence; identical to SEQ ID NO: 12207
  Description of Artificial Sequence: Synthetic oligonucleotide

SEQ ID NO: 15036 - protein, 17 aa, Artificial Sequence
  Description of Artificial Sequence: Synthetic peptide
WINPNSGGTNYAQKFQG

SEQ ID NO: 15037 - DNA, 51 bp, Artificial Sequence
  Description of Artificial Sequence: Synthetic oligonucleotide
gttacatggtatgatggaagtgataaatactatgcagactccgtgaagggc

SEQ ID NO: 15038 - protein, 17 aa, Artificial Sequence
  Description of Artificial Sequence: Synthetic peptide
VTWYDGSDKYYADSVKG

SEQ ID NO: 15039 - DNA, 51 bp, Artificial Sequence
  Description of Artificial Sequence: Synthetic oligonucleotide
tggatcaacgcttacaatggtcacacaaactatgcacagaagttccagggc

SEQ ID NO: 15040 - protein, 17 aa, Artificial Sequence
  Description of Artificial Sequence: Synthetic peptide
WINAYNGHTNYAQKFQG

SEQ ID NO: 15041 - DNA, 51 bp, Artificial Sequence
  Description of Artificial Sequence: Synthetic oligonucleotide
gttctttggtttgatggaagtaatagaaactatgcagactccgtgaagggc

SEQ ID NO: 15042 - protein, 17 aa, Artificial Sequence
  Description of Artificial Sequence: Synthetic peptide
VLWFDGSNRNYADSVKG

SEQ ID NO: 15043 - DNA, 51 bp, Artificial Sequence
  Description of Artificial Sequence: Synthetic oligonucleotide
gttatatggtatgatggaagtaataaaaactatgaagactccgtgaagggc

SEQ ID NO: 15044 - protein, 17 aa, Artificial Sequence
  Description of Artificial Sequence: Synthetic peptide
VIWYDGSNKNYEDSVKG

SEQ ID NO: 15045 - DNA, 51 bp, Artificial Sequence; identical to SEQ ID NO: 12263
  Description of Artificial Sequence: Synthetic oligonucleotide

SEQ ID NO: 15046 - protein, 17 aa, Artificial Sequence
  Description of Artificial Sequence: Synthetic peptide
VIWHDGSNKYYADSVKG

SEQ ID NO: 15047 - DNA, 51 bp, Artificial Sequence; identical to SEQ ID NO: 13745
  Description of Artificial Sequence: Synthetic oligonucleotide

SEQ ID NO: 15048 - protein, 17 aa, Artificial Sequence
  Description of Artificial Sequence: Synthetic peptide
VIWYDGSNKNYADSVKG

SEQ ID NO: 15049 - DNA, 51 bp, Artificial Sequence; identical to SEQ ID NO: 14605
  Description of Artificial Sequence: Synthetic oligonucleotide

SEQ ID NO: 15050 - protein, 17 aa, Artificial Sequence
  Description of Artificial Sequence: Synthetic peptide
VIWYDGSNEHYADSVKG

SEQ ID NO: 15051 - DNA, 51 bp, Artificial Sequence
  Description of Artificial Sequence: Synthetic oligonucleotide
tggatcagcgcttacaatggtctcacaaactatgcacagaagttccagggc

SEQ ID NO: 15052 - protein, 17 aa, Artificial Sequence
  Description of Artificial Sequence: Synthetic peptide
WISAYNGLTNYAQKFQG

SEQ ID NO: 15053 - DNA, 51 bp, Artificial Sequence
  Description of Artificial Sequence: Synthetic oligonucleotide
gttatatggtatgatggaagtaataaaaactatgtagactccgtgaagggc

SEQ ID NO: 15054 - protein, 17 aa, Artificial Sequence
  Description of Artificial Sequence: Synthetic peptide
VIWYDGSNKNYVDSVKG

SEQ ID NO: 15055 - DNA, 51 bp, Artificial Sequence
  Description of Artificial Sequence: Synthetic oligonucleotide
gttatatggtatgatggaagtaataaaaattatgcagactccgtgaagggc

SEQ ID NO: 15056 - protein, 17 aa, Artificial Sequence
  Description of Artificial Sequence: Synthetic peptide
VIWYDGSNKNYADSVKG

SEQ ID NO: 15057 - DNA, 51 bp, Artificial Sequence; identical to SEQ ID NO: 14605
  Description of Artificial Sequence: Synthetic oligonucleotide

SEQ ID NO: 15058 - protein, 17 aa, Artificial Sequence
  Description of Artificial Sequence: Synthetic peptide
VIWYDGSNEHYADSVKG

SEQ ID NO: 15059 - DNA, 51 bp, Artificial Sequence
  Description of Artificial Sequence: Synthetic oligonucleotide
gctatatggtatgatggaagtcataaatactatacagattccgtgaagggc

SEQ ID NO: 15060 - protein, 17 aa, Artificial Sequence
  Description of Artificial Sequence: Synthetic peptide
AIWYDGSHKYYTDSVKG

SEQ ID NO: 15061 - DNA, 51 bp, Artificial Sequence; identical to SEQ ID NO: 14893
  Description of Artificial Sequence: Synthetic oligonucleotide

SEQ ID NO: 15062 - protein, 17 aa, Artificial Sequence
  Description of Artificial Sequence: Synthetic peptide
VIWYDGSNKHYADSVKG

SEQ ID NO: 15063 - DNA, 51 bp, Artificial Sequence; identical to SEQ ID NO: 12575
  Description of Artificial Sequence: Synthetic oligonucleotide

SEQ ID NO: 15064 - protein, 17 aa, Artificial Sequence
  Description of Artificial Sequence: Synthetic peptide
VIWYDGSNKYYADSVKG

SEQ ID NO: 15065 - DNA, 51 bp, Artificial Sequence; identical to SEQ ID NO: 15043
  Description of Artificial Sequence: Synthetic oligonucleotide

SEQ ID NO: 15066 - protein, 17 aa, Artificial Sequence
  Description of Artificial Sequence: Synthetic peptide
VIWYDGSNKNYEDSVKG

SEQ ID NO: 15067 - DNA, 51 bp, Artificial Sequence; identical to SEQ ID NO: 15055
  Description of Artificial Sequence: Synthetic oligonucleotide

SEQ ID NO: 15068 - protein, 17 aa, Artificial Sequence
  Description of Artificial Sequence: Synthetic peptide
VIWYDGSNKNYADSVKG

SEQ ID NO: 15069 - DNA, 51 bp, Artificial Sequence; identical to SEQ ID NO: 13745
  Description of Artificial Sequence: Synthetic oligonucleotide

SEQ ID NO: 15070 - protein, 17 aa, Artificial Sequence
  Description of Artificial Sequence: Synthetic peptide
VIWYDGSNKNYADSVKG

SEQ ID NO: 15071 - DNA, 51 bp, Artificial Sequence; identical to SEQ ID NO: 14893
  Description of Artificial Sequence: Synthetic oligonucleotide

SEQ ID NO: 15072 - protein, 17 aa, Artificial Sequence
  Description of Artificial Sequence: Synthetic peptide
VIWYDGSNKHYADSVKG

SEQ ID NO: 15073 - DNA, 51 bp, Artificial Sequence; identical to SEQ ID NO: 15043
  Description of Artificial Sequence: Synthetic oligonucleotide

SEQ ID NO: 15074 - protein, 17 aa, Artificial Sequence
  Description of Artificial Sequence: Synthetic peptide
VIWYDGSNKNYEDSVKG

SEQ ID NO: 15075 - DNA, 51 bp, Artificial Sequence; identical to SEQ ID NO: 14893
  Description of Artificial Sequence: Synthetic oligonucleotide

SEQ ID NO: 15076 - protein, 17 aa, Artificial Sequence
  Description of Artificial Sequence: Synthetic peptide
VIWYDGSNKHYADSVKG

SEQ ID NO: 15077 - DNA, 51 bp, Artificial Sequence
  Description of Artificial Sequence: Synthetic oligonucleotide
tggatcaatcctaagagtgatggcacaaactatgcacagaagtttcagggc

SEQ ID NO: 15078 - protein, 17 aa, Artificial Sequence
  Description of Artificial Sequence: Synthetic peptide
WINPKSDGTNYAQKFQG

SEQ ID NO: 15079 - DNA, 51 bp, Artificial Sequence
  Description of Artificial Sequence: Synthetic oligonucleotide
tggatcagcgttcacaatggtaacacagactatgcacagaagttccagggc

SEQ ID NO: 15080 - protein, 17 aa, Artificial Sequence
  Description of Artificial Sequence: Synthetic peptide
WISVHNGNTDYAQKFQG

SEQ ID NO: 15081 - DNA, 51 bp, Artificial Sequence
  Description of Artificial Sequence: Synthetic oligonucleotide
gttatatggtatgatggaagtaataaaaactatggagactccgtgaagggc

SEQ ID NO: 15082 - protein, 17 aa, Artificial Sequence
  Description of Artificial Sequence: Synthetic peptide
VIWYDGSNKNYGDSVKG

SEQ ID NO: 15083 - DNA, 51 bp, Artificial Sequence
  Description of Artificial Sequence: Synthetic oligonucleotide
gttatatggtatgatggaagtaatgaaaactatgcagactccgtgaagggc

SEQ ID NO: 15084 - protein, 17 aa, Artificial Sequence
  Description of Artificial Sequence: Synthetic peptide
VIWYDGSNENYADSVKG

SEQ ID NO: 15085 - DNA, 51 bp, Artificial Sequence
  Description of Artificial Sequence: Synthetic oligonucleotide
tggatcaactctaacagtggtggcacaaactatgcacagaagtttcagggc

SEQ ID NO: 15086 - protein, 17 aa, Artificial Sequence
  Description of Artificial Sequence: Synthetic peptide
WINSNSGGTNYAQKFQG

SEQ ID NO: 15087 - DNA, 51 bp, Artificial Sequence; identical to SEQ ID NO: 12123
  Description of Artificial Sequence: Synthetic oligonucleotide

SEQ ID NO: 15088 - protein, 17 aa, Artificial Sequence
  Description of Artificial Sequence: Synthetic peptide
VIWYDGSNKYYADSVKG

SEQ ID NO: 15089 - DNA, 51 bp, Artificial Sequence; identical to SEQ ID NO: 12123
  Description of Artificial Sequence: Synthetic oligonucleotide

SEQ ID NO: 15090 - protein, 17 aa, Artificial Sequence
  Description of Artificial Sequence: Synthetic peptide
VIWYDGSNKYYADSVKG

SEQ ID NO: 15091 - DNA, 51 bp, Artificial Sequence; identical to SEQ ID NO: 12575
  Description of Artificial Sequence: Synthetic oligonucleotide

SEQ ID NO: 15092 - protein, 17 aa, Artificial Sequence
  Description of Artificial Sequence: Synthetic peptide
VIWYDGSNKYYADSVKG

SEQ ID NO: 15093 - DNA, 51 bp, Artificial Sequence; identical to SEQ ID NO: 12575
  Description of Artificial Sequence: Synthetic oligonucleotide

SEQ ID NO: 15094 - protein, 17 aa, Artificial Sequence
  Description of Artificial Sequence: Synthetic peptide
VIWYDGSNKYYADSVKG

SEQ ID NO: 15095 - DNA, 51 bp, Artificial Sequence; identical to SEQ ID NO: 12575
  Description of Artificial Sequence: Synthetic oligonucleotide

SEQ ID NO: 15096 - protein, 17 aa, Artificial Sequence
  Description of Artificial Sequence: Synthetic peptide
VIWYDGSNKYYADSVKG

SEQ ID NO: 15097 - DNA, 51 bp, Artificial Sequence; identical to SEQ ID NO: 15055
  Description of Artificial Sequence: Synthetic oligonucleotide

SEQ ID NO: 15098 - protein, 17 aa, Artificial Sequence
  Description of Artificial Sequence: Synthetic peptide
VIWYDGSNKNYADSVKG

SEQ ID NO: 15099 - DNA, 51 bp, Artificial Sequence
  Description of Artificial Sequence: Synthetic oligonucleotide
gttatatggtatgatggaagtaataaaaactatgcagattccgtgaagggc

SEQ ID NO: 15100 - protein, 17 aa, Artificial Sequence
  Description of Artificial Sequence: Synthetic peptide
VIWYDGSNKNYADSVKG

SEQ ID NO: 15101 - DNA, 51 bp, Artificial Sequence
  Description of Artificial Sequence: Synthetic oligonucleotide
tggatcaactctaacagtggtggcacaaattatgcagagaagtttcagggc

SEQ ID NO: 15102 - protein, 17 aa, Artificial Sequence
  Description of Artificial Sequence: Synthetic peptide
WINSNSGGTNYAEKFQG

SEQ ID NO: 15103 - DNA, 51 bp, Artificial Sequence; identical to SEQ ID NO: 12263
  Description of Artificial Sequence: Synthetic oligonucleotide

SEQ ID NO: 15104 - protein, 17 aa, Artificial Sequence
  Description of Artificial Sequence: Synthetic peptide
VIWHDGSNKYYADSVKG

SEQ ID NO: 15105 - DNA, 51 bp, Artificial Sequence; identical to SEQ ID NO: 12575
  Description of Artificial Sequence: Synthetic oligonucleotide

SEQ ID NO: 15106 - protein, 17 aa, Artificial Sequence
  Description of Artificial Sequence: Synthetic peptide
VIWYDGSNKYYADSVKG

SEQ ID NO: 15107 - DNA, 51 bp, Artificial Sequence; identical to SEQ ID NO: 14605
  Description of Artificial Sequence: Synthetic oligonucleotide

SEQ ID NO: 15108 - protein, 17 aa, Artificial Sequence
  Description of Artificial Sequence: Synthetic peptide
VIWYDGSNEHYADSVKG

SEQ ID NO: 15109 - DNA, 51 bp, Artificial Sequence; identical to SEQ ID NO: 12263
  Description of Artificial Sequence: Synthetic oligonucleotide

SEQ ID NO: 15110 - protein, 17 aa, Artificial Sequence
  Description of Artificial Sequence: Synthetic peptide
VIWHDGSNKYYADSVKG

SEQ ID NO: 15111 - DNA, 51 bp, Artificial Sequence; identical to SEQ ID NO: 12151
  Description of Artificial Sequence: Synthetic oligonucleotide

SEQ ID NO: 15112 - protein, 17 aa, Artificial Sequence
  Description of Artificial Sequence: Synthetic peptide
AIWYDGSNKYYADSVKG

SEQ ID NO: 15113 - DNA, 51 bp, Artificial Sequence
  Description of Artificial Sequence: Synthetic oligonucleotide
tacattactggtagtagtagtaccatatactacgcagactctgtgaagggc

SEQ ID NO: 15114 - protein, 17 aa, Artificial Sequence
  Description of Artificial Sequence: Synthetic peptide
YITGSSSTIYYADSVKG

SEQ ID NO: 15115 - DNA, 51 bp, Artificial Sequence; identical to SEQ ID NO: 12575
  Description of Artificial Sequence: Synthetic oligonucleotide

SEQ ID NO: 15116 - protein, 17 aa, Artificial Sequence
  Description of Artificial Sequence: Synthetic peptide
VIWYDGSNKYYADSVKG

SEQ ID NO: 15117 - DNA, 51 bp, Artificial Sequence; identical to SEQ ID NO: 12575
  Description of Artificial Sequence: Synthetic oligonucleotide

SEQ ID NO: 15118 - protein, 17 aa, Artificial Sequence
  Description of Artificial Sequence: Synthetic peptide
VIWYDGSNKYYADSVKG

SEQ ID NO: 15119 - DNA, 51 bp, Artificial Sequence
  Description of Artificial Sequence: Synthetic oligonucleotide
tacattagtagtagtcgtaatatcatatattacgcagactctgtgaagggc

SEQ ID NO: 15120 - protein, 17 aa, Artificial Sequence
  Description of Artificial Sequence: Synthetic peptide
YISSSRNIIYYADSVKG

SEQ ID NO: 15121 - DNA, 51 bp, Artificial Sequence; identical to SEQ ID NO: 12575
  Description of Artificial Sequence: Synthetic oligonucleotide

SEQ ID NO: 15122 - protein, 17 aa, Artificial Sequence
  Description of Artificial Sequence: Synthetic peptide
VIWYDGSNKYYADSVKG

SEQ ID NO: 15123 - DNA, 51 bp, Artificial Sequence; identical to SEQ ID NO: 13745
  Description of Artificial Sequence: Synthetic oligonucleotide

SEQ ID NO: 15124 - protein, 17 aa, Artificial Sequence
  Description of Artificial Sequence: Synthetic peptide
VIWYDGSNKNYADSVKG

SEQ ID NO: 15125 - DNA, 51 bp, Artificial Sequence; identical to SEQ ID NO: 15043
  Description of Artificial Sequence: Synthetic oligonucleotide

SEQ ID NO: 15126 - protein, 17 aa, Artificial Sequence
  Description of Artificial Sequence: Synthetic peptide
VIWYDGSNKNYEDSVKG

SEQ ID NO: 15127 - DNA, 51 bp, Artificial Sequence; identical to SEQ ID NO: 12575
  Description of Artificial Sequence: Synthetic oligonucleotide

SEQ ID NO: 15128 - protein, 17 aa, Artificial Sequence
  Description of Artificial Sequence: Synthetic peptide
VIWYDGSNKYYADSVKG

SEQ ID NO: 15129 - DNA, 51 bp, Artificial Sequence; identical to SEQ ID NO: 12575
  Description of Artificial Sequence: Synthetic oligonucleotide

SEQ ID NO: 15130 - protein, 17 aa, Artificial Sequence
  Description of Artificial Sequence: Synthetic peptide
VIWYDGSNKYYADSVKG

SEQ ID NO: 15131 - DNA, 51 bp, Artificial Sequence; identical to SEQ ID NO: 12575
  Description of Artificial Sequence: Synthetic oligonucleotide

SEQ ID NO: 15132 - protein, 17 aa, Artificial Sequence
  Description of Artificial Sequence: Synthetic peptide
VIWYDGSNKYYADSVKG

SEQ ID NO: 15133 - DNA, 51 bp, Artificial Sequence; identical to SEQ ID NO: 14893
  Description of Artificial Sequence: Synthetic oligonucleotide

SEQ ID NO: 15134 - protein, 17 aa, Artificial Sequence
  Description of Artificial Sequence: Synthetic peptide
VIWYDGSNKHYADSVKG

SEQ ID NO: 15135 - DNA, 48 bp, Artificial Sequence
  Description of Artificial Sequence: Synthetic oligonucleotide
tatatctattacagtgggaccaccaactacaacccctccctcaagagt

SEQ ID NO: 15136 - protein, 16 aa, Artificial Sequence
  Description of Artificial Sequence: Synthetic peptide
YIYYSGTTNYNPSLKS

SEQ ID NO: 15137 - DNA, 51 bp, Artificial Sequence; identical to SEQ ID NO: 12575
  Description of Artificial Sequence: Synthetic oligonucleotide

SEQ ID NO: 15138 - protein, 17 aa, Artificial Sequence
  Description of Artificial Sequence: Synthetic peptide
VIWYDGSNKYYADSVKG

SEQ ID NO: 15139 - DNA, 51 bp, Artificial Sequence
  Description of Artificial Sequence: Synthetic oligonucleotide
tggatccaccctaacagtggtggcacaaactatgcacagaaatttcagggc

SEQ ID NO: 15140 - protein, 17 aa, Artificial Sequence
  Description of Artificial Sequence: Synthetic peptide
WIHPNSGGTNYAQKFQG

SEQ ID NO: 15141 - DNA, 51 bp, Artificial Sequence
  Description of Artificial Sequence: Synthetic oligonucleotide
gttatatggtacgatggaagtaatgaaaactatgcagactccgtgaagggc

SEQ ID NO: 15142 - protein, 17 aa, Artificial Sequence
  Description of Artificial Sequence: Synthetic peptide
VIWYDGSNENYADSVKG

SEQ ID NO: 15143 - DNA, 51 bp, Artificial Sequence; identical to SEQ ID NO: 15139
  Description of Artificial Sequence: Synthetic oligonucleotide

SEQ ID NO: 15144 - protein, 17 aa, Artificial Sequence
  Description of Artificial Sequence: Synthetic peptide
WIHPNSGGTNYAQKFQG

SEQ ID NO: 15145 - DNA, 51 bp, Artificial Sequence
  Description of Artificial Sequence: Synthetic oligonucleotide
tggatcagcgtttacaatggtaacacaaactatgcacagaagctccagggc

SEQ ID NO: 15146 - protein, 17 aa, Artificial Sequence
  Description of Artificial Sequence: Synthetic peptide
WISVYNGNTNYAQKLQG

SEQ ID NO: 15147 - DNA, 51 bp, Artificial Sequence; identical to SEQ ID NO: 13745
  Description of Artificial Sequence: Synthetic oligonucleotide

SEQ ID NO: 15148 - protein, 17 aa, Artificial Sequence
  Description of Artificial Sequence: Synthetic peptide
VIWYDGSNKNYADSVKG

SEQ ID NO: 15149 - DNA, 51 bp, Artificial Sequence
  Description of Artificial Sequence: Synthetic oligonucleotide
agtattgttggtagtggtggtcgcacgtactacgcagactccgtgaagggc

SEQ ID NO: 15150 - protein, 17 aa, Artificial Sequence
  Description of Artificial Sequence: Synthetic peptide
SIVGSGGRTYYADSVKG

SEQ ID NO: 15151 - DNA, 48 bp, Artificial Sequence
  Description of Artificial Sequence: Synthetic oligonucleotide
gaaatcaatcatagtggaagcgccaactacaacccgtccctcaagagt

SEQ ID NO: 15152 - protein, 16 aa, Artificial Sequence
  Description of Artificial Sequence: Synthetic peptide
EINHSGSANYNPSLKS

SEQ ID NO: 15153 - DNA, 51 bp, Artificial Sequence; identical to SEQ ID NO: 15139
  Description of Artificial Sequence: Synthetic oligonucleotide

SEQ ID NO: 15154 - protein, 17 aa, Artificial Sequence
  Description of Artificial Sequence: Synthetic peptide
WIHPNSGGTNYAQKFQG

SEQ ID NO: 15155 - DNA, 51 bp, Artificial Sequence; identical to SEQ ID NO: 15149
  Description of Artificial Sequence: Synthetic oligonucleotide

SEQ ID NO: 15156 - protein, 17 aa, Artificial Sequence
  Description of Artificial Sequence: Synthetic peptide
SIVGSGGRTYYADSVKG

SEQ ID NO: 15157 - DNA, 51 bp, Artificial Sequence; identical to SEQ ID NO: 13745
  Description of Artificial Sequence: Synthetic oligonucleotide

SEQ ID NO: 15158 - protein, 17 aa, Artificial Sequence
  Description of Artificial Sequence: Synthetic peptide
VIWYDGSNKNYADSVKG

SEQ ID NO: 15159 - DNA, 51 bp, Artificial Sequence; identical to SEQ ID NO: 15139
  Description of Artificial Sequence: Synthetic oligonucleotide

SEQ ID NO: 15160 - protein, 17 aa, Artificial Sequence
  Description of Artificial Sequence: Synthetic peptide
WIHPNSGGTNYAQKFQG

SEQ ID NO: 15161 - DNA, 51 bp, Artificial Sequence
  Description of Artificial Sequence: Synthetic oligonucleotide
tggatcagcgtttacagtggtaacacaaactatgcacagaagctccagggc

SEQ ID NO: 15162 - protein, 17 aa, Artificial Sequence
  Description of Artificial Sequence: Synthetic peptide
WISVYSGNTNYAQKLQG

SEQ ID NO: 15163 - DNA, 51 bp, Artificial Sequence; identical to SEQ ID NO: 13745
  Description of Artificial Sequence: Synthetic oligonucleotide

SEQ ID NO: 15164 - protein, 17 aa, Artificial Sequence
  Description of Artificial Sequence: Synthetic peptide
VIWYDGSNKNYADSVKG

SEQ ID NO: 15165 - DNA, 51 bp, Artificial Sequence
  Description of Artificial Sequence: Synthetic oligonucleotide
gctattagtggcagaggcggcagcacatactacgcagacgccgtgaagggc

SEQ ID NO: 15166 - protein, 17 aa, Artificial Sequence
  Description of Artificial Sequence: Synthetic peptide
AISGRGGSTYYADAVKG

SEQ ID NO: 15167 - DNA, 51 bp, Artificial Sequence
  Description of Artificial Sequence: Synthetic oligonucleotide
gctattagtggtagtggtggtaacacatactacgcagactccgtgaagggc

SEQ ID NO: 15168 - protein, 17 aa, Artificial Sequence
  Description of Artificial Sequence: Synthetic peptide
AISGSGGNTYYADSVKG

SEQ ID NO: 15169 - DNA, 51 bp, Artificial Sequence; identical to SEQ ID NO: 12123
  Description of Artificial Sequence: Synthetic oligonucleotide

SEQ ID NO: 15170 - protein, 17 aa, Artificial Sequence
  Description of Artificial Sequence: Synthetic peptide
VIWYDGSNKYYADSVKG

SEQ ID NO: 15171 - DNA, 51 bp, Artificial Sequence
  Description of Artificial Sequence: Synthetic oligonucleotide
tggatcaacccttacagtggtgacacaaactatgcacagaagtttcagggc

SEQ ID NO: 15172 - protein, 17 aa, Artificial Sequence
  Description of Artificial Sequence: Synthetic peptide
WINPYSGDTNYAQKFQG

SEQ ID NO: 15173 - DNA, 48 bp, Artificial Sequence; identical to SEQ ID NO: 12481
  Description of Artificial Sequence: Synthetic oligonucleotide

SEQ ID NO: 15174 - protein, 16 aa, Artificial Sequence
  Description of Artificial Sequence: Synthetic peptide
NIYYSGSTYYNPSLKS

SEQ ID NO: 15175 - DNA, 51 bp, Artificial Sequence; identical to SEQ ID NO: 12123
  Description of Artificial Sequence: Synthetic oligonucleotide

SEQ ID NO: 15176 - protein, 17 aa, Artificial Sequence
  Description of Artificial Sequence: Synthetic peptide
VIWYDGSNKYYADSVKG

SEQ ID NO: 15177 - DNA, 51 bp, Artificial Sequence; identical to SEQ ID NO: 12103
  Description of Artificial Sequence: Synthetic oligonucleotide

SEQ ID NO: 15178 - protein, 17 aa, Artificial Sequence
  Description of Artificial Sequence: Synthetic peptide
WMNPNSGNTGYAQKFQG

SEQ ID NO: 15179 - DNA, 51 bp, Artificial Sequence
  Description of Artificial Sequence: Synthetic oligonucleotide
gctattagtggtagtggtgataacacattctacgcagactccgtgaagggc

SEQ ID NO: 15180 - protein, 17 aa, Artificial Sequence
  Description of Artificial Sequence: Synthetic peptide
AISGSGDNTFYADSVKG

SEQ ID NO: 15181 - DNA, 51 bp, Artificial Sequence; identical to SEQ ID NO: 15171
  Description of Artificial Sequence: Synthetic oligonucleotide

SEQ ID NO: 15182 - protein, 17 aa, Artificial Sequence
  Description of Artificial Sequence: Synthetic peptide
WINPYSGDTNYAQKFQG

SEQ ID NO: 15183 - DNA, 51 bp, Artificial Sequence
  Description of Artificial Sequence: Synthetic oligonucleotide
tggttgtaccctaacagtggtaacacaggctatgcacagaagttccagggc

SEQ ID NO: 15184 - protein, 17 aa, Artificial Sequence
  Description of Artificial Sequence: Synthetic peptide
WLYPNSGNTGYAQKFQG

SEQ ID NO: 15185 - DNA, 51 bp, Artificial Sequence; identical to SEQ ID NO: 12161
  Description of Artificial Sequence: Synthetic oligonucleotide

SEQ ID NO: 15186 - protein, 17 aa, Artificial Sequence
  Description of Artificial Sequence: Synthetic peptide
WMHPNSGNTGYAQKFQG

SEQ ID NO: 15187 - DNA, 51 bp, Artificial Sequence; identical to SEQ ID NO: 12477
  Description of Artificial Sequence: Synthetic oligonucleotide

SEQ ID NO: 15188 - protein, 17 aa, Artificial Sequence
  Description of Artificial Sequence: Synthetic peptide
VIWYEGSNKYYVDSVRG

SEQ ID NO: 15189 - DNA, 51 bp, Artificial Sequence; identical to SEQ ID NO: 15171
  Description of Artificial Sequence: Synthetic oligonucleotide

SEQ ID NO: 15190 - protein, 17 aa, Artificial Sequence
  Description of Artificial Sequence: Synthetic peptide
WINPYSGDTNYAQKFQG

SEQ ID NO: 15191 - DNA, 51 bp, Artificial Sequence; identical to SEQ ID NO: 12103
  Description of Artificial Sequence: Synthetic oligonucleotide

SEQ ID NO: 15192 - protein, 17 aa, Artificial Sequence
  Description of Artificial Sequence: Synthetic peptide
WMNPNSGNTGYAQKFQG

SEQ ID NO: 15193 - DNA, 51 bp, Artificial Sequence; identical to SEQ ID NO: 15171
  Description of Artificial Sequence: Synthetic oligonucleotide

SEQ ID NO: 15194 - protein, 17 aa, Artificial Sequence
  Description of Artificial Sequence: Synthetic peptide
WINPYSGDTNYAQKFQG

SEQ ID NO: 15195 - DNA, 51 bp, Artificial Sequence; identical to SEQ ID NO: 12123
  Description of Artificial Sequence: Synthetic oligonucleotide

SEQ ID NO: 15196 - protein, 17 aa, Artificial Sequence
  Description of Artificial Sequence: Synthetic peptide
VIWYDGSNKYYADSVKG

SEQ ID NO: 15197 - DNA, 51 bp, Artificial Sequence
  Description of Artificial Sequence: Synthetic oligonucleotide
ataatcaaccctagtggtggtagcacaagctacgcacagaagttccagggc

SEQ ID NO: 15198 - protein, 17 aa, Artificial Sequence
  Description of Artificial Sequence: Synthetic peptide
IINPSGGSTSYAQKFQG

SEQ ID NO: 15199 - DNA, 51 bp, Artificial Sequence; identical to SEQ ID NO: 13491
  Description of Artificial Sequence: Synthetic oligonucleotide

SEQ ID NO: 15200 - protein, 17 aa, Artificial Sequence
  Description of Artificial Sequence: Synthetic peptide
WMHPNSGSTGYAQKFQG

SEQ ID NO: 15201 - DNA, 51 bp, Artificial Sequence; identical to SEQ ID NO: 15171
  Description of Artificial Sequence: Synthetic oligonucleotide

SEQ ID NO: 15202 - protein, 17 aa, Artificial Sequence
  Description of Artificial Sequence: Synthetic peptide
WINPYSGDTNYAQKFQG

SEQ ID NO: 15203 - DNA, 51 bp, Artificial Sequence
  Description of Artificial Sequence: Synthetic oligonucleotide
tggatgcatcctaacagtggtaacacaggctttgcacagaagttccagggc

SEQ ID NO: 15204 - protein, 17 aa, Artificial Sequence
  Description of Artificial Sequence: Synthetic peptide
WMHPNSGNTGFAQKFQG

SEQ ID NO: 15205 - DNA, 51 bp, Artificial Sequence; identical to SEQ ID NO: 12491
  Description of Artificial Sequence: Synthetic oligonucleotide

SEQ ID NO: 15206 - protein, 17 aa, Artificial Sequence
  Description of Artificial Sequence: Synthetic peptide
VIWYDENNKYYADSVKG

SEQ ID NO: 15207 - DNA, 51 bp, Artificial Sequence; identical to SEQ ID NO: 12491
  Description of Artificial Sequence: Synthetic oligonucleotide

SEQ ID NO: 15208 - protein, 17 aa, Artificial Sequence
  Description of Artificial Sequence: Synthetic peptide
VIWYDENNKYYADSVKG

SEQ ID NO: 15209 - DNA, 48 bp, Artificial Sequence; identical to SEQ ID NO: 14133
  Description of Artificial Sequence: Synthetic oligonucleotide

SEQ ID NO: 15210 - protein, 16 aa, Artificial Sequence
  Description of Artificial Sequence: Synthetic peptide
FIYYTGSTYYNPSLKS

SEQ ID NO: 15211 - DNA, 51 bp, Artificial Sequence; identical to SEQ ID NO: 12391
  Description of Artificial Sequence: Synthetic oligonucleotide

SEQ ID NO: 15212 - protein, 17 aa, Artificial Sequence
  Description of Artificial Sequence: Synthetic peptide
VIWYDENNKYYVDSVKG

SEQ ID NO: 15213 - DNA, 51 bp, Artificial Sequence; identical to SEQ ID NO: 12159
  Description of Artificial Sequence: Synthetic oligonucleotide

SEQ ID NO: 15214 - protein, 17 aa, Artificial Sequence
  Description of Artificial Sequence: Synthetic peptide
WMHPNSGNTGYAQKFRG

SEQ ID NO: 15215 - DNA, 51 bp, Artificial Sequence; identical to SEQ ID NO: 12161
  Description of Artificial Sequence: Synthetic oligonucleotide

SEQ ID NO: 15216 - protein, 17 aa, Artificial Sequence
  Description of Artificial Sequence: Synthetic peptide
WMHPNSGNTGYAQKFQG

SEQ ID NO: 15217 - DNA, 51 bp, Artificial Sequence
  Description of Artificial Sequence: Synthetic oligonucleotide
tggatgcacccaaacagtggtaacacaggctatgcacagaagttccagggc

SEQ ID NO: 15218 - protein, 17 aa, Artificial Sequence
  Description of Artificial Sequence: Synthetic peptide
WMHPNSGNTGYAQKFQG

SEQ ID NO: 15219 - DNA, 51 bp, Artificial Sequence; identical to SEQ ID NO: 12161
  Description of Artificial Sequence: Synthetic oligonucleotide

SEQ ID NO: 15220 - protein, 17 aa, Artificial Sequence
  Description of Artificial Sequence: Synthetic peptide
WMHPNSGNTGYAQKFQG

SEQ ID NO: 15221 - DNA, 51 bp, Artificial Sequence
  Description of Artificial Sequence: Synthetic oligonucleotide
attatatggtatgatggaggttataaatactatgcagactccgtgaagggc

SEQ ID NO: 15222 - protein, 17 aa, Artificial Sequence
  Description of Artificial Sequence: Synthetic peptide
IIWYDGGYKYYADSVKG

SEQ ID NO: 15223 - DNA, 51 bp, Artificial Sequence
  Description of Artificial Sequence: Synthetic oligonucleotide
attatatggtatgatggaactaataaatactatacagactccgtgaagggc

SEQ ID NO: 15224 - protein, 17 aa, Artificial Sequence
  Description of Artificial Sequence: Synthetic peptide
IIWYDGTNKYYTDSVKG

SEQ ID NO: 15225 - DNA, 51 bp, Artificial Sequence; identical to SEQ ID NO: 12123
  Description of Artificial Sequence: Synthetic oligonucleotide

SEQ ID NO: 15226 - protein, 17 aa, Artificial Sequence
  Description of Artificial Sequence: Synthetic peptide
VIWYDGSNKYYADSVKG

SEQ ID NO: 15227 - DNA, 51 bp, Artificial Sequence; identical to SEQ ID NO: 12161
  Description of Artificial Sequence: Synthetic oligonucleotide

SEQ ID NO: 15228 - protein, 17 aa, Artificial Sequence
  Description of Artificial Sequence: Synthetic peptide
WMHPNSGNTGYAQKFQG

SEQ ID NO: 15229 - DNA, 51 bp, Artificial Sequence; identical to SEQ ID NO: 12161
  Description of Artificial Sequence: Synthetic oligonucleotide

SEQ ID NO: 15230 - protein, 17 aa, Artificial Sequence
  Description of Artificial Sequence: Synthetic peptide
WMHPNSGNTGYAQKFQG

SEQ ID NO: 15231 - DNA, 51 bp, Artificial Sequence; identical to SEQ ID NO: 12127
  Description of Artificial Sequence: Synthetic oligonucleotide

SEQ ID NO: 15232 - protein, 17 aa, Artificial Sequence
  Description of Artificial Sequence: Synthetic peptide
IIWYDGSNKYYADSVKG

SEQ ID NO: 15233 - DNA, 51 bp, Artificial Sequence; identical to SEQ ID NO: 12127
  Description of Artificial Sequence: Synthetic oligonucleotide

SEQ ID NO: 15234 - protein, 17 aa, Artificial Sequence
  Description of Artificial Sequence: Synthetic peptide
IIWYDGSNKYYADSVKG

SEQ ID NO: 15235 - DNA, 51 bp, Artificial Sequence
  Description of Artificial Sequence: Synthetic oligonucleotide
tggatcaacccttacagtggtgacacaaagtatgcacagaagtttcagggc

SEQ ID NO: 15236 - protein, 17 aa, Artificial Sequence
  Description of Artificial Sequence: Synthetic peptide
WINPYSGDTKYAQKFQG

SEQ ID NO: 15237 - DNA, 51 bp, Artificial Sequence; identical to SEQ ID NO: 12799
  Description of Artificial Sequence: Synthetic oligonucleotide

SEQ ID NO: 15238 - protein, 17 aa, Artificial Sequence
  Description of Artificial Sequence: Synthetic peptide
VIWYEESNKYYTDSVKG

SEQ ID NO: 15239 - DNA, 51 bp, Artificial Sequence; identical to SEQ ID NO: 15235
  Description of Artificial Sequence: Synthetic oligonucleotide

SEQ ID NO: 15240 - protein, 17 aa, Artificial Sequence
  Description of Artificial Sequence: Synthetic peptide
WINPYSGDTKYAQKFQG

SEQ ID NO: 15241 - DNA, 51 bp, Artificial Sequence
  Description of Artificial Sequence: Synthetic oligonucleotide
tggatcaacccttacagtggtgacacaaactctgcacagaagtttcagggc

SEQ ID NO: 15242 - protein, 17 aa, Artificial Sequence
  Description of Artificial Sequence: Synthetic peptide
WINPYSGDTNSAQKFQG

SEQ ID NO: 15243 - DNA, 51 bp, Artificial Sequence
  Description of Artificial Sequence: Synthetic oligonucleotide
tggatcaacccatacagtggtgacacaaactatgcacagaagtttcagggc

SEQ ID NO: 15244 - protein, 17 aa, Artificial Sequence
  Description of Artificial Sequence: Synthetic peptide
WINPYSGDTNYAQKFQG

SEQ ID NO: 15245 - DNA, 51 bp, Artificial Sequence; identical to SEQ ID NO: 12161
  Description of Artificial Sequence: Synthetic oligonucleotide

SEQ ID NO: 15246 - protein, 17 aa, Artificial Sequence
  Description of Artificial Sequence: Synthetic peptide
WMHPNSGNTGYAQKFQG

SEQ ID NO: 15247 - DNA, 51 bp, Artificial Sequence; identical to SEQ ID NO: 15171
  Description of Artificial Sequence: Synthetic oligonucleotide

SEQ ID NO: 15248 - protein, 17 aa, Artificial Sequence
  Description of Artificial Sequence: Synthetic peptide
WINPYSGDTNYAQKFQG

SEQ ID NO: 15249 - DNA, 51 bp, Artificial Sequence; identical to SEQ ID NO: 12123
  Description of Artificial Sequence: Synthetic oligonucleotide

SEQ ID NO: 15250 - protein, 17 aa, Artificial Sequence
  Description of Artificial Sequence: Synthetic peptide
VIWYDGSNKYYADSVKG

SEQ ID NO: 15251 - DNA, 51 bp, Artificial Sequence; identical to SEQ ID NO: 12161
  Description of Artificial Sequence: Synthetic oligonucleotide

SEQ ID NO: 15252 - protein, 17 aa, Artificial Sequence
  Description of Artificial Sequence: Synthetic peptide
WMHPNSGNTGYAQKFQG

SEQ ID NO: 15253 - DNA, 51 bp, Artificial Sequence; identical to SEQ ID NO: 15171
  Description of Artificial Sequence: Synthetic oligonucleotide

SEQ ID NO: 15254 - protein, 17 aa, Artificial Sequence
  Description of Artificial Sequence: Synthetic peptide
WINPYSGDTNYAQKFQG

SEQ ID NO: 15255 - DNA, 51 bp, Artificial Sequence; identical to SEQ ID NO: 12175
  Description of Artificial Sequence: Synthetic oligonucleotide

SEQ ID NO: 15256 - protein, 17 aa, Artificial Sequence
  Description of Artificial Sequence: Synthetic peptide
WINPYSGGTNYAQKFQG

SEQ ID NO: 15257 - DNA, 51 bp, Artificial Sequence; identical to SEQ ID NO: 15235
  Description of Artificial Sequence: Synthetic oligonucleotide

SEQ ID NO: 15258 - protein, 17 aa, Artificial Sequence
  Description of Artificial Sequence: Synthetic peptide
WINPYSGDTKYAQKFQG

SEQ ID NO: 15259 - DNA, 51 bp, Artificial Sequence
  Description of Artificial Sequence: Synthetic oligonucleotide
gttatatggtatgttggaagtaatcaatactatgcagactccgtgaagggc

SEQ ID NO: 15260 - protein, 17 aa, Artificial Sequence
  Description of Artificial Sequence: Synthetic peptide
VIWYVGSNQYYADSVKG

SEQ ID NO: 15261 - DNA, 51 bp, Artificial Sequence
  Description of Artificial Sequence: Synthetic oligonucleotide
gttattagtggtagaggtggtagctcattctacgcagactccgtgaagggc

SEQ ID NO: 15262 - protein, 17 aa, Artificial Sequence
  Description of Artificial Sequence: Synthetic peptide
VISGRGGSSFYADSVKG

SEQ ID NO: 15263 - DNA, 51 bp, Artificial Sequence; identical to SEQ ID NO: 13461
  Description of Artificial Sequence: Synthetic oligonucleotide

SEQ ID NO: 15264 - protein, 17 aa, Artificial Sequence
  Description of Artificial Sequence: Synthetic peptide
VIWYEESNKYYADSVKG

SEQ ID NO: 15265 - DNA, 51 bp, Artificial Sequence; identical to SEQ ID NO: 12161
  Description of Artificial Sequence: Synthetic oligonucleotide

SEQ ID NO: 15266 - protein, 17 aa, Artificial Sequence
  Description of Artificial Sequence: Synthetic peptide
WMHPNSGNTGYAQKFQG

SEQ ID NO: 15267 - DNA, 51 bp, Artificial Sequence; identical to SEQ ID NO: 13755
  Description of Artificial Sequence: Synthetic oligonucleotide

SEQ ID NO: 15268 - protein, 17 aa, Artificial Sequence
  Description of Artificial Sequence: Synthetic peptide
WMHPNSGNTGYAQKFQG

SEQ ID NO: 15269 - DNA, 51 bp, Artificial Sequence; identical to SEQ ID NO: 15171
  Description of Artificial Sequence: Synthetic oligonucleotide

SEQ ID NO: 15270 - protein, 17 aa, Artificial Sequence
  Description of Artificial Sequence: Synthetic peptide
WINPYSGDTNYAQKFQG

SEQ ID NO: 15271 - DNA, 51 bp, Artificial Sequence
  Description of Artificial Sequence: Synthetic oligonucleotide
tggatgtaccctaacagtggtaacacaggctatgcacagaagttccagggc

SEQ ID NO: 15272 - protein, 17 aa, Artificial Sequence
  Description of Artificial Sequence: Synthetic peptide
WMYPNSGNTGYAQKFQG

SEQ ID NO: 15273 - DNA, 51 bp, Artificial Sequence; identical to SEQ ID NO: 12161
  Description of Artificial Sequence: Synthetic oligonucleotide

SEQ ID NO: 15274 - protein, 17 aa, Artificial Sequence
  Description of Artificial Sequence: Synthetic peptide
WMHPNSGNTGYAQKFQG

SEQ ID NO: 15275 - DNA, 51 bp, Artificial Sequence
  Description of Artificial Sequence: Synthetic oligonucleotide
tccattagtagtagtattaattacatgtactacgcagactcagtgaagggc

SEQ ID NO: 15276 - protein, 17 aa, Artificial Sequence
  Description of Artificial Sequence: Synthetic peptide
SISSSINYMYYADSVKG

SEQ ID NO: 15277 - DNA, 51 bp, Artificial Sequence
  Description of Artificial Sequence: Synthetic oligonucleotide
gttatatggtatattggaagtaatcaatactatgcggactccgtgaagggc

SEQ ID NO: 15278 - protein, 17 aa, Artificial Sequence
  Description of Artificial Sequence: Synthetic peptide
VIWYIGSNQYYADSVKG

SEQ ID NO: 15279 - DNA, 51 bp, Artificial Sequence
  Description of Artificial Sequence: Synthetic oligonucleotide
gttattagtggtggtggtagtagcacatactacgcagactccgtgaagggc

SEQ ID NO: 15280 - protein, 17 aa, Artificial Sequence
  Description of Artificial Sequence: Synthetic peptide
VISGGGSSTYYADSVKG

SEQ ID NO: 15281 - DNA, 51 bp, Artificial Sequence; identical to SEQ ID NO: 15279
  Description of Artificial Sequence: Synthetic oligonucleotide

SEQ ID NO: 15282 - protein, 17 aa, Artificial Sequence
  Description of Artificial Sequence: Synthetic peptide
VISGGGSSTYYADSVKG

SEQ ID NO: 15283 - DNA, 51 bp, Artificial Sequence; identical to SEQ ID NO: 15279
  Description of Artificial Sequence: Synthetic oligonucleotide

SEQ ID NO: 15284 - protein, 17 aa, Artificial Sequence
  Description of Artificial Sequence: Synthetic peptide
VISGGGSSTYYADSVKG

SEQ ID NO: 15285 - DNA, 51 bp, Artificial Sequence
  Description of Artificial Sequence: Synthetic oligonucleotide
tacattagtagaagtagtaataccaaatactatgtagactctgtgaagggc

SEQ ID NO: 15286 - protein, 17 aa, Artificial Sequence
  Description of Artificial Sequence: Synthetic peptide
YISRSSNTKYYVDSVKG

SEQ ID NO: 15287 - DNA, 51 bp, Artificial Sequence
  Description of Artificial Sequence: Synthetic oligonucleotide
tggatgaaccctaatagtggtaacacaggctatgcacagaagttccagggc

SEQ ID NO: 15288 - protein, 17 aa, Artificial Sequence
  Description of Artificial Sequence: Synthetic peptide
WMNPNSGNTGYAQKFQG

SEQ ID NO: 15289 - DNA, 51 bp, Artificial Sequence
  Description of Artificial Sequence: Synthetic oligonucleotide
gttattagtggtggtggtagtagtacatactacgcagactccgtgaagggc

SEQ ID NO: 15290 - protein, 17 aa, Artificial Sequence
  Description of Artificial Sequence: Synthetic peptide
VISGGGSSTYYADSVKG

SEQ ID NO: 15291 - DNA, 51 bp, Artificial Sequence
  Description of Artificial Sequence: Synthetic oligonucleotide
tggatcaaccctaacagtggtgacacaaactatgcacagaagtttcagggc

SEQ ID NO: 15292 - protein, 17 aa, Artificial Sequence
  Description of Artificial Sequence: Synthetic peptide
WINPNSGDTNYAQKFQG

SEQ ID NO: 15293 - DNA, 51 bp, Artificial Sequence; identical to SEQ ID NO: 12123
  Description of Artificial Sequence: Synthetic oligonucleotide

SEQ ID NO: 15294 - protein, 17 aa, Artificial Sequence
  Description of Artificial Sequence: Synthetic peptide
VIWYDGSNKYYADSVKG

SEQ ID NO: 15295 - DNA, 51 bp, Artificial Sequence
  Description of Artificial Sequence: Synthetic oligonucleotide
gatatatggtttgatggcagtaataaatactatgtagactccgtgaaggac

SEQ ID NO: 15296 - protein, 17 aa, Artificial Sequence
  Description of Artificial Sequence: Synthetic peptide
DIWFDGSNKYYVDSVKD

SEQ ID NO: 15297 - DNA, 51 bp, Artificial Sequence
  Description of Artificial Sequence: Synthetic oligonucleotide
gttatatggtatggtggaagtgataaagactatgcagactccgtgaagggc

SEQ ID NO: 15298 - protein, 17 aa, Artificial Sequence
  Description of Artificial Sequence: Synthetic peptide
VIWYGGSDKDYADSVKG

SEQ ID NO: 15299 - DNA, 51 bp, Artificial Sequence; identical to SEQ ID NO: 15297
  Description of Artificial Sequence: Synthetic oligonucleotide

SEQ ID NO: 15300 - protein, 17 aa, Artificial Sequence
  Description of Artificial Sequence: Synthetic peptide
VIWYGGSDKDYADSVKG

SEQ ID NO: 15301 - DNA, 51 bp, Artificial Sequence; identical to SEQ ID NO: 15289
  Description of Artificial Sequence: Synthetic oligonucleotide

SEQ ID NO: 15302 - protein, 17 aa, Artificial Sequence
  Description of Artificial Sequence: Synthetic peptide
VISGGGSSTYYADSVKG

SEQ ID NO: 15303 - DNA, 51 bp, Artificial Sequence; identical to SEQ ID NO: 15279
  Description of Artificial Sequence: Synthetic oligonucleotide

SEQ ID NO: 15304 - protein, 17 aa, Artificial Sequence
  Description of Artificial Sequence: Synthetic peptide
VISGGGSSTYYADSVKG

SEQ ID NO: 15305 - DNA, 48 bp, Artificial Sequence; identical to SEQ ID NO: 12147
  Description of Artificial Sequence: Synthetic oligonucleotide

SEQ ID NO: 15306 - protein, 16 aa, Artificial Sequence
  Description of Artificial Sequence: Synthetic peptide
YIYYSGSTYYNPSLKS

SEQ ID NO: 15307 - DNA, 51 bp, Artificial Sequence
  Description of Artificial Sequence: Synthetic oligonucleotide
tacattagtagaagtagtaataccaaatactacgcagactctgtgaggggc

SEQ ID NO: 15308 - protein, 17 aa, Artificial Sequence
  Description of Artificial Sequence: Synthetic peptide
YISRSSNTKYYADSVRG

SEQ ID NO: 15309 - DNA, 51 bp, Artificial Sequence
  Description of Artificial Sequence: Synthetic oligonucleotide
tacattagtagaagtagtaataccaaacactacgcagactctgtgaagggc

SEQ ID NO: 15310 - protein, 17 aa, Artificial Sequence
  Description of Artificial Sequence: Synthetic peptide
YISRSSNTKHYADSVKG

SEQ ID NO: 15311 - DNA, 51 bp, Artificial Sequence; identical to SEQ ID NO: 15279
  Description of Artificial Sequence: Synthetic oligonucleotide

SEQ ID NO: 15312 - protein, 17 aa, Artificial Sequence
  Description of Artificial Sequence: Synthetic peptide
VISGGGSSTYYADSVKG

SEQ ID NO: 15313 - DNA, 51 bp, Artificial Sequence; identical to SEQ ID NO: 12123
  Description of Artificial Sequence: Synthetic oligonucleotide

SEQ ID NO: 15314 - protein, 17 aa, Artificial Sequence
  Description of Artificial Sequence: Synthetic peptide
VIWYDGSNKYYADSVKG

SEQ ID NO: 15315 - DNA, 51 bp, Artificial Sequence; identical to SEQ ID NO: 15297
  Description of Artificial Sequence: Synthetic oligonucleotide

SEQ ID NO: 15316 - protein, 17 aa, Artificial Sequence
  Description of Artificial Sequence: Synthetic peptide
VIWYGGSDKDYADSVKG

SEQ ID NO: 15317 - DNA, 51 bp, Artificial Sequence
  Description of Artificial Sequence: Synthetic oligonucleotide
gttattagtggtggtggtagtagtgcatactacgcagactccgtgaagggc

SEQ ID NO: 15318 - protein, 17 aa, Artificial Sequence
  Description of Artificial Sequence: Synthetic peptide
VISGGGSSAYYADSVKG

SEQ ID NO: 15319 - DNA, 51 bp, Artificial Sequence; identical to SEQ ID NO: 15309
  Description of Artificial Sequence: Synthetic oligonucleotide

SEQ ID NO: 15320 - protein, 17 aa, Artificial Sequence
  Description of Artificial Sequence: Synthetic peptide
YISRSSNTKHYADSVKG

SEQ ID NO: 15321 - DNA, 51 bp, Artificial Sequence
  Description of Artificial Sequence: Synthetic oligonucleotide
aacataaagcaagatggaagtgagaaatactatgtggactctgtgaagggc

SEQ ID NO: 15322 - protein, 17 aa, Artificial Sequence
  Description of Artificial Sequence: Synthetic peptide
NIKQDGSEKYYVDSVKG

SEQ ID NO: 15323 - DNA, 51 bp, Artificial Sequence; identical to SEQ ID NO: 15279
  Description of Artificial Sequence: Synthetic oligonucleotide

SEQ ID NO: 15324 - protein, 17 aa, Artificial Sequence
  Description of Artificial Sequence: Synthetic peptide
VISGGGSSTYYADSVKG

SEQ ID NO: 15325 - DNA, 51 bp, Artificial Sequence
  Description of Artificial Sequence: Synthetic oligonucleotide
gccattagtagtactggtagttacatatattacgcagactcagtgaagggc

SEQ ID NO: 15326 - protein, 17 aa, Artificial Sequence
  Description of Artificial Sequence: Synthetic peptide
AISSTGSYIYYADSVKG

SEQ ID NO: 15327 - DNA, 51 bp, Artificial Sequence
  Description of Artificial Sequence: Synthetic oligonucleotide
gttataagtggaggtggtagtagcacatattacgcagactccgtgaagggc

SEQ ID NO: 15328 - protein, 17 aa, Artificial Sequence
  Description of Artificial Sequence: Synthetic peptide
VISGGGSSTYYADSVKG

SEQ ID NO: 15329 - DNA, 51 bp, Artificial Sequence; identical to SEQ ID NO: 12123
  Description of Artificial Sequence: Synthetic oligonucleotide

SEQ ID NO: 15330 - protein, 17 aa, Artificial Sequence
  Description of Artificial Sequence: Synthetic peptide
VIWYDGSNKYYADSVKG

SEQ ID NO: 15331 - DNA, 51 bp, Artificial Sequence
  Description of Artificial Sequence: Synthetic oligonucleotide
gttatatggtatggtggaagtaataaagactatgcagactccgtgaagggc

SEQ ID NO: 15332 - protein, 17 aa, Artificial Sequence
  Description of Artificial Sequence: Synthetic peptide
VIWYGGSNKDYADSVKG

SEQ ID NO: 15333 - DNA, 51 bp, Artificial Sequence; identical to SEQ ID NO: 15279
  Description of Artificial Sequence: Synthetic oligonucleotide

SEQ ID NO: 15334 - protein, 17 aa, Artificial Sequence
  Description of Artificial Sequence: Synthetic peptide
VISGGGSSTYYADSVKG

SEQ ID NO: 15335 - DNA, 51 bp, Artificial Sequence; identical to SEQ ID NO: 15309
  Description of Artificial Sequence: Synthetic oligonucleotide

SEQ ID NO: 15336 - protein, 17 aa, Artificial Sequence
  Description of Artificial Sequence: Synthetic peptide
YISRSSNTKHYADSVKG

SEQ ID NO: 15337 - DNA, 51 bp, Artificial Sequence
  Description of Artificial Sequence: Synthetic oligonucleotide
attattagtggtggtggtagtagcacatactacgcagactccgtgaagggc

SEQ ID NO: 15338 - protein, 17 aa, Artificial Sequence
  Description of Artificial Sequence: Synthetic peptide
IISGGGSSTYYADSVKG

SEQ ID NO: 15339 - DNA, 51 bp, Artificial Sequence
  Description of Artificial Sequence: Synthetic oligonucleotide
gttatatggtatggtggaagtaatacagactatgcagactccgtgaagggc

SEQ ID NO: 15340 - protein, 17 aa, Artificial Sequence
  Description of Artificial Sequence: Synthetic peptide
VIWYGGSNTDYADSVKG

SEQ ID NO: 15341 - DNA, 51 bp, Artificial Sequence; identical to SEQ ID NO: 15279
  Description of Artificial Sequence: Synthetic oligonucleotide

SEQ ID NO: 15342 - protein, 17 aa, Artificial Sequence
  Description of Artificial Sequence: Synthetic peptide
VISGGGSSTYYADSVKG

SEQ ID NO: 15343 - DNA, 51 bp, Artificial Sequence; identical to SEQ ID NO: 12693
  Description of Artificial Sequence: Synthetic oligonucleotide

SEQ ID NO: 15344 - protein, 17 aa, Artificial Sequence
  Description of Artificial Sequence: Synthetic peptide
LIWYDGSNKYYADSVKG

SEQ ID NO: 15345 - DNA, 51 bp, Artificial Sequence; identical to SEQ ID NO: 15279
  Description of Artificial Sequence: Synthetic oligonucleotide

SEQ ID NO: 15346 - protein, 17 aa, Artificial Sequence
  Description of Artificial Sequence: Synthetic peptide
VISGGGSSTYYADSVKG

SEQ ID NO: 15347 - DNA, 51 bp, Artificial Sequence; identical to SEQ ID NO: 15279
  Description of Artificial Sequence: Synthetic oligonucleotide

SEQ ID NO: 15348 - protein, 17 aa, Artificial Sequence
  Description of Artificial Sequence: Synthetic peptide
VISGGGSSTYYADSVKG

SEQ ID NO: 15349 - DNA, 51 bp, Artificial Sequence; identical to SEQ ID NO: 12693
  Description of Artificial Sequence: Synthetic oligonucleotide

SEQ ID NO: 15350 - protein, 17 aa, Artificial Sequence
  Description of Artificial Sequence: Synthetic peptide
LIWYDGSNKYYADSVKG

SEQ ID NO: 15351 - DNA, 51 bp, Artificial Sequence; identical to SEQ ID NO: 15279
  Description of Artificial Sequence: Synthetic oligonucleotide

SEQ ID NO: 15352 - protein, 17 aa, Artificial Sequence
  Description of Artificial Sequence: Synthetic peptide
VISGGGSSTYYADSVKG

SEQ ID NO: 15353 - DNA, 51 bp, Artificial Sequence; identical to SEQ ID NO: 15279
  Description of Artificial Sequence: Synthetic oligonucleotide

SEQ ID NO: 15354 - protein, 17 aa, Artificial Sequence
  Description of Artificial Sequence: Synthetic peptide
VISGGGSSTYYADSVKG

SEQ ID NO: 15355 - DNA, 51 bp, Artificial Sequence; identical to SEQ ID NO: 12123
  Description of Artificial Sequence: Synthetic oligonucleotide

SEQ ID NO: 15356 - protein, 17 aa, Artificial Sequence
  Description of Artificial Sequence: Synthetic peptide
VIWYDGSNKYYADSVKG

SEQ ID NO: 15357 - DNA, 51 bp, Artificial Sequence; identical to SEQ ID NO: 12693
  Description of Artificial Sequence: Synthetic oligonucleotide

SEQ ID NO: 15358 - protein, 17 aa, Artificial Sequence
  Description of Artificial Sequence: Synthetic peptide
LIWYDGSNKYYADSVKG

SEQ ID NO: 15359 - DNA, 51 bp, Artificial Sequence
  Description of Artificial Sequence: Synthetic oligonucleotide
gttatatggtttgatggcagtaataaatactatgttgactccgtgaaggac

SEQ ID NO: 15360 - protein, 17 aa, Artificial Sequence
  Description of Artificial Sequence: Synthetic peptide
VIWFDGSNKYYVDSVKD

SEQ ID NO: 15361 - DNA, 51 bp, Artificial Sequence; identical to SEQ ID NO: 15331
  Description of Artificial Sequence: Synthetic oligonucleotide

SEQ ID NO: 15362 - protein, 17 aa, Artificial Sequence
  Description of Artificial Sequence: Synthetic peptide
VIWYGGSNKDYADSVKG

SEQ ID NO: 15363 - DNA, 51 bp, Artificial Sequence
  Description of Artificial Sequence: Synthetic oligonucleotide
gttgtatggtatggtggaaataataaagactatgcagactccgtgaagggc

SEQ ID NO: 15364 - protein, 17 aa, Artificial Sequence
  Description of Artificial Sequence: Synthetic peptide
VVWYGGNNKDYADSVKG

SEQ ID NO: 15365 - DNA, 51 bp, Artificial Sequence; identical to SEQ ID NO: 15279
  Description of Artificial Sequence: Synthetic oligonucleotide

SEQ ID NO: 15366 - protein, 17 aa, Artificial Sequence
  Description of Artificial Sequence: Synthetic peptide
VISGGGSSTYYADSVKG

SEQ ID NO: 15367 - DNA, 51 bp, Artificial Sequence; identical to SEQ ID NO: 12123
  Description of Artificial Sequence: Synthetic oligonucleotide

SEQ ID NO: 15368 - protein, 17 aa, Artificial Sequence
  Description of Artificial Sequence: Synthetic peptide
VIWYDGSNKYYADSVKG

SEQ ID NO: 15369 - DNA, 51 bp, Artificial Sequence; identical to SEQ ID NO: 15279
  Description of Artificial Sequence: Synthetic oligonucleotide

SEQ ID NO: 15370 - protein, 17 aa, Artificial Sequence
  Description of Artificial Sequence: Synthetic peptide
VISGGGSSTYYADSVKG

SEQ ID NO: 15371 - DNA, 51 bp, Artificial Sequence
  Description of Artificial Sequence: Synthetic oligonucleotide
gttatatggtatggtggaagtaataaagactatgcagactctgtgaagggc

SEQ ID NO: 15372 - protein, 17 aa, Artificial Sequence
  Description of Artificial Sequence: Synthetic peptide
VIWYGGSNKDYADSVKG

SEQ ID NO: 15373 - DNA, 48 bp, Artificial Sequence
  Description of Artificial Sequence: Synthetic oligonucleotide
tacatctattatagtgggagcacctactacaacccgtccctcaagagt

SEQ ID NO: 15374 - protein, 16 aa, Artificial Sequence
  Description of Artificial Sequence: Synthetic peptide
YIYYSGSTYYNPSLKS

SEQ ID NO: 15375 - DNA, 51 bp, Artificial Sequence
  Description of Artificial Sequence: Synthetic oligonucleotide
ctcatctatcctggtgcctctgataccagatacagcccgtccttccaaggc

SEQ ID NO: 15376 - protein, 17 aa, Artificial Sequence
  Description of Artificial Sequence: Synthetic peptide
LIYPGASDTRYSPSFQG

SEQ ID NO: 15377 - DNA, 51 bp, Artificial Sequence; identical to SEQ ID NO: 12339
  Description of Artificial Sequence: Synthetic oligonucleotide

SEQ ID NO: 15378 - protein, 17 aa, Artificial Sequence
  Description of Artificial Sequence: Synthetic peptide
VISYDGSNKYYADSVKG

SEQ ID NO: 15379 - DNA, 51 bp, Artificial Sequence
  Description of Artificial Sequence: Synthetic oligonucleotide
cttatacggtatgatggaagcgataaaaactatgcagactccgtgaagggc

SEQ ID NO: 15380 - protein, 17 aa, Artificial Sequence
  Description of Artificial Sequence: Synthetic peptide
LIRYDGSDKNYADSVKG

SEQ ID NO: 15381 - DNA, 51 bp, Artificial Sequence; identical to SEQ ID NO: 15279
  Description of Artificial Sequence: Synthetic oligonucleotide

SEQ ID NO: 15382 - protein, 17 aa, Artificial Sequence
  Description of Artificial Sequence: Synthetic peptide
VISGGGSSTYYADSVKG

SEQ ID NO: 15383 - DNA, 51 bp, Artificial Sequence; identical to SEQ ID NO: 12123
  Description of Artificial Sequence: Synthetic oligonucleotide

SEQ ID NO: 15384 - protein, 17 aa, Artificial Sequence
  Description of Artificial Sequence: Synthetic peptide
VIWYDGSNKYYADSVKG

SEQ ID NO: 15385 - DNA, 51 bp, Artificial Sequence
  Description of Artificial Sequence: Synthetic oligonucleotide
tacattagtagaagtagtaataccaaatactacgcagactctgtgaagggc

SEQ ID NO: 15386 - protein, 17 aa, Artificial Sequence
  Description of Artificial Sequence: Synthetic peptide
YISRSSNTKYYADSVKG

SEQ ID NO: 15387 - DNA, 51 bp, Artificial Sequence; identical to SEQ ID NO: 13327
  Description of Artificial Sequence: Synthetic oligonucleotide

SEQ ID NO: 15388 - protein, 17 aa, Artificial Sequence
  Description of Artificial Sequence: Synthetic peptide
VIWYDGSSKYYADSVKG

SEQ ID NO: 15389 - DNA, 51 bp, Artificial Sequence; identical to SEQ ID NO: 12123
  Description of Artificial Sequence: Synthetic oligonucleotide

SEQ ID NO: 15390 - protein, 17 aa, Artificial Sequence
  Description of Artificial Sequence: Synthetic peptide
VIWYDGSNKYYADSVKG

SEQ ID NO: 15391 - DNA, 51 bp, Artificial Sequence; identical to SEQ ID NO: 12123
  Description of Artificial Sequence: Synthetic oligonucleotide

SEQ ID NO: 15392 - protein, 17 aa, Artificial Sequence
  Description of Artificial Sequence: Synthetic peptide
VIWYDGSNKYYADSVKG

SEQ ID NO: 15393 - DNA, 51 bp, Artificial Sequence; identical to SEQ ID NO: 12123
  Description of Artificial Sequence: Synthetic oligonucleotide

SEQ ID NO: 15394 - protein, 17 aa, Artificial Sequence
  Description of Artificial Sequence: Synthetic peptide
VIWYDGSNKYYADSVKG

SEQ ID NO: 15395 - DNA, 51 bp, Artificial Sequence; identical to SEQ ID NO: 12123
  Description of Artificial Sequence: Synthetic oligonucleotide

SEQ ID NO: 15396 - protein, 17 aa, Artificial Sequence
  Description of Artificial Sequence: Synthetic peptide
VIWYDGSNKYYADSVKG

SEQ ID NO: 15397 - DNA, 51 bp, Artificial Sequence; identical to SEQ ID NO: 12133
  Description of Artificial Sequence: Synthetic oligonucleotide

SEQ ID NO: 15398 - protein, 17 aa, Artificial Sequence
  Description of Artificial Sequence: Synthetic peptide
VIWYDGSNKYYVDSVKG

SEQ ID NO: 15399 - DNA, 48 bp, Artificial Sequence
  Description of Artificial Sequence: Synthetic oligonucleotide
tacatctattacagtgggagcccctactacaacccgtccctcaagagt

SEQ ID NO: 15400 - protein, 16 aa, Artificial Sequence
  Description of Artificial Sequence: Synthetic peptide
YIYYSGSPYYNPSLKS

SEQ ID NO: 15401 - DNA, 48 bp, Artificial Sequence
  Description of Artificial Sequence: Synthetic oligonucleotide
tacatctattacagtgggagcccctactacaatccgtccctcaagagt

SEQ ID NO: 15402 - protein, 16 aa, Artificial Sequence
  Description of Artificial Sequence: Synthetic peptide
YIYYSGSPYYNPSLKS

SEQ ID NO: 15403 - DNA, 51 bp, Artificial Sequence; identical to SEQ ID NO: 12123
  Description of Artificial Sequence: Synthetic oligonucleotide

SEQ ID NO: 15404 - protein, 17 aa, Artificial Sequence
  Description of Artificial Sequence: Synthetic peptide
VIWYDGSNKYYADSVKG

SEQ ID NO: 15405 - DNA, 51 bp, Artificial Sequence; identical to SEQ ID NO: 12123
  Description of Artificial Sequence: Synthetic oligonucleotide

SEQ ID NO: 15406 - protein, 17 aa, Artificial Sequence
  Description of Artificial Sequence: Synthetic peptide
VIWYDGSNKYYADSVKG

SEQ ID NO: 15407 - DNA, 51 bp, Artificial Sequence; identical to SEQ ID NO: 12123
  Description of Artificial Sequence: Synthetic oligonucleotide

SEQ ID NO: 15408 - protein, 17 aa, Artificial Sequence
  Description of Artificial Sequence: Synthetic peptide
VIWYDGSNKYYADSVKG

SEQ ID NO: 15409 - DNA, 51 bp, Artificial Sequence
  Description of Artificial Sequence: Synthetic oligonucleotide
tacattggtagtagtggcagtatcatattctacgcagactctgtgaagggc

SEQ ID NO: 15410 - protein, 17 aa, Artificial Sequence
  Description of Artificial Sequence: Synthetic peptide
YIGSSGSIIFYADSVKG

SEQ ID NO: 15411 - DNA, 51 bp, Artificial Sequence; identical to SEQ ID NO: 12127
  Description of Artificial Sequence: Synthetic oligonucleotide

SEQ ID NO: 15412 - protein, 17 aa, Artificial Sequence
  Description of Artificial Sequence: Synthetic peptide
IIWYDGSNKYYADSVKG

SEQ ID NO: 15413 - DNA, 51 bp, Artificial Sequence; identical to SEQ ID NO: 12575
  Description of Artificial Sequence: Synthetic oligonucleotide

SEQ ID NO: 15414 - protein, 17 aa, Artificial Sequence
  Description of Artificial Sequence: Synthetic peptide
VIWYDGSNKYYADSVKG

SEQ ID NO: 15415 - DNA, 51 bp, Artificial Sequence
  Description of Artificial Sequence: Synthetic oligonucleotide
attatatggtatgatggaaataataaatactatgcagactccgtgaagggc

SEQ ID NO: 15416 - protein, 17 aa, Artificial Sequence
  Description of Artificial Sequence: Synthetic peptide
IIWYDGNNKYYADSVKG

SEQ ID NO: 15417 - DNA, 51 bp, Artificial Sequence; identical to SEQ ID NO: 12127
  Description of Artificial Sequence: Synthetic oligonucleotide

SEQ ID NO: 15418 - protein, 17 aa, Artificial Sequence
  Description of Artificial Sequence: Synthetic peptide
IIWYDGSNKYYADSVKG

SEQ ID NO: 15419 - DNA, 51 bp, Artificial Sequence; identical to SEQ ID NO: 15409
  Description of Artificial Sequence: Synthetic oligonucleotide

SEQ ID NO: 15420 - protein, 17 aa, Artificial Sequence
  Description of Artificial Sequence: Synthetic peptide
YIGSSGSIIFYADSVKG

SEQ ID NO: 15421 - DNA, 51 bp, Artificial Sequence
  Description of Artificial Sequence: Synthetic oligonucleotide
ataatcaaccctagtggtggtagcacaaactacgcacagaagttccagggc

SEQ ID NO: 15422 - protein, 17 aa, Artificial Sequence
  Description of Artificial Sequence: Synthetic peptide
IINPSGGSTNYAQKFQG

SEQ ID NO: 15423 - DNA, 51 bp, Artificial Sequence
  Description of Artificial Sequence: Synthetic oligonucleotide
gttatatggaatgatggaggtaataaatataatggagactccgtgaagggc

SEQ ID NO: 15424 - protein, 17 aa, Artificial Sequence
  Description of Artificial Sequence: Synthetic peptide
VIWNDGGNKYNGDSVKG

SEQ ID NO: 15425 - DNA, 51 bp, Artificial Sequence
  Description of Artificial Sequence: Synthetic oligonucleotide
acaatcaaccctagtggtggtagcacaaactacgcacagaagttccagggc

SEQ ID NO: 15426 - protein, 17 aa, Artificial Sequence
  Description of Artificial Sequence: Synthetic peptide
TINPSGGSTNYAQKFQG

SEQ ID NO: 15427 - DNA, 51 bp, Artificial Sequence
  Description of Artificial Sequence: Synthetic oligonucleotide
acaatcaaccctagtggtggtagcacagactacgcacagaagttccagggc

SEQ ID NO: 15428 - protein, 17 aa, Artificial Sequence
  Description of Artificial Sequence: Synthetic peptide
TINPSGGSTDYAQKFQG

SEQ ID NO: 15429 - DNA, 51 bp, Artificial Sequence
  Description of Artificial Sequence: Synthetic oligonucleotide
gttatatcatatgatggaagtcctaaatactgtgcagactccgtgaagggc

SEQ ID NO: 15430 - protein, 17 aa, Artificial Sequence
  Description of Artificial Sequence: Synthetic peptide
VISYDGSPKYCADSVKG

SEQ ID NO: 15431 - DNA, 54 bp, Artificial Sequence
  Description of Artificial Sequence: Synthetic oligonucleotide
aggacatactacaggtccaagtggtataatgcttatccagtatctatggaaagt

SEQ ID NO: 15432 - protein, 18 aa, Artificial Sequence
  Description of Artificial Sequence: Synthetic peptide
RTYYRSKWYNAYPVSMES

SEQ ID NO: 15433 - DNA, 51 bp, Artificial Sequence; identical to SEQ ID NO: 12127
  Description of Artificial Sequence: Synthetic oligonucleotide

SEQ ID NO: 15434 - protein, 17 aa, Artificial Sequence
  Description of Artificial Sequence: Synthetic peptide
IIWYDGSNKYYADSVKG

SEQ ID NO: 15435 - DNA, 54 bp, Artificial Sequence
  Description of Artificial Sequence: Synthetic oligonucleotide
aggacatactacaggtccaagtggtatagtgcttatccagtatctatggaaagt

SEQ ID NO: 15436 - protein, 18 aa, Artificial Sequence
  Description of Artificial Sequence: Synthetic peptide
RTYYRSKWYSAYPVSMES

SEQ ID NO: 15437 - DNA, 51 bp, Artificial Sequence; identical to SEQ ID NO: 12577
  Description of Artificial Sequence: Synthetic oligonucleotide

SEQ ID NO: 15438 - protein, 17 aa, Artificial Sequence
  Description of Artificial Sequence: Synthetic peptide
VIWYDGSNEYYADSVKG

SEQ ID NO: 15439 - DNA, 51 bp, Artificial Sequence
  Description of Artificial Sequence: Synthetic oligonucleotide
attatatattatgatggaagttataaatacaatgcagactccgtgaagggc

SEQ ID NO: 15440 - protein, 17 aa, Artificial Sequence
  Description of Artificial Sequence: Synthetic peptide
IIYYDGSYKYNADSVKG

SEQ ID NO: 15441 - DNA, 51 bp, Artificial Sequence
  Description of Artificial Sequence: Synthetic oligonucleotide
tacattagtagtagtggaagtaccacatactacgcagactctgtgcagggc

SEQ ID NO: 15442 - protein, 17 aa, Artificial Sequence
  Description of Artificial Sequence: Synthetic peptide
YISSSGSTTYYADSVQG

SEQ ID NO: 15443 - DNA, 51 bp, Artificial Sequence
  Description of Artificial Sequence: Synthetic oligonucleotide
attatatggtatgatggaagtgataaatactatgcagactccgtgaagggc

SEQ ID NO: 15444 - protein, 17 aa, Artificial Sequence
  Description of Artificial Sequence: Synthetic peptide
IIWYDGSDKYYADSVKG

SEQ ID NO: 15445 - DNA, 48 bp, Artificial Sequence
  Description of Artificial Sequence: Synthetic oligonucleotide
ttcatttcttggaatgatgataagcgctacagcccatctctgaagagc

SEQ ID NO: 15446 - protein, 16 aa, Artificial Sequence
  Description of Artificial Sequence: Synthetic peptide
FISWNDDKRYSPSLKS

SEQ ID NO: 15447 - DNA, 51 bp, Artificial Sequence; identical to SEQ ID NO: 12103
  Description of Artificial Sequence: Synthetic oligonucleotide

SEQ ID NO: 15448 - protein, 17 aa, Artificial Sequence
  Description of Artificial Sequence: Synthetic peptide
WMNPNSGNTGYAQKFQG

SEQ ID NO: 15449 - DNA, 51 bp, Artificial Sequence; identical to SEQ ID NO: 15443
  Description of Artificial Sequence: Synthetic oligonucleotide

SEQ ID NO: 15450 - protein, 17 aa, Artificial Sequence
  Description of Artificial Sequence: Synthetic peptide
IIWYDGSDKYYADSVKG

SEQ ID NO: 15451 - DNA, 51 bp, Artificial Sequence
  Description of Artificial Sequence: Synthetic oligonucleotide
tggatcagcgcttataatggtaacacaaagtatgcacagaagctccagggc

SEQ ID NO: 15452 - protein, 17 aa, Artificial Sequence
  Description of Artificial Sequence: Synthetic peptide
WISAYNGNTKYAQKLQG

SEQ ID NO: 15453 - DNA, 54 bp, Artificial Sequence; identical to SEQ ID NO: 12237
  Description of Artificial Sequence: Synthetic oligonucleotide

SEQ ID NO: 15454 - protein, 18 aa, Artificial Sequence
  Description of Artificial Sequence: Synthetic peptide
RTYYRSKWYNDYAVSVKS

SEQ ID NO: 15455 - DNA, 51 bp, Artificial Sequence
  Description of Artificial Sequence: Synthetic oligonucleotide
tggatcagcgcttataatggtaacagaaagtatgcacagaagctccagggc

SEQ ID NO: 15456 - protein, 17 aa, Artificial Sequence
  Description of Artificial Sequence: Synthetic peptide
WISAYNGNRKYAQKLQG

SEQ ID NO: 15457 - DNA, 51 bp, Artificial Sequence; identical to SEQ ID NO: 12123
  Description of Artificial Sequence: Synthetic oligonucleotide

SEQ ID NO: 15458 - protein, 17 aa, Artificial Sequence
  Description of Artificial Sequence: Synthetic peptide
VIWYDGSNKYYADSVKG

SEQ ID NO: 15459 - DNA, 51 bp, Artificial Sequence; identical to SEQ ID NO: 13705
  Description of Artificial Sequence: Synthetic oligonucleotide

SEQ ID NO: 15460 - protein, 17 aa, Artificial Sequence
  Description of Artificial Sequence: Synthetic peptide
VIWYDGSNKYYADSVKG

SEQ ID NO: 15461 - DNA, 51 bp, Artificial Sequence
  Description of Artificial Sequence: Synthetic oligonucleotide
tggatcatccctaacagtggtgacacaaactatgcacagaagtttcagggc

SEQ ID NO: 15462 - protein, 17 aa, Artificial Sequence
  Description of Artificial Sequence: Synthetic peptide
WIIPNSGDTNYAQKFQG

SEQ ID NO: 15463 - DNA, 51 bp, Artificial Sequence
  Description of Artificial Sequence: Synthetic oligonucleotide
tggattagtgcttataatggtaacacaaagaatgcacagaagctccagggc

SEQ ID NO: 15464 - protein, 17 aa, Artificial Sequence
  Description of Artificial Sequence: Synthetic peptide
WISAYNGNTKNAQKLQG

SEQ ID NO: 15465 - DNA, 51 bp, Artificial Sequence
  Description of Artificial Sequence: Synthetic oligonucleotide
tggatcagcgcttataatggtaacacaaagtatgcacagaagttccagggc

SEQ ID NO: 15466 - protein, 17 aa, Artificial Sequence
  Description of Artificial Sequence: Synthetic peptide
WISAYNGNTKYAQKFQG

SEQ ID NO: 15467 - DNA, 51 bp, Artificial Sequence
  Description of Artificial Sequence: Synthetic oligonucleotide
tggatcagcgcttataatggtaacacaaaggaagcacagaagttccagggc

SEQ ID NO: 15468 - protein, 17 aa, Artificial Sequence
  Description of Artificial Sequence: Synthetic peptide
WISAYNGNTKEAQKFQG

SEQ ID NO: 15469 - DNA, 48 bp, Artificial Sequence
  Description of Artificial Sequence: Synthetic oligonucleotide
ctcatttattggcatgaagataagcgctacagcccatctctgaagagc

SEQ ID NO: 15470 - protein, 16 aa, Artificial Sequence
  Description of Artificial Sequence: Synthetic peptide
LIYWHEDKRYSPSLKS

SEQ ID NO: 15471 - DNA, 48 bp, Artificial Sequence
  Description of Artificial Sequence: Synthetic oligonucleotide
ctcatttattggaatgatgataagcgctacagtccatctctgaagagc

SEQ ID NO: 15472 - protein, 16 aa, Artificial Sequence
  Description of Artificial Sequence: Synthetic peptide
LIYWNDDKRYSPSLKS

SEQ ID NO: 15473 - DNA, 48 bp, Artificial Sequence
  Description of Artificial Sequence: Synthetic oligonucleotide
ctcatttattggcatgaagataggcgctacagcccatctctgaagagc

SEQ ID NO: 15474 - protein, 16 aa, Artificial Sequence
  Description of Artificial Sequence: Synthetic peptide
LIYWHEDRRYSPSLKS

SEQ ID NO: 15475 - DNA, 48 bp, Artificial Sequence; identical to SEQ ID NO: 12761
  Description of Artificial Sequence: Synthetic oligonucleotide

SEQ ID NO: 15476 - protein, 16 aa, Artificial Sequence
  Description of Artificial Sequence: Synthetic peptide
LIYWDDDKRYSPSLKS

SEQ ID NO: 15477 - DNA, 51 bp, Artificial Sequence
  Description of Artificial Sequence: Synthetic oligonucleotide
tccattagtagtagtagttattacttatactacgcagactcagtgaagggc

SEQ ID NO: 15478 - protein, 17 aa, Artificial Sequence
  Description of Artificial Sequence: Synthetic peptide
SISSSSYYLYYADSVKG

SEQ ID NO: 15479 - DNA, 51 bp, Artificial Sequence
  Description of Artificial Sequence: Synthetic oligonucleotide
gttacatcatatgatggaagtgataaatactatgcagactccgtgaagggc

SEQ ID NO: 15480 - protein, 17 aa, Artificial Sequence
  Description of Artificial Sequence: Synthetic peptide
VTSYDGSDKYYADSVKG

SEQ ID NO: 15481 - DNA, 51 bp, Artificial Sequence
  Description of Artificial Sequence: Synthetic oligonucleotide
cacataaagcaagatggaagtgagaaatactatgtggactctgtgaagggc

SEQ ID NO: 15482 - protein, 17 aa, Artificial Sequence
  Description of Artificial Sequence: Synthetic peptide
HIKQDGSEKYYVDSVKG

SEQ ID NO: 15483 - DNA, 51 bp, Artificial Sequence; identical to SEQ ID NO: 12339
  Description of Artificial Sequence: Synthetic oligonucleotide

SEQ ID NO: 15484 - protein, 17 aa, Artificial Sequence
  Description of Artificial Sequence: Synthetic peptide
VISYDGSNKYYADSVKG

SEQ ID NO: 15485 - DNA, 51 bp, Artificial Sequence
  Description of Artificial Sequence: Synthetic oligonucleotide
tacattagtactagtagtagtaccatattctacgcagactctgtgaagggc

SEQ ID NO: 15486 - protein, 17 aa, Artificial Sequence
  Description of Artificial Sequence: Synthetic peptide
YISTSSSTIFYADSVKG

SEQ ID NO: 15487 - DNA, 51 bp, Artificial Sequence
  Description of Artificial Sequence: Synthetic oligonucleotide
tacattagtgggagtagtaatatcatatactacacagactctgtgaagggc

SEQ ID NO: 15488 - protein, 17 aa, Artificial Sequence
  Description of Artificial Sequence: Synthetic peptide
YISGSSNIIYYTDSVKG

SEQ ID NO: 15489 - DNA, 51 bp, Artificial Sequence; identical to SEQ ID NO: 12151
  Description of Artificial Sequence: Synthetic oligonucleotide

SEQ ID NO: 15490 - protein, 17 aa, Artificial Sequence
  Description of Artificial Sequence: Synthetic peptide
AIWYDGSNKYYADSVKG

SEQ ID NO: 15491 - DNA, 48 bp, Artificial Sequence; identical to SEQ ID NO: 15469
  Description of Artificial Sequence: Synthetic oligonucleotide

SEQ ID NO: 15492 - protein, 16 aa, Artificial Sequence
  Description of Artificial Sequence: Synthetic peptide
LIYWHEDKRYSPSLKS

SEQ ID NO: 15493 - DNA, 51 bp, Artificial Sequence
  Description of Artificial Sequence: Synthetic oligonucleotide
tacattagtgagagtagtaatatcatatactacacagactctgtgaagggc

SEQ ID NO: 15494 - protein, 17 aa, Artificial Sequence
  Description of Artificial Sequence: Synthetic peptide
YISESSNIIYYTDSVKG

SEQ ID NO: 15495 - DNA, 48 bp, Artificial Sequence; identical to SEQ ID NO: 12761
  Description of Artificial Sequence: Synthetic oligonucleotide

SEQ ID NO: 15496 - protein, 16 aa, Artificial Sequence
  Description of Artificial Sequence: Synthetic peptide
LIYWDDDKRYSPSLKS

SEQ ID NO: 15497 - DNA, 48 bp, Artificial Sequence
  Description of Artificial Sequence: Synthetic oligonucleotide
ctcatttattcacatgaagataagcgctacagcccatctctgaagagc

SEQ ID NO: 15498 - protein, 16 aa, Artificial Sequence
  Description of Artificial Sequence: Synthetic peptide
LIYSHEDKRYSPSLKS

SEQ ID NO: 15499 - DNA, 48 bp, Artificial Sequence
  Description of Artificial Sequence: Synthetic oligonucleotide
ctcattaattggaatgatgataagcgctacagcccatctctgaagagc

SEQ ID NO: 15500 - protein, 16 aa, Artificial Sequence
  Description of Artificial Sequence: Synthetic peptide
LINWNDDKRYSPSLKS

SEQ ID NO: 15501 - DNA, 48 bp, Artificial Sequence; identical to SEQ ID NO: 15499
  Description of Artificial Sequence: Synthetic oligonucleotide

SEQ ID NO: 15502 - protein, 16 aa, Artificial Sequence
  Description of Artificial Sequence: Synthetic peptide
LINWNDDKRYSPSLKS

SEQ ID NO: 15503 - DNA, 48 bp, Artificial Sequence; identical to SEQ ID NO: 15499
  Description of Artificial Sequence: Synthetic oligonucleotide

SEQ ID NO: 15504 - protein, 16 aa, Artificial Sequence
  Description of Artificial Sequence: Synthetic peptide
LINWNDDKRYSPSLKS

SEQ ID NO: 15505 - DNA, 48 bp, Artificial Sequence
  Description of Artificial Sequence: Synthetic oligonucleotide
ctcattaattggaatgatgataaacgctacagcccatctctgaagagc

SEQ ID NO: 15506 - protein, 16 aa, Artificial Sequence
  Description of Artificial Sequence: Synthetic peptide
LINWNDDKRYSPSLKS

SEQ ID NO: 15507 - DNA, 48 bp, Artificial Sequence
  Description of Artificial Sequence: Synthetic oligonucleotide
ctcattaattggaatgatgataagcgctacagcccgtctctgaagagc

SEQ ID NO: 15508 - protein, 16 aa, Artificial Sequence
  Description of Artificial Sequence: Synthetic peptide
LINWNDDKRYSPSLKS

SEQ ID NO: 15509 - DNA, 51 bp, Artificial Sequence
  Description of Artificial Sequence: Synthetic oligonucleotide
tacattagtagtagtactagtaccatatactacgcagcctctgtgaagggc

SEQ ID NO: 15510 - protein, 17 aa, Artificial Sequence
  Description of Artificial Sequence: Synthetic peptide
YISSSTSTIYYAASVKG

SEQ ID NO: 15511 - DNA, 51 bp, Artificial Sequence; identical to SEQ ID NO: 15509
  Description of Artificial Sequence: Synthetic oligonucleotide

SEQ ID NO: 15512 - protein, 17 aa, Artificial Sequence
  Description of Artificial Sequence: Synthetic peptide
YISSSTSTIYYAASVKG

SEQ ID NO: 15513 - DNA, 51 bp, Artificial Sequence
  Description of Artificial Sequence: Synthetic oligonucleotide
tggatcaaccctaacagtggtggcacaaattatgcacagaagtttcagggc

SEQ ID NO: 15514 - protein, 17 aa, Artificial Sequence
  Description of Artificial Sequence: Synthetic peptide
WINPNSGGTNYAQKFQG

SEQ ID NO: 15515 - DNA, 48 bp, Artificial Sequence
  Description of Artificial Sequence: Synthetic oligonucleotide
ctcattaattggaatgatgataagcgcttcagcccatctctgaagagc

SEQ ID NO: 15516 - protein, 16 aa, Artificial Sequence
  Description of Artificial Sequence: Synthetic peptide
LINWNDDKRFSPSLKS

SEQ ID NO: 15517 - DNA, 51 bp, Artificial Sequence
  Description of Artificial Sequence: Synthetic oligonucleotide
tggatcaaccctaacagtggtggcacaaactatggacagaagtttcagggc

SEQ ID NO: 15518 - protein, 17 aa, Artificial Sequence
  Description of Artificial Sequence: Synthetic peptide
WINPNSGGTNYGQKFQG

SEQ ID NO: 15519 - DNA, 54 bp, Artificial Sequence
  Description of Artificial Sequence: Synthetic oligonucleotide
aggacatactacaggtccgagtgctataatgattatgcagtatctgtgcagagt

SEQ ID NO: 15520 - protein, 18 aa, Artificial Sequence
  Description of Artificial Sequence: Synthetic peptide
RTYYRSECYNDYAVSVQS

SEQ ID NO: 15521 - DNA, 51 bp, Artificial Sequence; identical to SEQ ID NO: 15513
  Description of Artificial Sequence: Synthetic oligonucleotide

SEQ ID NO: 15522 - protein, 17 aa, Artificial Sequence
  Description of Artificial Sequence: Synthetic peptide
WINPNSGGTNYAQKFQG

SEQ ID NO: 15523 - DNA, 51 bp, Artificial Sequence
  Description of Artificial Sequence: Synthetic oligonucleotide
tggatcaaccctaacagtggtggcacaaactatggacagaagtttcaggac

SEQ ID NO: 15524 - protein, 17 aa, Artificial Sequence
  Description of Artificial Sequence: Synthetic peptide
WINPNSGGTNYGQKFQD

SEQ ID NO: 15525 - DNA, 51 bp, Artificial Sequence
  Description of Artificial Sequence: Synthetic oligonucleotide
tggatcaaccctaacagtggtggcacaaactatgcacagaagtttcaggtc

SEQ ID NO: 15526 - protein, 17 aa, Artificial Sequence
  Description of Artificial Sequence: Synthetic peptide
WINPNSGGTNYAQKFQV

SEQ ID NO: 15527 - DNA, 51 bp, Artificial Sequence; identical to SEQ ID NO: 15517
  Description of Artificial Sequence: Synthetic oligonucleotide

SEQ ID NO: 15528 - protein, 17 aa, Artificial Sequence
  Description of Artificial Sequence: Synthetic peptide
WINPNSGGTNYGQKFQG

SEQ ID NO: 15529 - DNA, 48 bp, Artificial Sequence; identical to SEQ ID NO: 15499
  Description of Artificial Sequence: Synthetic oligonucleotide

SEQ ID NO: 15530 - protein, 16 aa, Artificial Sequence
  Description of Artificial Sequence: Synthetic peptide
LINWNDDKRYSPSLKS

SEQ ID NO: 15531 - DNA, 51 bp, Artificial Sequence
  Description of Artificial Sequence: Synthetic oligonucleotide
gttacaacatatgatggaagtaataaatactatgcagactccgtgaagggc

SEQ ID NO: 15532 - protein, 17 aa, Artificial Sequence
  Description of Artificial Sequence: Synthetic peptide
VTTYDGSNKYYADSVKG

SEQ ID NO: 15533 - DNA, 48 bp, Artificial Sequence; identical to SEQ ID NO: 15499
  Description of Artificial Sequence: Synthetic oligonucleotide

SEQ ID NO: 15534 - protein, 16 aa, Artificial Sequence
  Description of Artificial Sequence: Synthetic peptide
LINWNDDKRYSPSLKS

SEQ ID NO: 15535 - DNA, 48 bp, Artificial Sequence; identical to SEQ ID NO: 12761
  Description of Artificial Sequence: Synthetic oligonucleotide

SEQ ID NO: 15536 - protein, 16 aa, Artificial Sequence
  Description of Artificial Sequence: Synthetic peptide
LIYWDDDKRYSPSLKS

SEQ ID NO: 15537 - DNA, 51 bp, Artificial Sequence
  Description of Artificial Sequence: Synthetic oligonucleotide
gttatatggtatgatggaaataataaatcctatgcagactccgtgaagggc

SEQ ID NO: 15538 - protein, 17 aa, Artificial Sequence
  Description of Artificial Sequence: Synthetic peptide
VIWYDGNNKSYADSVKG

SEQ ID NO: 15539 - DNA, 48 bp, Artificial Sequence
  Description of Artificial Sequence: Synthetic oligonucleotide
ttcatttattgggatgatgataagcgctacagcccatctctgaagagc

SEQ ID NO: 15540 - protein, 16 aa, Artificial Sequence
  Description of Artificial Sequence: Synthetic peptide
FIYWDDDKRYSPSLKS

SEQ ID NO: 15541 - DNA, 48 bp, Artificial Sequence
  Description of Artificial Sequence: Synthetic oligonucleotide
tacatctattacagtgggagcacctactacaacccgtccctcaggagt

SEQ ID NO: 15542 - protein, 16 aa, Artificial Sequence
  Description of Artificial Sequence: Synthetic peptide
YIYYSGSTYYNPSLRS

SEQ ID NO: 15543 - DNA, 51 bp, Artificial Sequence; identical to SEQ ID NO: 15537
  Description of Artificial Sequence: Synthetic oligonucleotide

SEQ ID NO: 15544 - protein, 17 aa, Artificial Sequence
  Description of Artificial Sequence: Synthetic peptide
VIWYDGNNKSYADSVKG

SEQ ID NO: 15545 - DNA, 51 bp, Artificial Sequence
  Description of Artificial Sequence: Synthetic oligonucleotide
gttttttggtatgatggaagtaataaagactatgcagactccgtgaagggc

SEQ ID NO: 15546 - protein, 17 aa, Artificial Sequence
  Description of Artificial Sequence: Synthetic peptide
VFWYDGSNKDYADSVKG

SEQ ID NO: 15547 - DNA, 48 bp, Artificial Sequence
  Description of Artificial Sequence: Synthetic oligonucleotide
tacatctattacattgggagtgtttactacaacccgtccctcaagagt

SEQ ID NO: 15548 - protein, 16 aa, Artificial Sequence
  Description of Artificial Sequence: Synthetic peptide
YIYYIGSVYYNPSLKS

SEQ ID NO: 15549 - DNA, 51 bp, Artificial Sequence; identical to SEQ ID NO: 15537
  Description of Artificial Sequence: Synthetic oligonucleotide

SEQ ID NO: 15550 - protein, 17 aa, Artificial Sequence
  Description of Artificial Sequence: Synthetic peptide
VIWYDGNNKSYADSVKG

SEQ ID NO: 15551 - DNA, 51 bp, Artificial Sequence; identical to SEQ ID NO: 15537
  Description of Artificial Sequence: Synthetic oligonucleotide

SEQ ID NO: 15552 - protein, 17 aa, Artificial Sequence
  Description of Artificial Sequence: Synthetic peptide
VIWYDGNNKSYADSVKG

SEQ ID NO: 15553 - DNA, 48 bp, Artificial Sequence; identical to SEQ ID NO: 12761
  Description of Artificial Sequence: Synthetic oligonucleotide

SEQ ID NO: 15554 - protein, 16 aa, Artificial Sequence
  Description of Artificial Sequence: Synthetic peptide
LIYWDDDKRYSPSLKS

SEQ ID NO: 15555 - DNA, 51 bp, Artificial Sequence; identical to SEQ ID NO: 15537
  Description of Artificial Sequence: Synthetic oligonucleotide

SEQ ID NO: 15556 - protein, 17 aa, Artificial Sequence
  Description of Artificial Sequence: Synthetic peptide
VIWYDGNNKSYADSVKG

SEQ ID NO: 15557 - DNA, 51 bp, Artificial Sequence
  Description of Artificial Sequence: Synthetic oligonucleotide
gttattagtggtggtggtactaccacatactacgcagactccgtgaagggc

SEQ ID NO: 15558 - protein, 17 aa, Artificial Sequence
  Description of Artificial Sequence: Synthetic peptide
VISGGGTTTYYADSVKG

SEQ ID NO: 15559 - DNA, 51 bp, Artificial Sequence
  Description of Artificial Sequence: Synthetic oligonucleotide
gttgtatggtatggtggaaatgataaagactttgcagactccgtgacgggc

SEQ ID NO: 15560 - protein, 17 aa, Artificial Sequence
  Description of Artificial Sequence: Synthetic peptide
VVWYGGNDKDFADSVTG

SEQ ID NO: 15561 - DNA, 51 bp, Artificial Sequence; identical to SEQ ID NO: 12103
  Description of Artificial Sequence: Synthetic oligonucleotide

SEQ ID NO: 15562 - protein, 17 aa, Artificial Sequence
  Description of Artificial Sequence: Synthetic peptide
WMNPNSGNTGYAQKFQG

SEQ ID NO: 15563 - DNA, 48 bp, Artificial Sequence
  Description of Artificial Sequence: Synthetic oligonucleotide
atccttttttggaatgatgatgagcgctacagcccatctctgaagagc

SEQ ID NO: 15564 - protein, 16 aa, Artificial Sequence
  Description of Artificial Sequence: Synthetic peptide
ILFWNDDERYSPSLKS

SEQ ID NO: 15565 - DNA, 51 bp, Artificial Sequence; identical to SEQ ID NO: 12123
  Description of Artificial Sequence: Synthetic oligonucleotide

SEQ ID NO: 15566 - protein, 17 aa, Artificial Sequence
  Description of Artificial Sequence: Synthetic peptide
VIWYDGSNKYYADSVKG

SEQ ID NO: 15567 - DNA, 51 bp, Artificial Sequence
  Description of Artificial Sequence: Synthetic oligonucleotide
gttatatggtatgatggaagtggtaaatactatgcagactccgtgaagggc

SEQ ID NO: 15568 - protein, 17 aa, Artificial Sequence
  Description of Artificial Sequence: Synthetic peptide
VIWYDGSGKYYADSVKG

SEQ ID NO: 15569 - DNA, 51 bp, Artificial Sequence; identical to SEQ ID NO: 12127
  Description of Artificial Sequence: Synthetic oligonucleotide

SEQ ID NO: 15570 - protein, 17 aa, Artificial Sequence
  Description of Artificial Sequence: Synthetic peptide
IIWYDGSNKYYADSVKG

SEQ ID NO: 15571 - DNA, 51 bp, Artificial Sequence; identical to SEQ ID NO: 15443
  Description of Artificial Sequence: Synthetic oligonucleotide

SEQ ID NO: 15572 - protein, 17 aa, Artificial Sequence
  Description of Artificial Sequence: Synthetic peptide
IIWYDGSDKYYADSVKG

SEQ ID NO: 15573 - DNA, 48 bp, Artificial Sequence; identical to SEQ ID NO: 12763
  Description of Artificial Sequence: Synthetic oligonucleotide

SEQ ID NO: 15574 - protein, 16 aa, Artificial Sequence
  Description of Artificial Sequence: Synthetic peptide
LIYWNDDERYSPSLKS

SEQ ID NO: 15575 - DNA, 48 bp, Artificial Sequence; identical to SEQ ID NO: 15445
  Description of Artificial Sequence: Synthetic oligonucleotide

SEQ ID NO: 15576 - protein, 16 aa, Artificial Sequence
  Description of Artificial Sequence: Synthetic peptide
FISWNDDKRYSPSLKS

SEQ ID NO: 15577 - DNA, 48 bp, Artificial Sequence; identical to SEQ ID NO: 12147
  Description of Artificial Sequence: Synthetic oligonucleotide

SEQ ID NO: 15578 - protein, 16 aa, Artificial Sequence
  Description of Artificial Sequence: Synthetic peptide
YIYYSGSTYYNPSLKS

SEQ ID NO: 15579 - DNA, 51 bp, Artificial Sequence
  Description of Artificial Sequence: Synthetic oligonucleotide
gttataatatatgatggaagttataagtactatgcagactccgtgaagggc

SEQ ID NO: 15580 - protein, 17 aa, Artificial Sequence
  Description of Artificial Sequence: Synthetic peptide
VIIYDGSYKYYADSVKG

SEQ ID NO: 15581 - DNA, 54 bp, Artificial Sequence
  Description of Artificial Sequence: Synthetic oligonucleotide
aagacatactacaggtccaagtggtataatgattatgcagtatctgtgaaaagt

SEQ ID NO: 15582 - protein, 18 aa, Artificial Sequence
  Description of Artificial Sequence: Synthetic peptide
KTYYRSKWYNDYAVSVKS

SEQ ID NO: 15583 - DNA, 51 bp, Artificial Sequence
  Description of Artificial Sequence: Synthetic oligonucleotide
gttatatggtttgatggagataataaatactatgcagactccgtgaagggc

SEQ ID NO: 15584 - protein, 17 aa, Artificial Sequence
  Description of Artificial Sequence: Synthetic peptide
VIWFDGDNKYYADSVKG

SEQ ID NO: 15585 - DNA, 51 bp, Artificial Sequence; identical to SEQ ID NO: 12123
  Description of Artificial Sequence: Synthetic oligonucleotide

SEQ ID NO: 15586 - protein, 17 aa, Artificial Sequence
  Description of Artificial Sequence: Synthetic peptide
VIWYDGSNKYYADSVKG

SEQ ID NO: 15587 - DNA, 51 bp, Artificial Sequence
  Description of Artificial Sequence: Synthetic oligonucleotide
gttatatggaatgatggaagtaaaaaataccatgtagactccgtgaagggc

SEQ ID NO: 15588 - protein, 17 aa, Artificial Sequence
  Description of Artificial Sequence: Synthetic peptide
VIWNDGSKKYHVDSVKG

SEQ ID NO: 15589 - DNA, 51 bp, Artificial Sequence
  Description of Artificial Sequence: Synthetic oligonucleotide
gttatatggtttgatggaagtaataaatactatacagactccgtgaagggc

SEQ ID NO: 15590 - protein, 17 aa, Artificial Sequence
  Description of Artificial Sequence: Synthetic peptide
VIWFDGSNKYYTDSVKG

SEQ ID NO: 15591 - DNA, 51 bp, Artificial Sequence; identical to SEQ ID NO: 12197
  Description of Artificial Sequence: Synthetic oligonucleotide

SEQ ID NO: 15592 - protein, 17 aa, Artificial Sequence
  Description of Artificial Sequence: Synthetic peptide
WINPNSGGTNYAQKFQG

SEQ ID NO: 15593 - DNA, 51 bp, Artificial Sequence; identical to SEQ ID NO: 15579
  Description of Artificial Sequence: Synthetic oligonucleotide

SEQ ID NO: 15594 - protein, 17 aa, Artificial Sequence
  Description of Artificial Sequence: Synthetic peptide
VIIYDGSYKYYADSVKG

SEQ ID NO: 15595 - DNA, 51 bp, Artificial Sequence; identical to SEQ ID NO: 12123
  Description of Artificial Sequence: Synthetic oligonucleotide

SEQ ID NO: 15596 - protein, 17 aa, Artificial Sequence
  Description of Artificial Sequence: Synthetic peptide
VIWYDGSNKYYADSVKG

SEQ ID NO: 15597 - DNA, 54 bp, Artificial Sequence; identical to SEQ ID NO: 12237
  Description of Artificial Sequence: Synthetic oligonucleotide

SEQ ID NO: 15598 - protein, 18 aa, Artificial Sequence
  Description of Artificial Sequence: Synthetic peptide
RTYYRSKWYNDYAVSVKS

SEQ ID NO: 15599 - DNA, 51 bp, Artificial Sequence
  Description of Artificial Sequence: Synthetic oligonucleotide
gttatatggtttggtggagataataaatactatgcagactccgtgaggggc

SEQ ID NO: 15600 - protein, 17 aa, Artificial Sequence
  Description of Artificial Sequence: Synthetic peptide
VIWFGGDNKYYADSVRG

SEQ ID NO: 15601 - DNA, 51 bp, Artificial Sequence; identical to SEQ ID NO: 15579
  Description of Artificial Sequence: Synthetic oligonucleotide

SEQ ID NO: 15602 - protein, 17 aa, Artificial Sequence
  Description of Artificial Sequence: Synthetic peptide
VIIYDGSYKYYADSVKG

SEQ ID NO: 15603 - DNA, 48 bp, Artificial Sequence
  Description of Artificial Sequence: Synthetic oligonucleotide
tacatctattacagtgggatcacctactacaatccgtccctcaagagt

SEQ ID NO: 15604 - protein, 16 aa, Artificial Sequence
  Description of Artificial Sequence: Synthetic peptide
YIYYSGITYYNPSLKS

SEQ ID NO: 15605 - DNA, 48 bp, Artificial Sequence
  Description of Artificial Sequence: Synthetic oligonucleotide
tatatctattacagtgggagtactaagtacaacccctccctcaagagt

SEQ ID NO: 15606 - protein, 16 aa, Artificial Sequence
  Description of Artificial Sequence: Synthetic peptide
YIYYSGSTKYNPSLKS

SEQ ID NO: 15607 - DNA, 48 bp, Artificial Sequence; identical to SEQ ID NO: 15603
  Description of Artificial Sequence: Synthetic oligonucleotide

SEQ ID NO: 15608 - protein, 16 aa, Artificial Sequence
  Description of Artificial Sequence: Synthetic peptide
YIYYSGITYYNPSLKS

SEQ ID NO: 15609 - DNA, 51 bp, Artificial Sequence; identical to SEQ ID NO: 12227
  Description of Artificial Sequence: Synthetic oligonucleotide

SEQ ID NO: 15610 - protein, 17 aa, Artificial Sequence
  Description of Artificial Sequence: Synthetic peptide
VIWFDGSNKYYADSVKG

SEQ ID NO: 15611 - DNA, 51 bp, Artificial Sequence
  Description of Artificial Sequence: Synthetic oligonucleotide
gttatatggtttggtggagataataaatactatgcagactccgtgaagggc

SEQ ID NO: 15612 - protein, 17 aa, Artificial Sequence
  Description of Artificial Sequence: Synthetic peptide
VIWFGGDNKYYADSVKG

SEQ ID NO: 15613 - DNA, 51 bp, Artificial Sequence
  Description of Artificial Sequence: Synthetic oligonucleotide
gttatatggtatgatggaagtaaaaaatactatgcagactccgtgaagggc

SEQ ID NO: 15614 - protein, 17 aa, Artificial Sequence
  Description of Artificial Sequence: Synthetic peptide
VIWYDGSKKYYADSVKG

SEQ ID NO: 15615 - DNA, 51 bp, Artificial Sequence
  Description of Artificial Sequence: Synthetic oligonucleotide
cttatatggtttgatggaagtaataaatactatgcagactccgtgaagggc

SEQ ID NO: 15616 - protein, 17 aa, Artificial Sequence
  Description of Artificial Sequence: Synthetic peptide
LIWFDGSNKYYADSVKG

SEQ ID NO: 15617 - DNA, 51 bp, Artificial Sequence
  Description of Artificial Sequence: Synthetic oligonucleotide
tggatcaaccctaatagtggtggcacaaactatgcacacaagtttcagggc

SEQ ID NO: 15618 - protein, 17 aa, Artificial Sequence
  Description of Artificial Sequence: Synthetic peptide
WINPNSGGTNYAHKFQG

SEQ ID NO: 15619 - DNA, 51 bp, Artificial Sequence; identical to SEQ ID NO: 12735
  Description of Artificial Sequence: Synthetic oligonucleotide

SEQ ID NO: 15620 - protein, 17 aa, Artificial Sequence
  Description of Artificial Sequence: Synthetic peptide
VIWNDGSNKYYADSVKG

SEQ ID NO: 15621 - DNA, 48 bp, Artificial Sequence
  Description of Artificial Sequence: Synthetic oligonucleotide
tacatctattacactgggagcacctactacaacccgtccctcaagagt

SEQ ID NO: 15622 - protein, 16 aa, Artificial Sequence
  Description of Artificial Sequence: Synthetic peptide
YIYYTGSTYYNPSLKS

SEQ ID NO: 15623 - DNA, 48 bp, Artificial Sequence
  Description of Artificial Sequence: Synthetic oligonucleotide
cggatctattccagtgggagcaccaactacaacccctccctcaagagt

SEQ ID NO: 15624 - protein, 16 aa, Artificial Sequence
  Description of Artificial Sequence: Synthetic peptide
RIYSSGSTNYNPSLKS

SEQ ID NO: 15625 - DNA, 48 bp, Artificial Sequence
  Description of Artificial Sequence: Synthetic oligonucleotide
tacatctattacagagggagtacctactacaatccgtccctcaagagt

SEQ ID NO: 15626 - protein, 16 aa, Artificial Sequence
  Description of Artificial Sequence: Synthetic peptide
YIYYRGSTYYNPSLKS

SEQ ID NO: 15627 - DNA, 48 bp, Artificial Sequence
  Description of Artificial Sequence: Synthetic oligonucleotide
tacatctattacagtgggcccacctactacaacccgtccctcaagagt

SEQ ID NO: 15628 - protein, 16 aa, Artificial Sequence
  Description of Artificial Sequence: Synthetic peptide
YIYYSGPTYYNPSLKS

SEQ ID NO: 15629 - DNA, 48 bp, Artificial Sequence
  Description of Artificial Sequence: Synthetic oligonucleotide
tatatctattacagtgggagcaccaactacaacccctccctcaagagt

SEQ ID NO: 15630 - protein, 16 aa, Artificial Sequence
  Description of Artificial Sequence: Synthetic peptide
YIYYSGSTNYNPSLKS

SEQ ID NO: 15631 - DNA, 57 bp, Artificial Sequence; identical to SEQ ID NO: 12475
  Description of Artificial Sequence: Synthetic oligonucleotide

SEQ ID NO: 15632 - protein, 19 aa, Artificial Sequence
  Description of Artificial Sequence: Synthetic peptide
RIKSKTDGGTTDYAAPVKG

SEQ ID NO: 15633 - DNA, 51 bp, Artificial Sequence; identical to SEQ ID NO: 12175
  Description of Artificial Sequence: Synthetic oligonucleotide

SEQ ID NO: 15634 - protein, 17 aa, Artificial Sequence
  Description of Artificial Sequence: Synthetic peptide
WINPYSGGTNYAQKFQG

SEQ ID NO: 15635 - DNA, 48 bp, Artificial Sequence
  Description of Artificial Sequence: Synthetic oligonucleotide
tacatctattacagtgggagcacctactacaacccgtctctcaagagt

SEQ ID NO: 15636 - protein, 16 aa, Artificial Sequence
  Description of Artificial Sequence: Synthetic peptide
YIYYSGSTYYNPSLKS

SEQ ID NO: 15637 - DNA, 51 bp, Artificial Sequence; identical to SEQ ID NO: 15587
  Description of Artificial Sequence: Synthetic oligonucleotide

SEQ ID NO: 15638 - protein, 17 aa, Artificial Sequence
  Description of Artificial Sequence: Synthetic peptide
VIWNDGSKKYHVDSVKG

SEQ ID NO: 15639 - DNA, 48 bp, Artificial Sequence
  Description of Artificial Sequence: Synthetic oligonucleotide
tacatctattacagtgggagtacctactacaacccgtccctcaagagt

SEQ ID NO: 15640 - protein, 16 aa, Artificial Sequence
  Description of Artificial Sequence: Synthetic peptide
YIYYSGSTYYNPSLKS

SEQ ID NO: 15641 - DNA, 51 bp, Artificial Sequence; identical to SEQ ID NO: 12735
  Description of Artificial Sequence: Synthetic oligonucleotide

SEQ ID NO: 15642 - protein, 17 aa, Artificial Sequence
  Description of Artificial Sequence: Synthetic peptide
VIWNDGSNKYYADSVKG

SEQ ID NO: 15643 - DNA, 51 bp, Artificial Sequence
  Description of Artificial Sequence: Synthetic oligonucleotide
tatattactagtagtggtaataccatatactacgcagactctgtgaagggc

SEQ ID NO: 15644 - protein, 17 aa, Artificial Sequence
  Description of Artificial Sequence: Synthetic peptide
YITSSGNTIYYADSVKG

SEQ ID NO: 15645 - DNA, 48 bp, Artificial Sequence
  Description of Artificial Sequence: Synthetic oligonucleotide
cgtatctatagcagtgggagcaccaactacaacccctccctcaagagt

SEQ ID NO: 15646 - protein, 16 aa, Artificial Sequence
  Description of Artificial Sequence: Synthetic peptide
RIYSSGSTNYNPSLKS

SEQ ID NO: 15647 - DNA, 51 bp, Artificial Sequence
  Description of Artificial Sequence: Synthetic oligonucleotide
tggatcaaccctaacagtggtgccacaaactatgcacagaagtttcagggc

SEQ ID NO: 15648 - protein, 17 aa, Artificial Sequence
  Description of Artificial Sequence: Synthetic peptide
WINPNSGATNYAQKFQG

SEQ ID NO: 15649 - DNA, 51 bp, Artificial Sequence
  Description of Artificial Sequence: Synthetic oligonucleotide
tggatcaacccttacagtggtggcacaaactatgcacagaagtttcaggac

SEQ ID NO: 15650 - protein, 17 aa, Artificial Sequence
  Description of Artificial Sequence: Synthetic peptide
WINPYSGGTNYAQKFQD

SEQ ID NO: 15651 - DNA, 51 bp, Artificial Sequence; identical to SEQ ID NO: 15617
  Description of Artificial Sequence: Synthetic oligonucleotide

SEQ ID NO: 15652 - protein, 17 aa, Artificial Sequence
  Description of Artificial Sequence: Synthetic peptide
WINPNSGGTNYAHKFQG

SEQ ID NO: 15653 - DNA, 51 bp, Artificial Sequence; identical to SEQ ID NO: 13449
  Description of Artificial Sequence: Synthetic oligonucleotide

SEQ ID NO: 15654 - protein, 17 aa, Artificial Sequence
  Description of Artificial Sequence: Synthetic peptide
WINPNSGGTNYAQRFQG

SEQ ID NO: 15655 - DNA, 48 bp, Artificial Sequence
  Description of Artificial Sequence: Synthetic oligonucleotide
tatgtctattacagtgggagcaccacctacaacccctccctcaagagt

SEQ ID NO: 15656 - protein, 16 aa, Artificial Sequence
  Description of Artificial Sequence: Synthetic peptide
YVYYSGSTTYNPSLKS

SEQ ID NO: 15657 - DNA, 48 bp, Artificial Sequence; identical to SEQ ID NO: 15621
  Description of Artificial Sequence: Synthetic oligonucleotide

SEQ ID NO: 15658 - protein, 16 aa, Artificial Sequence
  Description of Artificial Sequence: Synthetic peptide
YIYYTGSTYYNPSLKS

SEQ ID NO: 15659 - DNA, 51 bp, Artificial Sequence; identical to SEQ ID NO: 15617
  Description of Artificial Sequence: Synthetic oligonucleotide

SEQ ID NO: 15660 - protein, 17 aa, Artificial Sequence
  Description of Artificial Sequence: Synthetic peptide
WINPNSGGTNYAHKFQG

SEQ ID NO: 15661 - DNA, 51 bp, Artificial Sequence; identical to SEQ ID NO: 15613
  Description of Artificial Sequence: Synthetic oligonucleotide

SEQ ID NO: 15662 - protein, 17 aa, Artificial Sequence
  Description of Artificial Sequence: Synthetic peptide
VIWYDGSKKYYADSVKG

SEQ ID NO: 15663 - DNA, 48 bp, Artificial Sequence; identical to SEQ ID NO: 15603
  Description of Artificial Sequence: Synthetic oligonucleotide

SEQ ID NO: 15664 - protein, 16 aa, Artificial Sequence
  Description of Artificial Sequence: Synthetic peptide
YIYYSGITYYNPSLKS

SEQ ID NO: 15665 - DNA, 51 bp, Artificial Sequence
  Description of Artificial Sequence: Synthetic oligonucleotide
gttatttggtatgatggaagtagtaaatactatgcagactccgtgaagggc

SEQ ID NO: 15666 - protein, 17 aa, Artificial Sequence
  Description of Artificial Sequence: Synthetic peptide
VIWYDGSSKYYADSVKG

SEQ ID NO: 15667 - DNA, 48 bp, Artificial Sequence
  Description of Artificial Sequence: Synthetic oligonucleotide
tatatctattacagtgggagcaccacctacaacccctccctcaagagt

SEQ ID NO: 15668 - protein, 16 aa, Artificial Sequence
  Description of Artificial Sequence: Synthetic peptide
YIYYSGSTTYNPSLKS

SEQ ID NO: 15669 - DNA, 48 bp, Artificial Sequence; identical to SEQ ID NO: 15373
  Description of Artificial Sequence: Synthetic oligonucleotide

SEQ ID NO: 15670 - protein, 16 aa, Artificial Sequence
  Description of Artificial Sequence: Synthetic peptide
YIYYSGSTYYNPSLKS

SEQ ID NO: 15671 - DNA, 48 bp, Artificial Sequence; identical to SEQ ID NO: 15605
  Description of Artificial Sequence: Synthetic oligonucleotide

SEQ ID NO: 15672 - protein, 16 aa, Artificial Sequence
  Description of Artificial Sequence: Synthetic peptide
YIYYSGSTKYNPSLKS

SEQ ID NO: 15673 - DNA, 48 bp, Artificial Sequence; identical to SEQ ID NO: 12147
  Description of Artificial Sequence: Synthetic oligonucleotide

SEQ ID NO: 15674 - protein, 16 aa, Artificial Sequence
  Description of Artificial Sequence: Synthetic peptide
YIYYSGSTYYNPSLKS

SEQ ID NO: 15675 - DNA, 48 bp, Artificial Sequence
  Description of Artificial Sequence: Synthetic oligonucleotide
tacatctattacagagggagcacctactacaacccgtccctcaagagt

SEQ ID NO: 15676 - protein, 16 aa, Artificial Sequence
  Description of Artificial Sequence: Synthetic peptide
YIYYRGSTYYNPSLKS

SEQ ID NO: 15677 - DNA, 54 bp, Artificial Sequence
  Description of Artificial Sequence: Synthetic oligonucleotide
aggacatactacaggtccaagtggtatcatgtttatgcagtatctgtgaaaagt

SEQ ID NO: 15678 - protein, 18 aa, Artificial Sequence
  Description of Artificial Sequence: Synthetic peptide
RTYYRSKWYHVYAVSVKS

SEQ ID NO: 15679 - DNA, 51 bp, Artificial Sequence
  Description of Artificial Sequence: Synthetic oligonucleotide
attatatggtttgatggaagtaatgaatactatgcagactccgtgaagggc

SEQ ID NO: 15680 - protein, 17 aa, Artificial Sequence
  Description of Artificial Sequence: Synthetic peptide
IIWFDGSNEYYADSVKG

SEQ ID NO: 15681 - DNA, 54 bp, Artificial Sequence
  Description of Artificial Sequence: Synthetic oligonucleotide
aggacatactacaggtccaagtggtatcatgtttatgcactatctgtgaaaagt

SEQ ID NO: 15682 - protein, 18 aa, Artificial Sequence
  Description of Artificial Sequence: Synthetic peptide
RTYYRSKWYHVYALSVKS

SEQ ID NO: 15683 - DNA, 51 bp, Artificial Sequence; identical to SEQ ID NO: 15679
  Description of Artificial Sequence: Synthetic oligonucleotide

SEQ ID NO: 15684 - protein, 17 aa, Artificial Sequence
  Description of Artificial Sequence: Synthetic peptide
IIWFDGSNEYYADSVKG

SEQ ID NO: 15685 - DNA, 51 bp, Artificial Sequence; identical to SEQ ID NO: 12123
  Description of Artificial Sequence: Synthetic oligonucleotide

SEQ ID NO: 15686 - protein, 17 aa, Artificial Sequence
  Description of Artificial Sequence: Synthetic peptide
VIWYDGSNKYYADSVKG

SEQ ID NO: 15687 - DNA, 51 bp, Artificial Sequence
  Description of Artificial Sequence: Synthetic oligonucleotide
tacattagtagtagtagtagtatcaaaaagtacgcagactctgtgaagggc

SEQ ID NO: 15688 - protein, 17 aa, Artificial Sequence
  Description of Artificial Sequence: Synthetic peptide
YISSSSSIKKYADSVKG

SEQ ID NO: 15689 - DNA, 51 bp, Artificial Sequence; identical to SEQ ID NO: 12123
  Description of Artificial Sequence: Synthetic oligonucleotide

SEQ ID NO: 15690 - protein, 17 aa, Artificial Sequence
  Description of Artificial Sequence: Synthetic peptide
VIWYDGSNKYYADSVKG

SEQ ID NO: 15691 - DNA, 48 bp, Artificial Sequence
  Description of Artificial Sequence: Synthetic oligonucleotide
tacatctattacattgggaccacctactacaacccgtccctcaagagt

SEQ ID NO: 15692 - protein, 16 aa, Artificial Sequence
  Description of Artificial Sequence: Synthetic peptide
YIYYIGTTYYNPSLKS

SEQ ID NO: 15693 - DNA, 51 bp, Artificial Sequence; identical to SEQ ID NO: 12197
  Description of Artificial Sequence: Synthetic oligonucleotide

SEQ ID NO: 15694 - protein, 17 aa, Artificial Sequence
  Description of Artificial Sequence: Synthetic peptide
WINPNSGGTNYAQKFQG

SEQ ID NO: 15695 - DNA, 51 bp, Artificial Sequence; identical to SEQ ID NO: 12123
  Description of Artificial Sequence: Synthetic oligonucleotide

SEQ ID NO: 15696 - protein, 17 aa, Artificial Sequence
  Description of Artificial Sequence: Synthetic peptide
VIWYDGSNKYYADSVKG

SEQ ID NO: 15697 - DNA, 51 bp, Artificial Sequence; identical to SEQ ID NO: 12123
  Description of Artificial Sequence: Synthetic oligonucleotide

SEQ ID NO: 15698 - protein, 17 aa, Artificial Sequence
  Description of Artificial Sequence: Synthetic peptide
VIWYDGSNKYYADSVKG

SEQ ID NO: 15699 - DNA, 51 bp, Artificial Sequence; identical to SEQ ID NO: 12123
  Description of Artificial Sequence: Synthetic oligonucleotide

SEQ ID NO: 15700 - protein, 17 aa, Artificial Sequence
  Description of Artificial Sequence: Synthetic peptide
VIWYDGSNKYYADSVKG

SEQ ID NO: 15701 - DNA, 51 bp, Artificial Sequence; identical to SEQ ID NO: 12123
  Description of Artificial Sequence: Synthetic oligonucleotide

SEQ ID NO: 15702 - protein, 17 aa, Artificial Sequence
  Description of Artificial Sequence: Synthetic peptide
VIWYDGSNKYYADSVKG

SEQ ID NO: 15703 - DNA, 51 bp, Artificial Sequence
  Description of Artificial Sequence: Synthetic oligonucleotide
attatatggtttgatggaagtgatcaatactatgcagactccgtgaagggc

SEQ ID NO: 15704 - protein, 17 aa, Artificial Sequence
  Description of Artificial Sequence: Synthetic peptide
IIWFDGSDQYYADSVKG

SEQ ID NO: 15705 - DNA, 51 bp, Artificial Sequence; identical to SEQ ID NO: 12123
  Description of Artificial Sequence: Synthetic oligonucleotide

SEQ ID NO: 15706 - protein, 17 aa, Artificial Sequence
  Description of Artificial Sequence: Synthetic peptide
VIWYDGSNKYYADSVKG

SEQ ID NO: 15707 - DNA, 48 bp, Artificial Sequence
  Description of Artificial Sequence: Synthetic oligonucleotide
tacatctattacgttgggagcacctactacaacccgtccctcaagagt

SEQ ID NO: 15708 - protein, 16 aa, Artificial Sequence
  Description of Artificial Sequence: Synthetic peptide
YIYYVGSTYYNPSLKS

SEQ ID NO: 15709 - DNA, 48 bp, Artificial Sequence; identical to SEQ ID NO: 15373
  Description of Artificial Sequence: Synthetic oligonucleotide

SEQ ID NO: 15710 - protein, 16 aa, Artificial Sequence
  Description of Artificial Sequence: Synthetic peptide
YIYYSGSTYYNPSLKS

SEQ ID NO: 15711 - DNA, 48 bp, Artificial Sequence
  Description of Artificial Sequence: Synthetic oligonucleotide
tacatctattacactgggagcaactactacaacccgtccctcaagagt

SEQ ID NO: 15712 - protein, 16 aa, Artificial Sequence
  Description of Artificial Sequence: Synthetic peptide
YIYYTGSNYYNPSLKS

SEQ ID NO: 15713 - DNA, 51 bp, Artificial Sequence; identical to SEQ ID NO: 12123
  Description of Artificial Sequence: Synthetic oligonucleotide

SEQ ID NO: 15714 - protein, 17 aa, Artificial Sequence
  Description of Artificial Sequence: Synthetic peptide
VIWYDGSNKYYADSVKG

SEQ ID NO: 15715 - DNA, 51 bp, Artificial Sequence; identical to SEQ ID NO: 12123
  Description of Artificial Sequence: Synthetic oligonucleotide

SEQ ID NO: 15716 - protein, 17 aa, Artificial Sequence
  Description of Artificial Sequence: Synthetic peptide
VIWYDGSNKYYADSVKG

SEQ ID NO: 15717 - DNA, 51 bp, Artificial Sequence
  Description of Artificial Sequence: Synthetic oligonucleotide
gttatatggtatgatggaagtaataaatactatgcggactccgtgaagggc

SEQ ID NO: 15718 - protein, 17 aa, Artificial Sequence
  Description of Artificial Sequence: Synthetic peptide
VIWYDGSNKYYADSVKG

SEQ ID NO: 15719 - DNA, 51 bp, Artificial Sequence
  Description of Artificial Sequence: Synthetic oligonucleotide
gttatatggtatgatggaagtaataaatactgtgcagactccgtgaagggc

SEQ ID NO: 15720 - protein, 17 aa, Artificial Sequence
  Description of Artificial Sequence: Synthetic peptide
VIWYDGSNKYCADSVKG

SEQ ID NO: 15721 - DNA, 48 bp, Artificial Sequence
  Description of Artificial Sequence: Synthetic oligonucleotide
tatatgtattacagtgggagcacctactacaacccgtccctcaagagt

SEQ ID NO: 15722 - protein, 16 aa, Artificial Sequence
  Description of Artificial Sequence: Synthetic peptide
YMYYSGSTYYNPSLKS

SEQ ID NO: 15723 - DNA, 48 bp, Artificial Sequence; identical to SEQ ID NO: 12147
  Description of Artificial Sequence: Synthetic oligonucleotide

SEQ ID NO: 15724 - protein, 16 aa, Artificial Sequence
  Description of Artificial Sequence: Synthetic peptide
YIYYSGSTYYNPSLKS

SEQ ID NO: 15725 - DNA, 51 bp, Artificial Sequence; identical to SEQ ID NO: 12123
  Description of Artificial Sequence: Synthetic oligonucleotide

SEQ ID NO: 15726 - protein, 17 aa, Artificial Sequence
  Description of Artificial Sequence: Synthetic peptide
VIWYDGSNKYYADSVKG

SEQ ID NO: 15727 - DNA, 51 bp, Artificial Sequence; identical to SEQ ID NO: 12123
  Description of Artificial Sequence: Synthetic oligonucleotide

SEQ ID NO: 15728 - protein, 17 aa, Artificial Sequence
  Description of Artificial Sequence: Synthetic peptide
VIWYDGSNKYYADSVKG

SEQ ID NO: 15729 - DNA, 48 bp, Artificial Sequence; identical to SEQ ID NO: 15373
  Description of Artificial Sequence: Synthetic oligonucleotide

SEQ ID NO: 15730 - protein, 16 aa, Artificial Sequence
  Description of Artificial Sequence: Synthetic peptide
YIYYSGSTYYNPSLKS

SEQ ID NO: 15731 - DNA, 51 bp, Artificial Sequence
  Description of Artificial Sequence: Synthetic oligonucleotide
tggatcaaccctaagaatggtggcacaaactatgcacagaagtttcagggc

SEQ ID NO: 15732 - protein, 17 aa, Artificial Sequence
  Description of Artificial Sequence: Synthetic peptide
WINPKNGGTNYAQKFQG

SEQ ID NO: 15733 - DNA, 48 bp, Artificial Sequence; identical to SEQ ID NO: 12147
  Description of Artificial Sequence: Synthetic oligonucleotide

SEQ ID NO: 15734 - protein, 16 aa, Artificial Sequence
  Description of Artificial Sequence: Synthetic peptide
YIYYSGSTYYNPSLKS

SEQ ID NO: 15735 - DNA, 48 bp, Artificial Sequence
  Description of Artificial Sequence: Synthetic oligonucleotide
tacatctatttcagtgggagcacctactacaacccgtccctcaagagt

SEQ ID NO: 15736 - protein, 16 aa, Artificial Sequence
  Description of Artificial Sequence: Synthetic peptide
YIYFSGSTYYNPSLKS

SEQ ID NO: 15737 - DNA, 48 bp, Artificial Sequence; identical to SEQ ID NO: 15627
  Description of Artificial Sequence: Synthetic oligonucleotide

SEQ ID NO: 15738 - protein, 16 aa, Artificial Sequence
  Description of Artificial Sequence: Synthetic peptide
YIYYSGPTYYNPSLKS

SEQ ID NO: 15739 - DNA, 48 bp, Artificial Sequence; identical to SEQ ID NO: 15711
  Description of Artificial Sequence: Synthetic oligonucleotide

SEQ ID NO: 15740 - protein, 16 aa, Artificial Sequence
  Description of Artificial Sequence: Synthetic peptide
YIYYTGSNYYNPSLKS

SEQ ID NO: 15741 - DNA, 57 bp, Artificial Sequence
  Description of Artificial Sequence: Synthetic oligonucleotide
cgtattaaaagcaaaactaatggtgggacaacagactacgctgcacccgtgaaaggc

SEQ ID NO: 15742 - protein, 19 aa, Artificial Sequence
  Description of Artificial Sequence: Synthetic peptide
RIKSKTNGGTTDYAAPVKG

SEQ ID NO: 15743 - DNA, 51 bp, Artificial Sequence
  Description of Artificial Sequence: Synthetic oligonucleotide
gttatatggtatgatggaagtaatgagtactatgcagactccgtgaagggc

SEQ ID NO: 15744 - protein, 17 aa, Artificial Sequence
  Description of Artificial Sequence: Synthetic peptide
VIWYDGSNEYYADSVKG

SEQ ID NO: 15745 - DNA, 48 bp, Artificial Sequence; identical to SEQ ID NO: 15721
  Description of Artificial Sequence: Synthetic oligonucleotide

SEQ ID NO: 15746 - protein, 16 aa, Artificial Sequence
  Description of Artificial Sequence: Synthetic peptide
YMYYSGSTYYNPSLKS

SEQ ID NO: 15747 - DNA, 51 bp, Artificial Sequence; identical to SEQ ID NO: 12123
  Description of Artificial Sequence: Synthetic oligonucleotide

SEQ ID NO: 15748 - protein, 17 aa, Artificial Sequence
  Description of Artificial Sequence: Synthetic peptide
VIWYDGSNKYYADSVKG

SEQ ID NO: 15749 - DNA, 48 bp, Artificial Sequence; identical to SEQ ID NO: 15721
  Description of Artificial Sequence: Synthetic oligonucleotide

SEQ ID NO: 15750 - protein, 16 aa, Artificial Sequence
  Description of Artificial Sequence: Synthetic peptide
YMYYSGSTYYNPSLKS

SEQ ID NO: 15751 - DNA, 48 bp, Artificial Sequence; identical to SEQ ID NO: 15627
  Description of Artificial Sequence: Synthetic oligonucleotide

SEQ ID NO: 15752 - protein, 16 aa, Artificial Sequence
  Description of Artificial Sequence: Synthetic peptide
YIYYSGPTYYNPSLKS

SEQ ID NO: 15753 - DNA, 51 bp, Artificial Sequence; identical to SEQ ID NO: 12123
  Description of Artificial Sequence: Synthetic oligonucleotide

SEQ ID NO: 15754 - protein, 17 aa, Artificial Sequence
  Description of Artificial Sequence: Synthetic peptide
VIWYDGSNKYYADSVKG

SEQ ID NO: 15755 - DNA, 51 bp, Artificial Sequence; identical to SEQ ID NO: 12123
  Description of Artificial Sequence: Synthetic oligonucleotide

SEQ ID NO: 15756 - protein, 17 aa, Artificial Sequence
  Description of Artificial Sequence: Synthetic peptide
VIWYDGSNKYYADSVKG

SEQ ID NO: 15757 - DNA, 51 bp, Artificial Sequence
  Description of Artificial Sequence: Synthetic oligonucleotide
attatatggtttgatggaagtgatgaatactatgcagactccgtgaagggc

SEQ ID NO: 15758 - protein, 17 aa, Artificial Sequence
  Description of Artificial Sequence: Synthetic peptide
IIWFDGSDEYYADSVKG

SEQ ID NO: 15759 - DNA, 51 bp, Artificial Sequence
  Description of Artificial Sequence: Synthetic oligonucleotide
attatatggtttgatggaagtgatcagtactatgcagactccgtgaagggc

SEQ ID NO: 15760 - protein, 17 aa, Artificial Sequence
  Description of Artificial Sequence: Synthetic peptide
IIWFDGSDQYYADSVKG

SEQ ID NO: 15761 - DNA, 51 bp, Artificial Sequence; identical to SEQ ID NO: 12123
  Description of Artificial Sequence: Synthetic oligonucleotide

SEQ ID NO: 15762 - protein, 17 aa, Artificial Sequence
  Description of Artificial Sequence: Synthetic peptide
VIWYDGSNKYYADSVKG

SEQ ID NO: 15763 - DNA, 51 bp, Artificial Sequence; identical to SEQ ID NO: 15757
  Description of Artificial Sequence: Synthetic oligonucleotide

SEQ ID NO: 15764 - protein, 17 aa, Artificial Sequence
  Description of Artificial Sequence: Synthetic peptide
IIWFDGSDEYYADSVKG

SEQ ID NO: 15765 - DNA, 51 bp, Artificial Sequence; identical to SEQ ID NO: 13585
  Description of Artificial Sequence: Synthetic oligonucleotide

SEQ ID NO: 15766 - protein, 17 aa, Artificial Sequence
  Description of Artificial Sequence: Synthetic peptide
VIWYDGSNKYYADSVKG

SEQ ID NO: 15767 - DNA, 51 bp, Artificial Sequence; identical to SEQ ID NO: 12123
  Description of Artificial Sequence: Synthetic oligonucleotide

SEQ ID NO: 15768 - protein, 17 aa, Artificial Sequence
  Description of Artificial Sequence: Synthetic peptide
VIWYDGSNKYYADSVKG

SEQ ID NO: 15769 - DNA, 51 bp, Artificial Sequence; identical to SEQ ID NO: 12123
  Description of Artificial Sequence: Synthetic oligonucleotide

SEQ ID NO: 15770 - protein, 17 aa, Artificial Sequence
  Description of Artificial Sequence: Synthetic peptide
VIWYDGSNKYYADSVKG

SEQ ID NO: 15771 - DNA, 54 bp, Artificial Sequence; identical to SEQ ID NO: 12237
  Description of Artificial Sequence: Synthetic oligonucleotide

SEQ ID NO: 15772 - protein, 18 aa, Artificial Sequence
  Description of Artificial Sequence: Synthetic peptide
RTYYRSKWYNDYAVSVKS

SEQ ID NO: 15773 - DNA, 51 bp, Artificial Sequence
  Description of Artificial Sequence: Synthetic oligonucleotide
tggatcaaccctaaaaatggtggcacaaactatgcacagaagtttcagggc

SEQ ID NO: 15774 - protein, 17 aa, Artificial Sequence
  Description of Artificial Sequence: Synthetic peptide
WINPKNGGTNYAQKFQG

SEQ ID NO: 15775 - DNA, 51 bp, Artificial Sequence; identical to SEQ ID NO: 12123
  Description of Artificial Sequence: Synthetic oligonucleotide

SEQ ID NO: 15776 - protein, 17 aa, Artificial Sequence
  Description of Artificial Sequence: Synthetic peptide
VIWYDGSNKYYADSVKG

SEQ ID NO: 15777 - DNA, 51 bp, Artificial Sequence
  Description of Artificial Sequence: Synthetic oligonucleotide
gttatgtggtatgatggaggtaataaagactatgcagactccgtgaagggc

SEQ ID NO: 15778 - protein, 17 aa, Artificial Sequence
  Description of Artificial Sequence: Synthetic peptide
VMWYDGGNKDYADSVKG

SEQ ID NO: 15779 - DNA, 51 bp, Artificial Sequence; identical to SEQ ID NO: 15291
  Description of Artificial Sequence: Synthetic oligonucleotide

SEQ ID NO: 15780 - protein, 17 aa, Artificial Sequence
  Description of Artificial Sequence: Synthetic peptide
WINPNSGDTNYAQKFQG

SEQ ID NO: 15781 - DNA, 51 bp, Artificial Sequence
  Description of Artificial Sequence: Synthetic oligonucleotide
tggatcaaccctaacagtggaggcacaaactatgcacagaagtttcaggac

SEQ ID NO: 15782 - protein, 17 aa, Artificial Sequence
  Description of Artificial Sequence: Synthetic peptide
WINPNSGGTNYAQKFQD

SEQ ID NO: 15783 - DNA, 51 bp, Artificial Sequence
  Description of Artificial Sequence: Synthetic oligonucleotide
tggatcaaccctaacagtggtggcacaaactatgcacggaagtttcagggc

SEQ ID NO: 15784 - protein, 17 aa, Artificial Sequence
  Description of Artificial Sequence: Synthetic peptide
WINPNSGGTNYARKFQG

SEQ ID NO: 15785 - DNA, 51 bp, Artificial Sequence; identical to SEQ ID NO: 15291
  Description of Artificial Sequence: Synthetic oligonucleotide

SEQ ID NO: 15786 - protein, 17 aa, Artificial Sequence
  Description of Artificial Sequence: Synthetic peptide
WINPNSGDTNYAQKFQG

SEQ ID NO: 15787 - DNA, 51 bp, Artificial Sequence
  Description of Artificial Sequence: Synthetic oligonucleotide
tggatcaaccctaagagtggtggcacaaactttgcacagaagtttcagggc

SEQ ID NO: 15788 - protein, 17 aa, Artificial Sequence
  Description of Artificial Sequence: Synthetic peptide
WINPKSGGTNFAQKFQG

SEQ ID NO: 15789 - DNA, 51 bp, Artificial Sequence; identical to SEQ ID NO: 12421
  Description of Artificial Sequence: Synthetic oligonucleotide

SEQ ID NO: 15790 - protein, 17 aa, Artificial Sequence
  Description of Artificial Sequence: Synthetic peptide
AISGSGGSTYYADSVKG

SEQ ID NO: 15791 - DNA, 51 bp, Artificial Sequence
  Description of Artificial Sequence: Synthetic oligonucleotide
tggatcaaccctaagagtggtggcacaaactatgcacagaagtttcagggc

SEQ ID NO: 15792 - protein, 17 aa, Artificial Sequence
  Description of Artificial Sequence: Synthetic peptide
WINPKSGGTNYAQKFQG

SEQ ID NO: 15793 - DNA, 48 bp, Artificial Sequence; identical to SEQ ID NO: 12209
  Description of Artificial Sequence: Synthetic oligonucleotide

SEQ ID NO: 15794 - protein, 16 aa, Artificial Sequence
  Description of Artificial Sequence: Synthetic peptide
LIYWNDDKVYSPSLKS

SEQ ID NO: 15795 - DNA, 51 bp, Artificial Sequence; identical to SEQ ID NO: 12619
  Description of Artificial Sequence: Synthetic oligonucleotide

SEQ ID NO: 15796 - protein, 17 aa, Artificial Sequence
  Description of Artificial Sequence: Synthetic peptide
AISGRGGNTFYADSVKG

SEQ ID NO: 15797 - DNA, 51 bp, Artificial Sequence; identical to SEQ ID NO: 13333
  Description of Artificial Sequence: Synthetic oligonucleotide

SEQ ID NO: 15798 - protein, 17 aa, Artificial Sequence
  Description of Artificial Sequence: Synthetic peptide
TMSGSGGRTYYADSVNG

SEQ ID NO: 15799 - DNA, 51 bp, Artificial Sequence; identical to SEQ ID NO: 12701
  Description of Artificial Sequence: Synthetic oligonucleotide

SEQ ID NO: 15800 - protein, 17 aa, Artificial Sequence
  Description of Artificial Sequence: Synthetic peptide
SISGSSTYIYYADSVKG

SEQ ID NO: 15801 - DNA, 51 bp, Artificial Sequence; identical to SEQ ID NO: 12277
  Description of Artificial Sequence: Synthetic oligonucleotide

SEQ ID NO: 15802 - protein, 17 aa, Artificial Sequence
  Description of Artificial Sequence: Synthetic peptide
SISGSSTDIYYADSVKG

SEQ ID NO: 15803 - DNA, 51 bp, Artificial Sequence
  Description of Artificial Sequence: Synthetic oligonucleotide
tctattagtagtagtactggttacatatacaacgcagactcagtgaagggc

SEQ ID NO: 15804 - protein, 17 aa, Artificial Sequence
  Description of Artificial Sequence: Synthetic peptide
SISSSTGYIYNADSVKG

SEQ ID NO: 15805 - DNA, 51 bp, Artificial Sequence; identical to SEQ ID NO: 13377
  Description of Artificial Sequence: Synthetic oligonucleotide

SEQ ID NO: 15806 - protein, 17 aa, Artificial Sequence
  Description of Artificial Sequence: Synthetic peptide
AISGSGGNTFYADSVKG

SEQ ID NO: 15807 - DNA, 51 bp, Artificial Sequence; identical to SEQ ID NO: 12361
  Description of Artificial Sequence: Synthetic oligonucleotide

SEQ ID NO: 15808 - protein, 17 aa, Artificial Sequence
  Description of Artificial Sequence: Synthetic peptide
SISSSSSYIYYADSVKG

SEQ ID NO: 15809 - DNA, 51 bp, Artificial Sequence
  Description of Artificial Sequence: Synthetic oligonucleotide
gctattagtggtagtggtgctaacacattctacgcagactccgtgaagggc

SEQ ID NO: 15810 - protein, 17 aa, Artificial Sequence
  Description of Artificial Sequence: Synthetic peptide
AISGSGANTFYADSVKG

SEQ ID NO: 15811 - DNA, 51 bp, Artificial Sequence; identical to SEQ ID NO: 13081
  Description of Artificial Sequence: Synthetic oligonucleotide

SEQ ID NO: 15812 - protein, 17 aa, Artificial Sequence
  Description of Artificial Sequence: Synthetic peptide
WINPNNNGTNYAQKFQG

SEQ ID NO: 15813 - DNA, 48 bp, Artificial Sequence; identical to SEQ ID NO: 13749
  Description of Artificial Sequence: Synthetic oligonucleotide

SEQ ID NO: 15814 - protein, 16 aa, Artificial Sequence
  Description of Artificial Sequence: Synthetic peptide
EINHSGDTNYNPSLKS

SEQ ID NO: 15815 - DNA, 51 bp, Artificial Sequence; identical to SEQ ID NO: 15289
  Description of Artificial Sequence: Synthetic oligonucleotide

SEQ ID NO: 15816 - protein, 17 aa, Artificial Sequence
  Description of Artificial Sequence: Synthetic peptide
VISGGGSSTYYADSVKG

SEQ ID NO: 15817 - DNA, 51 bp, Artificial Sequence; identical to SEQ ID NO: 15279
  Description of Artificial Sequence: Synthetic oligonucleotide

SEQ ID NO: 15818 - protein, 17 aa, Artificial Sequence
  Description of Artificial Sequence: Synthetic peptide
VISGGGSSTYYADSVKG

SEQ ID NO: 15819 - DNA, 51 bp, Artificial Sequence
  Description of Artificial Sequence: Synthetic oligonucleotide
tttatatggtatgatggaagtgagaactactatgcagactccgtgaagggc

SEQ ID NO: 15820 - protein, 17 aa, Artificial Sequence
  Description of Artificial Sequence: Synthetic peptide
FIWYDGSENYYADSVKG

SEQ ID NO: 15821 - DNA, 51 bp, Artificial Sequence; identical to SEQ ID NO: 15819
  Description of Artificial Sequence: Synthetic oligonucleotide

SEQ ID NO: 15822 - protein, 17 aa, Artificial Sequence
  Description of Artificial Sequence: Synthetic peptide
FIWYDGSENYYADSVKG

SEQ ID NO: 15823 - DNA, 51 bp, Artificial Sequence
  Description of Artificial Sequence: Synthetic oligonucleotide
gttatatggtatggtggaagtgatacagactatgcagactccgtgaggggc

SEQ ID NO: 15824 - protein, 17 aa, Artificial Sequence
  Description of Artificial Sequence: Synthetic peptide
VIWYGGSDTDYADSVRG

SEQ ID NO: 15825 - DNA, 51 bp, Artificial Sequence
  Description of Artificial Sequence: Synthetic oligonucleotide
tggatcaagcctaaaagcggtggcacaaactgtgcacagaagtttcagggc

SEQ ID NO: 15826 - protein, 17 aa, Artificial Sequence
  Description of Artificial Sequence: Synthetic peptide
WIKPKSGGTNCAQKFQG

SEQ ID NO: 15827 - DNA, 51 bp, Artificial Sequence
  Description of Artificial Sequence: Synthetic oligonucleotide
tacattagcagtagtggtagtaccaaatactacgcagactctgtggagggc

SEQ ID NO: 15828 - protein, 17 aa, Artificial Sequence
  Description of Artificial Sequence: Synthetic peptide
YISSSGSTKYYADSVEG

SEQ ID NO: 15829 - DNA, 51 bp, Artificial Sequence; identical to SEQ ID NO: 14445
  Description of Artificial Sequence: Synthetic oligonucleotide

SEQ ID NO: 15830 - protein, 17 aa, Artificial Sequence
  Description of Artificial Sequence: Synthetic peptide
WIKPKSGGTNSAQRFQG

SEQ ID NO: 15831 - DNA, 51 bp, Artificial Sequence; identical to SEQ ID NO: 14445
  Description of Artificial Sequence: Synthetic oligonucleotide

SEQ ID NO: 15832 - protein, 17 aa, Artificial Sequence
  Description of Artificial Sequence: Synthetic peptide
WIKPKSGGTNSAQRFQG

SEQ ID NO: 15833 - DNA, 51 bp, Artificial Sequence; identical to SEQ ID NO: 14581
  Description of Artificial Sequence: Synthetic oligonucleotide

SEQ ID NO: 15834 - protein, 17 aa, Artificial Sequence
  Description of Artificial Sequence: Synthetic peptide
IIWFDGSNKYYADSVKG

SEQ ID NO: 15835 - DNA, 51 bp, Artificial Sequence
  Description of Artificial Sequence: Synthetic oligonucleotide
tggatcaagcctaaaagtggtggcacaaactgtgcacagaagtttcagggc

SEQ ID NO: 15836 - protein, 17 aa, Artificial Sequence
  Description of Artificial Sequence: Synthetic peptide
WIKPKSGGTNCAQKFQG

SEQ ID NO: 15837 - DNA, 51 bp, Artificial Sequence
  Description of Artificial Sequence: Synthetic oligonucleotide
gttatatggtatgatggaagtaatagaaactatgcagactccgtgaagggc

SEQ ID NO: 15838 - protein, 17 aa, Artificial Sequence
  Description of Artificial Sequence: Synthetic peptide
VIWYDGSNRNYADSVKG

SEQ ID NO: 15839 - DNA, 51 bp, Artificial Sequence
  Description of Artificial Sequence: Synthetic oligonucleotide
gttatatggtatgatggaggtaatacacattatacagactccgtgaagggc

SEQ ID NO: 15840 - protein, 17 aa, Artificial Sequence
  Description of Artificial Sequence: Synthetic peptide
VIWYDGGNTHYTDSVKG

SEQ ID NO: 15841 - DNA, 51 bp, Artificial Sequence; identical to SEQ ID NO: 12421
  Description of Artificial Sequence: Synthetic oligonucleotide

SEQ ID NO: 15842 - protein, 17 aa, Artificial Sequence
  Description of Artificial Sequence: Synthetic peptide
AISGSGGSTYYADSVKG

SEQ ID NO: 15843 - DNA, 51 bp, Artificial Sequence; identical to SEQ ID NO: 12133
  Description of Artificial Sequence: Synthetic oligonucleotide

SEQ ID NO: 15844 - protein, 17 aa, Artificial Sequence
  Description of Artificial Sequence: Synthetic peptide
VIWYDGSNKYYVDSVKG

SEQ ID NO: 15845 - DNA, 51 bp, Artificial Sequence; identical to SEQ ID NO: 12133
  Description of Artificial Sequence: Synthetic oligonucleotide

SEQ ID NO: 15846 - protein, 17 aa, Artificial Sequence
  Description of Artificial Sequence: Synthetic peptide
VIWYDGSNKYYVDSVKG

SEQ ID NO: 15847 - DNA, 48 bp, Artificial Sequence; identical to SEQ ID NO: 12147
  Description of Artificial Sequence: Synthetic oligonucleotide

SEQ ID NO: 15848 - protein, 16 aa, Artificial Sequence
  Description of Artificial Sequence: Synthetic peptide
YIYYSGSTYYNPSLKS

SEQ ID NO: 15849 - DNA, 51 bp, Artificial Sequence
  Description of Artificial Sequence: Synthetic oligonucleotide
attatatcatatagtggaagtaataaatactatgcagactccgtgaagggc

SEQ ID NO: 15850 - protein, 17 aa, Artificial Sequence
  Description of Artificial Sequence: Synthetic peptide
IISYSGSNKYYADSVKG

SEQ ID NO: 15851 - DNA, 48 bp, Artificial Sequence; identical to SEQ ID NO: 13749
  Description of Artificial Sequence: Synthetic oligonucleotide

SEQ ID NO: 15852 - protein, 16 aa, Artificial Sequence
  Description of Artificial Sequence: Synthetic peptide
EINHSGDTNYNPSLKS

SEQ ID NO: 15853 - DNA, 51 bp, Artificial Sequence; identical to SEQ ID NO: 12161
  Description of Artificial Sequence: Synthetic oligonucleotide

SEQ ID NO: 15854 - protein, 17 aa, Artificial Sequence
  Description of Artificial Sequence: Synthetic peptide
WMHPNSGNTGYAQKFQG

SEQ ID NO: 15855 - DNA, 48 bp, Artificial Sequence; identical to SEQ ID NO: 13715
  Description of Artificial Sequence: Synthetic oligonucleotide

SEQ ID NO: 15856 - protein, 16 aa, Artificial Sequence
  Description of Artificial Sequence: Synthetic peptide
EINHSGSTNYNPSLKS

SEQ ID NO: 15857 - DNA, 51 bp, Artificial Sequence; identical to SEQ ID NO: 13645
  Description of Artificial Sequence: Synthetic oligonucleotide

SEQ ID NO: 15858 - protein, 17 aa, Artificial Sequence
  Description of Artificial Sequence: Synthetic peptide
VIWYDGSDKYYADSVKG

SEQ ID NO: 15859 - DNA, 48 bp, Artificial Sequence; identical to SEQ ID NO: 13715
  Description of Artificial Sequence: Synthetic oligonucleotide

SEQ ID NO: 15860 - protein, 16 aa, Artificial Sequence
  Description of Artificial Sequence: Synthetic peptide
EINHSGSTNYNPSLKS

SEQ ID NO: 15861 - DNA, 48 bp, Artificial Sequence; identical to SEQ ID NO: 13715
  Description of Artificial Sequence: Synthetic oligonucleotide

SEQ ID NO: 15862 - protein, 16 aa, Artificial Sequence
  Description of Artificial Sequence: Synthetic peptide
EINHSGSTNYNPSLKS

SEQ ID NO: 15863 - DNA, 48 bp, Artificial Sequence; identical to SEQ ID NO: 12761
  Description of Artificial Sequence: Synthetic oligonucleotide

SEQ ID NO: 15864 - protein, 16 aa, Artificial Sequence
  Description of Artificial Sequence: Synthetic peptide
LIYWDDDKRYSPSLKS

SEQ ID NO: 15865 - DNA, 48 bp, Artificial Sequence; identical to SEQ ID NO: 13731
  Description of Artificial Sequence: Synthetic oligonucleotide

SEQ ID NO: 15866 - protein, 16 aa, Artificial Sequence
  Description of Artificial Sequence: Synthetic peptide
EINHSGRTNYNPSLKS

SEQ ID NO: 15867 - DNA, 48 bp, Artificial Sequence; identical to SEQ ID NO: 13715
  Description of Artificial Sequence: Synthetic oligonucleotide

SEQ ID NO: 15868 - protein, 16 aa, Artificial Sequence
  Description of Artificial Sequence: Synthetic peptide
EINHSGSTNYNPSLKS

SEQ ID NO: 15869 - DNA, 48 bp, Artificial Sequence; identical to SEQ ID NO: 12165
  Description of Artificial Sequence: Synthetic oligonucleotide

SEQ ID NO: 15870 - protein, 16 aa, Artificial Sequence
  Description of Artificial Sequence: Synthetic peptide
SIYYSGSAYSNPSLKS

SEQ ID NO: 15871 - DNA, 48 bp, Artificial Sequence; identical to SEQ ID NO: 13715
  Description of Artificial Sequence: Synthetic oligonucleotide

SEQ ID NO: 15872 - protein, 16 aa, Artificial Sequence
  Description of Artificial Sequence: Synthetic peptide
EINHSGSTNYNPSLKS

SEQ ID NO: 15873 - DNA, 51 bp, Artificial Sequence; identical to SEQ ID NO: 12103
  Description of Artificial Sequence: Synthetic oligonucleotide

SEQ ID NO: 15874 - protein, 17 aa, Artificial Sequence
  Description of Artificial Sequence: Synthetic peptide
WMNPNSGNTGYAQKFQG

SEQ ID NO: 15875 - DNA, 51 bp, Artificial Sequence
  Description of Artificial Sequence: Synthetic oligonucleotide
tggatgaaccctgacagtggtaacacaggctttgcacagaagttccagggc

SEQ ID NO: 15876 - protein, 17 aa, Artificial Sequence
  Description of Artificial Sequence: Synthetic peptide
WMNPDSGNTGFAQKFQG

SEQ ID NO: 15877 - DNA, 51 bp, Artificial Sequence
  Description of Artificial Sequence: Synthetic oligonucleotide
tggatgaaccctaacagtggtaacataggctatgcacagaagttccagggc

SEQ ID NO: 15878 - protein, 17 aa, Artificial Sequence
  Description of Artificial Sequence: Synthetic peptide
WMNPNSGNIGYAQKFQG

SEQ ID NO: 15879 - DNA, 48 bp, Artificial Sequence; identical to SEQ ID NO: 13715
  Description of Artificial Sequence: Synthetic oligonucleotide

SEQ ID NO: 15880 - protein, 16 aa, Artificial Sequence
  Description of Artificial Sequence: Synthetic peptide
EINHSGSTNYNPSLKS

SEQ ID NO: 15881 - DNA, 48 bp, Artificial Sequence; identical to SEQ ID NO: 13761
  Description of Artificial Sequence: Synthetic oligonucleotide

SEQ ID NO: 15882 - protein, 16 aa, Artificial Sequence
  Description of Artificial Sequence: Synthetic peptide
AIGTAGDTYYPGSVKG

SEQ ID NO: 15883 - DNA, 48 bp, Artificial Sequence; identical to SEQ ID NO: 12761
  Description of Artificial Sequence: Synthetic oligonucleotide

SEQ ID NO: 15884 - protein, 16 aa, Artificial Sequence
  Description of Artificial Sequence: Synthetic peptide
LIYWDDDKRYSPSLKS

SEQ ID NO: 15885 - DNA, 51 bp, Artificial Sequence; identical to SEQ ID NO: 13701
  Description of Artificial Sequence: Synthetic oligonucleotide

SEQ ID NO: 15886 - protein, 17 aa, Artificial Sequence
  Description of Artificial Sequence: Synthetic peptide
WMHPNSGNTGFAQKFQG

SEQ ID NO: 15887 - DNA, 57 bp, Artificial Sequence; identical to SEQ ID NO: 12475
  Description of Artificial Sequence: Synthetic oligonucleotide

SEQ ID NO: 15888 - protein, 19 aa, Artificial Sequence
  Description of Artificial Sequence: Synthetic peptide
RIKSKTDGGTTDYAAPVKG

SEQ ID NO: 15889 - DNA, 51 bp, Artificial Sequence; identical to SEQ ID NO: 12123
  Description of Artificial Sequence: Synthetic oligonucleotide

SEQ ID NO: 15890 - protein, 17 aa, Artificial Sequence
  Description of Artificial Sequence: Synthetic peptide
VIWYDGSNKYYADSVKG

SEQ ID NO: 15891 - DNA, 51 bp, Artificial Sequence
  Description of Artificial Sequence: Synthetic oligonucleotide
tggatgtaccctaacagtggtagcacaggctatgcacagaaattccagggc

SEQ ID NO: 15892 - protein, 17 aa, Artificial Sequence
  Description of Artificial Sequence: Synthetic peptide
WMYPNSGSTGYAQKFQG

SEQ ID NO: 15893 - DNA, 51 bp, Artificial Sequence
  Description of Artificial Sequence: Synthetic oligonucleotide
tggatgtaccctaacagtggtaacgcaggctatgcacagaaattccagggc

SEQ ID NO: 15894 - protein, 17 aa, Artificial Sequence
  Description of Artificial Sequence: Synthetic peptide
WMYPNSGNAGYAQKFQG

SEQ ID NO: 15895 - DNA, 51 bp, Artificial Sequence
  Description of Artificial Sequence: Synthetic oligonucleotide
tggatgtaccctaacagtggtaacgtaggctatgcacagaaattccagggc

SEQ ID NO: 15896 - protein, 17 aa, Artificial Sequence
  Description of Artificial Sequence: Synthetic peptide
WMYPNSGNVGYAQKFQG

SEQ ID NO: 15897 - DNA, 51 bp, Artificial Sequence
  Description of Artificial Sequence: Synthetic oligonucleotide
tggatgtaccctaacagtggtcaaacaggctatgcacagaaattccagggc

SEQ ID NO: 15898 - protein, 17 aa, Artificial Sequence
  Description of Artificial Sequence: Synthetic peptide
WMYPNSGQTGYAQKFQG

SEQ ID NO: 15899 - DNA, 51 bp, Artificial Sequence; identical to SEQ ID NO: 15891
  Description of Artificial Sequence: Synthetic oligonucleotide

SEQ ID NO: 15900 - protein, 17 aa, Artificial Sequence
  Description of Artificial Sequence: Synthetic peptide
WMYPNSGSTGYAQKFQG

SEQ ID NO: 15901 - DNA, 51 bp, Artificial Sequence; identical to SEQ ID NO: 15893
  Description of Artificial Sequence: Synthetic oligonucleotide

SEQ ID NO: 15902 - protein, 17 aa, Artificial Sequence
  Description of Artificial Sequence: Synthetic peptide
WMYPNSGNAGYAQKFQG

SEQ ID NO: 15903 - DNA, 51 bp, Artificial Sequence; identical to SEQ ID NO: 15895
  Description of Artificial Sequence: Synthetic oligonucleotide

SEQ ID NO: 15904 - protein, 17 aa, Artificial Sequence
  Description of Artificial Sequence: Synthetic peptide
WMYPNSGNVGYAQKFQG

SEQ ID NO: 15905 - DNA, 51 bp, Artificial Sequence; identical to SEQ ID NO: 15897
  Description of Artificial Sequence: Synthetic oligonucleotide

SEQ ID NO: 15906 - protein, 17 aa, Artificial Sequence
  Description of Artificial Sequence: Synthetic peptide
WMYPNSGQTGYAQKFQG

SEQ ID NO: 15907 - DNA, 51 bp, Artificial Sequence; identical to SEQ ID NO: 15891
  Description of Artificial Sequence: Synthetic oligonucleotide

SEQ ID NO: 15908 - protein, 17 aa, Artificial Sequence
  Description of Artificial Sequence: Synthetic peptide
WMYPNSGSTGYAQKFQG

SEQ ID NO: 15909 - DNA, 51 bp, Artificial Sequence; identical to SEQ ID NO: 15891
  Description of Artificial Sequence: Synthetic oligonucleotide

SEQ ID NO: 15910 - protein, 17 aa, Artificial Sequence
  Description of Artificial Sequence: Synthetic peptide
WMYPNSGSTGYAQKFQG

SEQ ID NO: 15911 - DNA, 51 bp, Artificial Sequence; identical to SEQ ID NO: 15897
  Description of Artificial Sequence: Synthetic oligonucleotide

SEQ ID NO: 15912 - protein, 17 aa, Artificial Sequence
  Description of Artificial Sequence: Synthetic peptide
WMYPNSGQTGYAQKFQG

SEQ ID NO: 15913 - DNA, 51 bp, Artificial Sequence; identical to SEQ ID NO: 15893
  Description of Artificial Sequence: Synthetic oligonucleotide

SEQ ID NO: 15914 - protein, 17 aa, Artificial Sequence
  Description of Artificial Sequence: Synthetic peptide
WMYPNSGNAGYAQKFQG

SEQ ID NO: 15915 - DNA, 51 bp, Artificial Sequence; identical to SEQ ID NO: 12161
  Description of Artificial Sequence: Synthetic oligonucleotide

SEQ ID NO: 15916 - protein, 17 aa, Artificial Sequence
  Description of Artificial Sequence: Synthetic peptide
WMHPNSGNTGYAQKFQG

SEQ ID NO: 15917 - DNA, 51 bp, Artificial Sequence; identical to SEQ ID NO: 12161
  Description of Artificial Sequence: Synthetic oligonucleotide

SEQ ID NO: 15918 - protein, 17 aa, Artificial Sequence
  Description of Artificial Sequence: Synthetic peptide
WMHPNSGNTGYAQKFQG

SEQ ID NO: 15919 - DNA, 51 bp, Artificial Sequence; identical to SEQ ID NO: 12161
  Description of Artificial Sequence: Synthetic oligonucleotide

SEQ ID NO: 15920 - protein, 17 aa, Artificial Sequence
  Description of Artificial Sequence: Synthetic peptide
WMHPNSGNTGYAQKFQG

SEQ ID NO: 15921 - DNA, 51 bp, Artificial Sequence
  Description of Artificial Sequence: Synthetic oligonucleotide
tggatgcaccctaacagtggtaacgcaggctatgcacagaagttccagggc

SEQ ID NO: 15922 - protein, 17 aa, Artificial Sequence
  Description of Artificial Sequence: Synthetic peptide
WMHPNSGNAGYAQKFQG

SEQ ID NO: 15923 - DNA, 51 bp, Artificial Sequence; identical to SEQ ID NO: 13491
  Description of Artificial Sequence: Synthetic oligonucleotide

SEQ ID NO: 15924 - protein, 17 aa, Artificial Sequence
  Description of Artificial Sequence: Synthetic peptide
WMHPNSGSTGYAQKFQG

SEQ ID NO: 15925 - DNA, 51 bp, Artificial Sequence
  Description of Artificial Sequence: Synthetic oligonucleotide
tggatgcaccctaacagtggtcaaacaggctatgcacagaagttccagggc

SEQ ID NO: 15926 - protein, 17 aa, Artificial Sequence
  Description of Artificial Sequence: Synthetic peptide
WMHPNSGQTGYAQKFQG

SEQ ID NO: 15927 - DNA, 51 bp, Artificial Sequence; identical to SEQ ID NO: 15925
  Description of Artificial Sequence: Synthetic oligonucleotide

SEQ ID NO: 15928 - protein, 17 aa, Artificial Sequence
  Description of Artificial Sequence: Synthetic peptide
WMHPNSGQTGYAQKFQG

SEQ ID NO: 15929 - DNA, 51 bp, Artificial Sequence; identical to SEQ ID NO: 15921
  Description of Artificial Sequence: Synthetic oligonucleotide

SEQ ID NO: 15930 - protein, 17 aa, Artificial Sequence
  Description of Artificial Sequence: Synthetic peptide
WMHPNSGNAGYAQKFQG

SEQ ID NO: 15931 - DNA, 51 bp, Artificial Sequence; identical to SEQ ID NO: 15925
  Description of Artificial Sequence: Synthetic oligonucleotide

SEQ ID NO: 15932 - protein, 17 aa, Artificial Sequence
  Description of Artificial Sequence: Synthetic peptide
WMHPNSGQTGYAQKFQG

SEQ ID NO: 15933 - DNA, 51 bp, Artificial Sequence; identical to SEQ ID NO: 15921
  Description of Artificial Sequence: Synthetic oligonucleotide

SEQ ID NO: 15934 - protein, 17 aa, Artificial Sequence
  Description of Artificial Sequence: Synthetic peptide
WMHPNSGNAGYAQKFQG

SEQ ID NO: 15935 - DNA, 51 bp, Artificial Sequence; identical to SEQ ID NO: 15925
  Description of Artificial Sequence: Synthetic oligonucleotide

SEQ ID NO: 15936 - protein, 17 aa, Artificial Sequence
  Description of Artificial Sequence: Synthetic peptide
WMHPNSGQTGYAQKFQG

SEQ ID NO: 15937 - DNA, 51 bp, Artificial Sequence; identical to SEQ ID NO: 13491
  Description of Artificial Sequence: Synthetic oligonucleotide

SEQ ID NO: 15938 - protein, 17 aa, Artificial Sequence
  Description of Artificial Sequence: Synthetic peptide
WMHPNSGSTGYAQKFQG

SEQ ID NO: 15939 - DNA, 51 bp, Artificial Sequence; identical to SEQ ID NO: 12161
  Description of Artificial Sequence: Synthetic oligonucleotide

SEQ ID NO: 15940 - protein, 17 aa, Artificial Sequence
  Description of Artificial Sequence: Synthetic peptide
WMHPNSGNTGYAQKFQG

SEQ ID NO: 15941 - DNA, 51 bp, Artificial Sequence; identical to SEQ ID NO: 12161
  Description of Artificial Sequence: Synthetic oligonucleotide

SEQ ID NO: 15942 - protein, 17 aa, Artificial Sequence
  Description of Artificial Sequence: Synthetic peptide
WMHPNSGNTGYAQKFQG

SEQ ID NO: 15943 - DNA, 51 bp, Artificial Sequence; identical to SEQ ID NO: 15925
  Description of Artificial Sequence: Synthetic oligonucleotide

SEQ ID NO: 15944 - protein, 17 aa, Artificial Sequence
  Description of Artificial Sequence: Synthetic peptide
WMHPNSGQTGYAQKFQG

SEQ ID NO: 15945 - DNA, 51 bp, Artificial Sequence; identical to SEQ ID NO: 15925
  Description of Artificial Sequence: Synthetic oligonucleotide

SEQ ID NO: 15946 - protein, 17 aa, Artificial Sequence
  Description of Artificial Sequence: Synthetic peptide
WMHPNSGQTGYAQKFQG

SEQ ID NO: 15947 - DNA, 51 bp, Artificial Sequence; identical to SEQ ID NO: 13491
  Description of Artificial Sequence: Synthetic oligonucleotide

SEQ ID NO: 15948 - protein, 17 aa, Artificial Sequence
  Description of Artificial Sequence: Synthetic peptide
WMHPNSGSTGYAQKFQG

SEQ ID NO: 15949 - DNA, 51 bp, Artificial Sequence
  Description of Artificial Sequence: Synthetic oligonucleotide
tggatgcaccctaacagtggtaacgaaggctatgcacagaagttccagggc

SEQ ID NO: 15950 - protein, 17 aa, Artificial Sequence
  Description of Artificial Sequence: Synthetic peptide
WMHPNSGNEGYAQKFQG

SEQ ID NO: 15951 - DNA, 51 bp, Artificial Sequence; identical to SEQ ID NO: 12189
  Description of Artificial Sequence: Synthetic oligonucleotide

SEQ ID NO: 15952 - protein, 17 aa, Artificial Sequence
  Description of Artificial Sequence: Synthetic peptide
WIHPNSGGTNYAQKFQG

SEQ ID NO: 15953 - DNA, 51 bp, Artificial Sequence; identical to SEQ ID NO: 12189
  Description of Artificial Sequence: Synthetic oligonucleotide

SEQ ID NO: 15954 - protein, 17 aa, Artificial Sequence
  Description of Artificial Sequence: Synthetic peptide
WIHPNSGGTNYAQKFQG

SEQ ID NO: 15955 - DNA, 51 bp, Artificial Sequence; identical to SEQ ID NO: 12189
  Description of Artificial Sequence: Synthetic oligonucleotide

SEQ ID NO: 15956 - protein, 17 aa, Artificial Sequence
  Description of Artificial Sequence: Synthetic peptide
WIHPNSGGTNYAQKFQG

SEQ ID NO: 15957 - DNA, 51 bp, Artificial Sequence; identical to SEQ ID NO: 12189
  Description of Artificial Sequence: Synthetic oligonucleotide

SEQ ID NO: 15958 - protein, 17 aa, Artificial Sequence
  Description of Artificial Sequence: Synthetic peptide
WIHPNSGGTNYAQKFQG

SEQ ID NO: 15959 - DNA, 51 bp, Artificial Sequence; identical to SEQ ID NO: 12189
  Description of Artificial Sequence: Synthetic oligonucleotide

SEQ ID NO: 15960 - protein, 17 aa, Artificial Sequence
  Description of Artificial Sequence: Synthetic peptide
WIHPNSGGTNYAQKFQG

SEQ ID NO: 15961 - DNA, 51 bp, Artificial Sequence; identical to SEQ ID NO: 12189
  Description of Artificial Sequence: Synthetic oligonucleotide

SEQ ID NO: 15962 - protein, 17 aa, Artificial Sequence
  Description of Artificial Sequence: Synthetic peptide
WIHPNSGGTNYAQKFQG

SEQ ID NO: 15963 - DNA, 51 bp, Artificial Sequence; identical to SEQ ID NO: 12189
  Description of Artificial Sequence: Synthetic oligonucleotide

SEQ ID NO: 15964 - protein, 17 aa, Artificial Sequence
  Description of Artificial Sequence: Synthetic peptide
WIHPNSGGTNYAQKFQG

SEQ ID NO: 15965 - DNA, 51 bp, Artificial Sequence; identical to SEQ ID NO: 12189
  Description of Artificial Sequence: Synthetic oligonucleotide

SEQ ID NO: 15966 - protein, 17 aa, Artificial Sequence
  Description of Artificial Sequence: Synthetic peptide
WIHPNSGGTNYAQKFQG

SEQ ID NO: 15967 - DNA, 51 bp, Artificial Sequence
  Description of Artificial Sequence: Synthetic oligonucleotide
gttatctggtatgatgcaagtaataaatactatgcagactccgtgaagggc

SEQ ID NO: 15968 - protein, 17 aa, Artificial Sequence
  Description of Artificial Sequence: Synthetic peptide
VIWYDASNKYYADSVKG

SEQ ID NO: 15969 - DNA, 51 bp, Artificial Sequence
  Description of Artificial Sequence: Synthetic oligonucleotide
gttatctggtatgatggaagtaataaatactatgcagaatccgtgaagggc

SEQ ID NO: 15970 - protein, 17 aa, Artificial Sequence
  Description of Artificial Sequence: Synthetic peptide
VIWYDGSNKYYAESVKG

SEQ ID NO: 15971 - DNA, 51 bp, Artificial Sequence
  Description of Artificial Sequence: Synthetic oligonucleotide
gttatctggtatgatggaagtaataaatactatgcaggctccgtgaagggc

SEQ ID NO: 15972 - protein, 17 aa, Artificial Sequence
  Description of Artificial Sequence: Synthetic peptide
VIWYDGSNKYYAGSVKG

SEQ ID NO: 15973 - DNA, 51 bp, Artificial Sequence
  Description of Artificial Sequence: Synthetic oligonucleotide
gttatctggtatgatggaagtaataaatactatgcagacgccgtgaagggc

SEQ ID NO: 15974 - protein, 17 aa, Artificial Sequence
  Description of Artificial Sequence: Synthetic peptide
VIWYDGSNKYYADAVKG

SEQ ID NO: 15975 - DNA, 51 bp, Artificial Sequence
  Description of Artificial Sequence: Synthetic oligonucleotide
gttatctggtatgatgcaagtaataaatactatgcagaatccgtgaagggc

SEQ ID NO: 15976 - protein, 17 aa, Artificial Sequence
  Description of Artificial Sequence: Synthetic peptide
VIWYDASNKYYAESVKG

SEQ ID NO: 15977 - DNA, 51 bp, Artificial Sequence
  Description of Artificial Sequence: Synthetic oligonucleotide
gttatctggtatgatgcaagtaataaatactatgcagacgccgtgaagggc

SEQ ID NO: 15978 - protein, 17 aa, Artificial Sequence
  Description of Artificial Sequence: Synthetic peptide
VIWYDASNKYYADAVKG

SEQ ID NO: 15979 - DNA, 51 bp, Artificial Sequence; identical to SEQ ID NO: 15967
  Description of Artificial Sequence: Synthetic oligonucleotide

SEQ ID NO: 15980 - protein, 17 aa, Artificial Sequence
  Description of Artificial Sequence: Synthetic peptide
VIWYDASNKYYADSVKG

SEQ ID NO: 15981 - DNA, 51 bp, Artificial Sequence; identical to SEQ ID NO: 15967
  Description of Artificial Sequence: Synthetic oligonucleotide

SEQ ID NO: 15982 - protein, 17 aa, Artificial Sequence
  Description of Artificial Sequence: Synthetic peptide
VIWYDASNKYYADSVKG

SEQ ID NO: 15983 - DNA, 51 bp, Artificial Sequence; identical to SEQ ID NO: 15969
  Description of Artificial Sequence: Synthetic oligonucleotide

SEQ ID NO: 15984 - protein, 17 aa, Artificial Sequence
  Description of Artificial Sequence: Synthetic peptide
VIWYDGSNKYYAESVKG

SEQ ID NO: 15985 - DNA, 51 bp, Artificial Sequence
  Description of Artificial Sequence: Synthetic oligonucleotide
gttatctggtatgatggaagtaataaatactatgcagactccgtgaagggc

SEQ ID NO: 15986 - protein, 17 aa, Artificial Sequence
  Description of Artificial Sequence: Synthetic peptide
VIWYDGSNKYYADSVKG

SEQ ID NO: 15987 - DNA, 51 bp, Artificial Sequence; identical to SEQ ID NO: 15985
  Description of Artificial Sequence: Synthetic oligonucleotide

SEQ ID NO: 15988 - protein, 17 aa, Artificial Sequence
  Description of Artificial Sequence: Synthetic peptide
VIWYDGSNKYYADSVKG

SEQ ID NO: 15989 - DNA, 51 bp, Artificial Sequence; identical to SEQ ID NO: 15975
  Description of Artificial Sequence: Synthetic oligonucleotide

SEQ ID NO: 15990 - protein, 17 aa, Artificial Sequence
  Description of Artificial Sequence: Synthetic peptide
VIWYDASNKYYAESVKG

SEQ ID NO: 15991 - DNA, 51 bp, Artificial Sequence; identical to SEQ ID NO: 15977
  Description of Artificial Sequence: Synthetic oligonucleotide

SEQ ID NO: 15992 - protein, 17 aa, Artificial Sequence
  Description of Artificial Sequence: Synthetic peptide
VIWYDASNKYYADAVKG

SEQ ID NO: 15993 - DNA, 51 bp, Artificial Sequence; identical to SEQ ID NO: 15969
  Description of Artificial Sequence: Synthetic oligonucleotide

SEQ ID NO: 15994 - protein, 17 aa, Artificial Sequence
  Description of Artificial Sequence: Synthetic peptide
VIWYDGSNKYYAESVKG

SEQ ID NO: 15995 - DNA, 51 bp, Artificial Sequence; identical to SEQ ID NO: 13159
  Description of Artificial Sequence: Synthetic oligonucleotide

SEQ ID NO: 15996 - protein, 17 aa, Artificial Sequence
  Description of Artificial Sequence: Synthetic peptide
IIWHDGSNKYYADSVKG

SEQ ID NO: 15997 - DNA, 51 bp, Artificial Sequence; identical to SEQ ID NO: 13159
  Description of Artificial Sequence: Synthetic oligonucleotide

SEQ ID NO: 15998 - protein, 17 aa, Artificial Sequence
  Description of Artificial Sequence: Synthetic peptide
IIWHDGSNKYYADSVKG

SEQ ID NO: 15999 - DNA, 51 bp, Artificial Sequence
  Description of Artificial Sequence: Synthetic oligonucleotide
attatctggcatagtggaagtaataaatactatgcagactccgtgaagggc

SEQ ID NO: 16000 - protein, 17 aa, Artificial Sequence
  Description of Artificial Sequence: Synthetic peptide
IIWHSGSNKYYADSVKG

SEQ ID NO: 16001 - DNA, 51 bp, Artificial Sequence
  Description of Artificial Sequence: Synthetic oligonucleotide
attatctggcatgaaggaagtaataaatactatgcagactccgtgaagggc

SEQ ID NO: 16002 - protein, 17 aa, Artificial Sequence
  Description of Artificial Sequence: Synthetic peptide
IIWHEGSNKYYADSVKG

SEQ ID NO: 16003 - DNA, 51 bp, Artificial Sequence
  Description of Artificial Sequence: Synthetic oligonucleotide
attatctggcatgatgcaagtaataaatactatgcagactccgtgaagggc

SEQ ID NO: 16004 - protein, 17 aa, Artificial Sequence
  Description of Artificial Sequence: Synthetic peptide
IIWHDASNKYYADSVKG

SEQ ID NO: 16005 - DNA, 51 bp, Artificial Sequence
  Description of Artificial Sequence: Synthetic oligonucleotide
attatctggcatgatggaagtaataaatactatgcagaatccgtgaagggc

SEQ ID NO: 16006 - protein, 17 aa, Artificial Sequence
  Description of Artificial Sequence: Synthetic peptide
IIWHDGSNKYYAESVKG

SEQ ID NO: 16007 - DNA, 51 bp, Artificial Sequence
  Description of Artificial Sequence: Synthetic oligonucleotide
attatctggcatgatggaagtaataaatactatgcagacgccgtgaagggc

SEQ ID NO: 16008 - protein, 17 aa, Artificial Sequence
  Description of Artificial Sequence: Synthetic peptide
IIWHDGSNKYYADAVKG

SEQ ID NO: 16009 - DNA, 51 bp, Artificial Sequence
  Description of Artificial Sequence: Synthetic oligonucleotide
attatctggcatgaaggaagtaataaatactatgcagacgccgtgaagggc

SEQ ID NO: 16010 - protein, 17 aa, Artificial Sequence
  Description of Artificial Sequence: Synthetic peptide
IIWHEGSNKYYADAVKG

SEQ ID NO: 16011 - DNA, 51 bp, Artificial Sequence
  Description of Artificial Sequence: Synthetic oligonucleotide
attatctggcatgaaggaagtaataaatactatgcagaatccgtgaagggc

SEQ ID NO: 16012 - protein, 17 aa, Artificial Sequence
  Description of Artificial Sequence: Synthetic peptide
IIWHEGSNKYYAESVKG

SEQ ID NO: 16013 - DNA, 51 bp, Artificial Sequence
  Description of Artificial Sequence: Synthetic oligonucleotide
attatctggcatagtggaagtaataaatactatgcagaatccgtgaagggc

SEQ ID NO: 16014 - protein, 17 aa, Artificial Sequence
  Description of Artificial Sequence: Synthetic peptide
IIWHSGSNKYYAESVKG

SEQ ID NO: 16015 - DNA, 51 bp, Artificial Sequence
  Description of Artificial Sequence: Synthetic oligonucleotide
attatctggcatagtggaagtaataaatactatgcagacgccgtgaagggc

SEQ ID NO: 16016 - protein, 17 aa, Artificial Sequence
  Description of Artificial Sequence: Synthetic peptide
IIWHSGSNKYYADAVKG

SEQ ID NO: 16017 - DNA, 51 bp, Artificial Sequence; identical to SEQ ID NO: 15999
  Description of Artificial Sequence: Synthetic oligonucleotide

SEQ ID NO: 16018 - protein, 17 aa, Artificial Sequence
  Description of Artificial Sequence: Synthetic peptide
IIWHSGSNKYYADSVKG

SEQ ID NO: 16019 - DNA, 51 bp, Artificial Sequence; identical to SEQ ID NO: 16005
  Description of Artificial Sequence: Synthetic oligonucleotide

SEQ ID NO: 16020 - protein, 17 aa, Artificial Sequence
  Description of Artificial Sequence: Synthetic peptide
IIWHDGSNKYYAESVKG

SEQ ID NO: 16021 - DNA, 51 bp, Artificial Sequence; identical to SEQ ID NO: 16013
  Description of Artificial Sequence: Synthetic oligonucleotide

SEQ ID NO: 16022 - protein, 17 aa, Artificial Sequence
  Description of Artificial Sequence: Synthetic peptide
IIWHSGSNKYYAESVKG

SEQ ID NO: 16023 - DNA, 51 bp, Artificial Sequence; identical to SEQ ID NO: 15999
  Description of Artificial Sequence: Synthetic oligonucleotide

SEQ ID NO: 16024 - protein, 17 aa, Artificial Sequence
  Description of Artificial Sequence: Synthetic peptide
IIWHSGSNKYYADSVKG

SEQ ID NO: 16025 - DNA, 51 bp, Artificial Sequence; identical to SEQ ID NO: 16013
  Description of Artificial Sequence: Synthetic oligonucleotide

SEQ ID NO: 16026 - protein, 17 aa, Artificial Sequence
  Description of Artificial Sequence: Synthetic peptide
IIWHSGSNKYYAESVKG

SEQ ID NO: 16027 - DNA, 51 bp, Artificial Sequence; identical to SEQ ID NO: 16009
  Description of Artificial Sequence: Synthetic oligonucleotide

SEQ ID NO: 16028 - protein, 17 aa, Artificial Sequence
  Description of Artificial Sequence: Synthetic peptide
IIWHEGSNKYYADAVKG

SEQ ID NO: 16029 - DNA, 51 bp, Artificial Sequence
  Description of Artificial Sequence: Synthetic oligonucleotide
attatctggcatgatgcaagtaataaatactatgcagaatccgtgaagggc

SEQ ID NO: 16030 - protein, 17 aa, Artificial Sequence
  Description of Artificial Sequence: Synthetic peptide
IIWHDASNKYYAESVKG

SEQ ID NO: 16031 - DNA, 51 bp, Artificial Sequence; identical to SEQ ID NO: 16005
  Description of Artificial Sequence: Synthetic oligonucleotide

SEQ ID NO: 16032 - protein, 17 aa, Artificial Sequence
  Description of Artificial Sequence: Synthetic peptide
IIWHDGSNKYYAESVKG

SEQ ID NO: 16033 - DNA, 51 bp, Artificial Sequence; identical to SEQ ID NO: 16013
  Description of Artificial Sequence: Synthetic oligonucleotide

SEQ ID NO: 16034 - protein, 17 aa, Artificial Sequence
  Description of Artificial Sequence: Synthetic peptide
IIWHSGSNKYYAESVKG

SEQ ID NO: 16035 - DNA, 51 bp, Artificial Sequence; identical to SEQ ID NO: 16011
  Description of Artificial Sequence: Synthetic oligonucleotide

SEQ ID NO: 16036 - protein, 17 aa, Artificial Sequence
  Description of Artificial Sequence: Synthetic peptide
IIWHEGSNKYYAESVKG

SEQ ID NO: 16037 - DNA, 48 bp, Artificial Sequence; identical to SEQ ID NO: 14117
  Description of Artificial Sequence: Synthetic oligonucleotide

SEQ ID NO: 16038 - protein, 16 aa, Artificial Sequence
  Description of Artificial Sequence: Synthetic peptide
YSYYSGSTYYNPSLKS

SEQ ID NO: 16039 - DNA, 51 bp, Artificial Sequence; identical to SEQ ID NO: 12197
  Description of Artificial Sequence: Synthetic oligonucleotide

SEQ ID NO: 16040 - protein, 17 aa, Artificial Sequence
  Description of Artificial Sequence: Synthetic peptide
WINPNSGGTNYAQKFQG

SEQ ID NO: 16041 - DNA, 51 bp, Artificial Sequence; identical to SEQ ID NO: 12197
  Description of Artificial Sequence: Synthetic oligonucleotide

SEQ ID NO: 16042 - protein, 17 aa, Artificial Sequence
  Description of Artificial Sequence: Synthetic peptide
WINPNSGGTNYAQKFQG

SEQ ID NO: 16043 - DNA, 51 bp, Artificial Sequence; identical to SEQ ID NO: 15897
  Description of Artificial Sequence: Synthetic oligonucleotide

SEQ ID NO: 16044 - protein, 17 aa, Artificial Sequence
  Description of Artificial Sequence: Synthetic peptide
WMYPNSGQTGYAQKFQG

SEQ ID NO: 16045 - DNA, 51 bp, Artificial Sequence; identical to SEQ ID NO: 12189
  Description of Artificial Sequence: Synthetic oligonucleotide

SEQ ID NO: 16046 - protein, 17 aa, Artificial Sequence
  Description of Artificial Sequence: Synthetic peptide
WIHPNSGGTNYAQKFQG

SEQ ID NO: 16047 - DNA, 51 bp, Artificial Sequence
  Description of Artificial Sequence: Synthetic oligonucleotide
attatctggcatgatgcaagtaataaatactatgcagacgccgtgaagggc

SEQ ID NO: 16048 - protein, 17 aa, Artificial Sequence
  Description of Artificial Sequence: Synthetic peptide
IIWHDASNKYYADAVKG

SEQ ID NO: 16049 - DNA, 51 bp, Artificial Sequence; identical to SEQ ID NO: 13865
  Description of Artificial Sequence: Synthetic oligonucleotide

SEQ ID NO: 16050 - protein, 17 aa, Artificial Sequence
  Description of Artificial Sequence: Synthetic peptide
WMNPNSGNTGYAQKFQV

SEQ ID NO: 16051 - DNA, 51 bp, Artificial Sequence; identical to SEQ ID NO: 12103
  Description of Artificial Sequence: Synthetic oligonucleotide

SEQ ID NO: 16052 - protein, 17 aa, Artificial Sequence
  Description of Artificial Sequence: Synthetic peptide
WMNPNSGNTGYAQKFQG

SEQ ID NO: 16053 - DNA, 51 bp, Artificial Sequence; identical to SEQ ID NO: 12361
  Description of Artificial Sequence: Synthetic oligonucleotide

SEQ ID NO: 16054 - protein, 17 aa, Artificial Sequence
  Description of Artificial Sequence: Synthetic peptide
SISSSSSYIYYADSVKG

SEQ ID NO: 16055 - DNA, 51 bp, Artificial Sequence; identical to SEQ ID NO: 12153
  Description of Artificial Sequence: Synthetic oligonucleotide

SEQ ID NO: 16056 - protein, 17 aa, Artificial Sequence
  Description of Artificial Sequence: Synthetic peptide
SISGSSSYIYYADSVKG

SEQ ID NO: 16057 - DNA, 51 bp, Artificial Sequence
  Description of Artificial Sequence: Synthetic oligonucleotide
gttatatcacaagatggaattattagatactatgcagactccgtgaagggc

SEQ ID NO: 16058 - protein, 17 aa, Artificial Sequence
  Description of Artificial Sequence: Synthetic peptide
VISQDGIIRYYADSVKG

SEQ ID NO: 16059 - DNA, 51 bp, Artificial Sequence
  Description of Artificial Sequence: Synthetic oligonucleotide
gttatatcatatgatggaagtaataaatattatgcagactccgtgaagggc

SEQ ID NO: 16060 - protein, 17 aa, Artificial Sequence
  Description of Artificial Sequence: Synthetic peptide
VISYDGSNKYYADSVKG

SEQ ID NO: 16061 - DNA, 51 bp, Artificial Sequence; identical to SEQ ID NO: 15451
  Description of Artificial Sequence: Synthetic oligonucleotide

SEQ ID NO: 16062 - protein, 17 aa, Artificial Sequence
  Description of Artificial Sequence: Synthetic peptide
WISAYNGNTKYAQKLQG

SEQ ID NO: 16063 - DNA, 51 bp, Artificial Sequence
  Description of Artificial Sequence: Synthetic oligonucleotide
tggatcagcgcttataatggtaacacaaagaatgcacagaagctccagggc

SEQ ID NO: 16064 - protein, 17 aa, Artificial Sequence
  Description of Artificial Sequence: Synthetic peptide
WISAYNGNTKNAQKLQG

SEQ ID NO: 16065 - DNA, 51 bp, Artificial Sequence
  Description of Artificial Sequence: Synthetic oligonucleotide
tggatcagcgcttataatggtaacacaaagtttgcacagaagctccagggc

SEQ ID NO: 16066 - protein, 17 aa, Artificial Sequence
  Description of Artificial Sequence: Synthetic peptide
WISAYNGNTKFAQKLQG

SEQ ID NO: 16067 - DNA, 51 bp, Artificial Sequence; identical to SEQ ID NO: 15537
  Description of Artificial Sequence: Synthetic oligonucleotide

SEQ ID NO: 16068 - protein, 17 aa, Artificial Sequence
  Description of Artificial Sequence: Synthetic peptide
VIWYDGNNKSYADSVKG

SEQ ID NO: 16069 - DNA, 51 bp, Artificial Sequence; identical to SEQ ID NO: 12197
  Description of Artificial Sequence: Synthetic oligonucleotide

SEQ ID NO: 16070 - protein, 17 aa, Artificial Sequence
  Description of Artificial Sequence: Synthetic peptide
WINPNSGGTNYAQKFQG

SEQ ID NO: 16071 - DNA, 51 bp, Artificial Sequence; identical to SEQ ID NO: 12123
  Description of Artificial Sequence: Synthetic oligonucleotide

SEQ ID NO: 16072 - protein, 17 aa, Artificial Sequence
  Description of Artificial Sequence: Synthetic peptide
VIWYDGSNKYYADSVKG

SEQ ID NO: 16073 - DNA, 51 bp, Artificial Sequence; identical to SEQ ID NO: 12161
  Description of Artificial Sequence: Synthetic oligonucleotide

SEQ ID NO: 16074 - protein, 17 aa, Artificial Sequence
  Description of Artificial Sequence: Synthetic peptide
WMHPNSGNTGYAQKFQG

SEQ ID NO: 16075 - DNA, 48 bp, Artificial Sequence
  Description of Artificial Sequence: Synthetic oligonucleotide
tatatctattacagtgggaccaccatttacaacccctccctcaagagt

SEQ ID NO: 16076 - protein, 16 aa, Artificial Sequence
  Description of Artificial Sequence: Synthetic peptide
YIYYSGTTIYNPSLKS

SEQ ID NO: 16077 - DNA, 51 bp, Artificial Sequence; identical to SEQ ID NO: 14605
  Description of Artificial Sequence: Synthetic oligonucleotide

SEQ ID NO: 16078 - protein, 17 aa, Artificial Sequence
  Description of Artificial Sequence: Synthetic peptide
VIWYDGSNEHYADSVKG

SEQ ID NO: 16079 - DNA, 48 bp, Artificial Sequence; identical to SEQ ID NO: 13715
  Description of Artificial Sequence: Synthetic oligonucleotide

SEQ ID NO: 16080 - protein, 16 aa, Artificial Sequence
  Description of Artificial Sequence: Synthetic peptide
EINHSGSTNYNPSLKS

SEQ ID NO: 16081 - DNA, 51 bp, Artificial Sequence; identical to SEQ ID NO: 12161
  Description of Artificial Sequence: Synthetic oligonucleotide

SEQ ID NO: 16082 - protein, 17 aa, Artificial Sequence
  Description of Artificial Sequence: Synthetic peptide
WMHPNSGNTGYAQKFQG

SEQ ID NO: 16083 - DNA, 51 bp, Artificial Sequence; identical to SEQ ID NO: 12161
  Description of Artificial Sequence: Synthetic oligonucleotide

SEQ ID NO: 16084 - protein, 17 aa, Artificial Sequence
  Description of Artificial Sequence: Synthetic peptide
WMHPNSGNTGYAQKFQG

SEQ ID NO: 16085 - DNA, 51 bp, Artificial Sequence; identical to SEQ ID NO: 13701
  Description of Artificial Sequence: Synthetic oligonucleotide

SEQ ID NO: 16086 - protein, 17 aa, Artificial Sequence
  Description of Artificial Sequence: Synthetic peptide
WMHPNSGNTGFAQKFQG

SEQ ID NO: 16087 - DNA, 51 bp, Artificial Sequence
  Description of Artificial Sequence: Synthetic oligonucleotide
tggatgcaccctcacagtggtaacacaggctatgcacagaagttccagggc

SEQ ID NO: 16088 - protein, 17 aa, Artificial Sequence
  Description of Artificial Sequence: Synthetic peptide
WMHPHSGNTGYAQKFQG

SEQ ID NO: 16089 - DNA, 51 bp, Artificial Sequence; identical to SEQ ID NO: 12103
  Description of Artificial Sequence: Synthetic oligonucleotide

SEQ ID NO: 16090 - protein, 17 aa, Artificial Sequence
  Description of Artificial Sequence: Synthetic peptide
WMNPNSGNTGYAQKFQG

SEQ ID NO: 16091 - DNA, 51 bp, Artificial Sequence
  Description of Artificial Sequence: Synthetic oligonucleotide
tggctgaaccctcacagtggtaacacaggctatgcacagaagttccagggc

SEQ ID NO: 16092 - protein, 17 aa, Artificial Sequence
  Description of Artificial Sequence: Synthetic peptide
WLNPHSGNTGYAQKFQG

SEQ ID NO: 16093 - DNA, 51 bp, Artificial Sequence; identical to SEQ ID NO: 16091
  Description of Artificial Sequence: Synthetic oligonucleotide

SEQ ID NO: 16094 - protein, 17 aa, Artificial Sequence
  Description of Artificial Sequence: Synthetic peptide
WLNPHSGNTGYAQKFQG

SEQ ID NO: 16095 - DNA, 51 bp, Artificial Sequence; identical to SEQ ID NO: 13377
  Description of Artificial Sequence: Synthetic oligonucleotide

SEQ ID NO: 16096 - protein, 17 aa, Artificial Sequence
  Description of Artificial Sequence: Synthetic peptide
AISGSGGNTFYADSVKG

SEQ ID NO: 16097 - DNA, 51 bp, Artificial Sequence; identical to SEQ ID NO: 16091
  Description of Artificial Sequence: Synthetic oligonucleotide

SEQ ID NO: 16098 - protein, 17 aa, Artificial Sequence
  Description of Artificial Sequence: Synthetic peptide
WLNPHSGNTGYAQKFQG

SEQ ID NO: 16099 - DNA, 51 bp, Artificial Sequence; identical to SEQ ID NO: 12103
  Description of Artificial Sequence: Synthetic oligonucleotide

SEQ ID NO: 16100 - protein, 17 aa, Artificial Sequence
  Description of Artificial Sequence: Synthetic peptide
WMNPNSGNTGYAQKFQG

SEQ ID NO: 16101 - DNA, 51 bp, Artificial Sequence; identical to SEQ ID NO: 13377
  Description of Artificial Sequence: Synthetic oligonucleotide

SEQ ID NO: 16102 - protein, 17 aa, Artificial Sequence
  Description of Artificial Sequence: Synthetic peptide
AISGSGGNTFYADSVKG

SEQ ID NO: 16103 - DNA, 27 bp, Artificial Sequence
  Description of Artificial Sequence: Synthetic oligonucleotide
caacagagtgacagtttccctctcact

SEQ ID NO: 16104 - protein, 9 aa, Artificial Sequence
  Description of Artificial Sequence: Synthetic peptide
QQSDSFPLT

SEQ ID NO: 16105 - DNA, 27 bp, Artificial Sequence
  Description of Artificial Sequence: Synthetic oligonucleotide
cagcaatattatagtattcctcccact

SEQ ID NO: 16106 - protein, 9 aa, Artificial Sequence
  Description of Artificial Sequence: Synthetic peptide
QQYYSIPPT

SEQ ID NO: 16107 - DNA, 27 bp, Artificial Sequence
  Description of Artificial Sequence: Synthetic oligonucleotide
cagcaatatcatagttctcctccgacg

SEQ ID NO: 16108 - protein, 9 aa, Artificial Sequence
  Description of Artificial Sequence: Synthetic peptide
QQYHSSPPT

SEQ ID NO: 16109 - DNA, 27 bp, Artificial Sequence
  Description of Artificial Sequence: Synthetic oligonucleotide
atgcaaagtaaacagcttcctctcact

SEQ ID NO: 16110 - protein, 9 aa, Artificial Sequence
  Description of Artificial Sequence: Synthetic peptide
MQSKQLPLT

SEQ ID NO: 16111 - DNA, 27 bp, Artificial Sequence
  Description of Artificial Sequence: Synthetic oligonucleotide
caacagtatagttgttacccattcact

SEQ ID NO: 16112 - protein, 9 aa, Artificial Sequence
  Description of Artificial Sequence: Synthetic peptide
QQYSCYPFT

SEQ ID NO: 16113 - DNA, 30 bp, Artificial Sequence
  Description of Artificial Sequence: Synthetic oligonucleotide
caggcgtgggacaggaacacttatgtggtg

SEQ ID NO: 16114 - protein, 10 aa, Artificial Sequence
  Description of Artificial Sequence: Synthetic peptide
QAWDRNTYVV

SEQ ID NO: 16115 - DNA, 27 bp, Artificial Sequence
  Description of Artificial Sequence: Synthetic oligonucleotide
caacagggtaacattttcccattcact

SEQ ID NO: 16116 - protein, 9 aa, Artificial Sequence
  Description of Artificial Sequence: Synthetic peptide
QQGNIFPFT

SEQ ID NO: 16117 - DNA, 27 bp, Artificial Sequence
  Description of Artificial Sequence: Synthetic oligonucleotide
ctacagtataatagttaccctcccacc

SEQ ID NO: 16118 - protein, 9 aa, Artificial Sequence
  Description of Artificial Sequence: Synthetic peptide
LQYNSYPPT

SEQ ID NO: 16119 - DNA, 27 bp, Artificial Sequence
  Description of Artificial Sequence: Synthetic oligonucleotide
caacaggctaacagtttcccattcact

SEQ ID NO: 16120 - protein, 9 aa, Artificial Sequence
  Description of Artificial Sequence: Synthetic peptide
QQANSFPFT

SEQ ID NO: 16121 - DNA, 27 bp, Artificial Sequence
  Description of Artificial Sequence: Synthetic oligonucleotide
caacaggctaacagtttcccattcact

SEQ ID NO: 16122 - protein, 9 aa, Artificial Sequence
  Description of Artificial Sequence: Synthetic peptide
QQANSFPFT

SEQ ID NO: 16123 - DNA, 27 bp, Artificial Sequence
  Description of Artificial Sequence: Synthetic oligonucleotide
cagcagtatgaaagctcgccgtggacg

SEQ ID NO: 16124 - protein, 9 aa, Artificial Sequence
  Description of Artificial Sequence: Synthetic peptide
QQYESSPWT

SEQ ID NO: 16125 - DNA, 27 bp, Artificial Sequence
  Description of Artificial Sequence: Synthetic oligonucleotide
ctacaacattatagttacccgctcact

SEQ ID NO: 16126 - protein, 9 aa, Artificial Sequence
  Description of Artificial Sequence: Synthetic peptide
LQHYSYPLT

SEQ ID NO: 16127 - DNA, 27 bp, Artificial Sequence
  Description of Artificial Sequence: Synthetic oligonucleotide
atgcaaagtatgcagcttccgattatc

SEQ ID NO: 16128 - protein, 9 aa, Artificial Sequence
  Description of Artificial Sequence: Synthetic peptide
MQSMQLPII

SEQ ID NO: 16129 - DNA, 27 bp, Artificial Sequence
  Description of Artificial Sequence: Synthetic oligonucleotide
caacagtatagtggttacccattcact

SEQ ID NO: 16130 - protein, 9 aa, Artificial Sequence
  Description of Artificial Sequence: Synthetic peptide
QQYSGYPFT

SEQ ID NO: 16131 - DNA, 27 bp, Artificial Sequence
  Description of Artificial Sequence: Synthetic oligonucleotide
atgcaaagtatacaggttccgtggacg

SEQ ID NO: 16132 - protein, 9 aa, Artificial Sequence
  Description of Artificial Sequence: Synthetic peptide
MQSIQVPWT

SEQ ID NO: 16133 - DNA, 27 bp, Artificial Sequence
  Description of Artificial Sequence: Synthetic oligonucleotide
ctacagcataatagttacccgctcact

SEQ ID NO: 16134 - protein, 9 aa, Artificial Sequence
  Description of Artificial Sequence: Synthetic peptide
LQHNSYPLT

SEQ ID NO: 16135 - DNA, 27 bp, Artificial Sequence
  Description of Artificial Sequence: Synthetic oligonucleotide
ctacagcataatgattacccgttcact

SEQ ID NO: 16136 - protein, 9 aa, Artificial Sequence
  Description of Artificial Sequence: Synthetic peptide
LQHNDYPFT

SEQ ID NO: 16137 - DNA, 27 bp, Artificial Sequence
  Description of Artificial Sequence: Synthetic oligonucleotide
ctacagcattatagtttccctcggacg

SEQ ID NO: 16138 - protein, 9 aa, Artificial Sequence
  Description of Artificial Sequence: Synthetic peptide
LQHYSFPRT

SEQ ID NO: 16139 - DNA, 27 bp, Artificial Sequence
  Description of Artificial Sequence: Synthetic oligonucleotide
cagcagtataatgactggccgtgcagt

SEQ ID NO: 16140 - protein, 9 aa, Artificial Sequence
  Description of Artificial Sequence: Synthetic peptide
QQYNDWPCS

SEQ ID NO: 16141 - DNA, 27 bp, Artificial Sequence
  Description of Artificial Sequence: Synthetic oligonucleotide
cagcagtataattactggccgctcact

SEQ ID NO: 16142 - protein, 9 aa, Artificial Sequence
  Description of Artificial Sequence: Synthetic peptide
QQYNYWPLT

SEQ ID NO: 16143 - DNA, 27 bp, Artificial Sequence
  Description of Artificial Sequence: Synthetic oligonucleotide
ctacagtataatagttacccattcact

SEQ ID NO: 16144 - protein, 9 aa, Artificial Sequence
  Description of Artificial Sequence: Synthetic peptide
LQYNSYPFT

SEQ ID NO: 16145 - DNA, 27 bp, Artificial Sequence
  Description of Artificial Sequence: Synthetic oligonucleotide
cagcagtatgaaagctcgccgtggacg

SEQ ID NO: 16146 - protein, 9 aa, Artificial Sequence
  Description of Artificial Sequence: Synthetic peptide
QQYESSPWT

SEQ ID NO: 16147 - DNA, 27 bp, Artificial Sequence
  Description of Artificial Sequence: Synthetic oligonucleotide
ctacaacattatcgttaccctttcact

SEQ ID NO: 16148 - protein, 9 aa, Artificial Sequence
  Description of Artificial Sequence: Synthetic peptide
LQHYRYPFT

SEQ ID NO: 16149 - DNA, 27 bp, Artificial Sequence
  Description of Artificial Sequence: Synthetic oligonucleotide
cagcagtatgaaagctcgccgtggacg

SEQ ID NO: 16150 - protein, 9 aa, Artificial Sequence
  Description of Artificial Sequence: Synthetic peptide
QQYESSPWT

SEQ ID NO: 16151 - DNA, 27 bp, Artificial Sequence
  Description of Artificial Sequence: Synthetic oligonucleotide
ctacagcataatagttaccctctcact

SEQ ID NO: 16152 - protein, 9 aa, Artificial Sequence
  Description of Artificial Sequence: Synthetic peptide
LQHNSYPLT

SEQ ID NO: 16153 - DNA, 27 bp, Artificial Sequence
  Description of Artificial Sequence: Synthetic oligonucleotide
cagcagtatgaaagctcgccgtggacg

SEQ ID NO: 16154 - protein, 9 aa, Artificial Sequence
  Description of Artificial Sequence: Synthetic peptide
QQYESSPWT

SEQ ID NO: 16155 - DNA, 27 bp, Artificial Sequence
  Description of Artificial Sequence: Synthetic oligonucleotide
ctacaacattatagttaccctcggacg

SEQ ID NO: 16156 - protein, 9 aa, Artificial Sequence
  Description of Artificial Sequence: Synthetic peptide
LQHYSYPRT

SEQ ID NO: 16157 - DNA, 27 bp, Artificial Sequence
  Description of Artificial Sequence: Synthetic oligonucleotide
ctacagtataatagttacccattcact

SEQ ID NO: 16158 - protein, 9 aa, Artificial Sequence
  Description of Artificial Sequence: Synthetic peptide
LQYNSYPFT

SEQ ID NO: 16159 - DNA, 27 bp, Artificial Sequence
  Description of Artificial Sequence: Synthetic oligonucleotide
ctacagtataatagttacccattcact

SEQ ID NO: 16160 - protein, 9 aa, Artificial Sequence
  Description of Artificial Sequence: Synthetic peptide
LQYNSYPFT

SEQ ID NO: 16161 - DNA, 30 bp, Artificial Sequence
  Description of Artificial Sequence: Synthetic oligonucleotide
caacagagttacagaacccctctgtggacg

SEQ ID NO: 16162 - protein, 10 aa, Artificial Sequence
  Description of Artificial Sequence: Synthetic peptide
QQSYRTPLWT

SEQ ID NO: 16163 - DNA, 27 bp, Artificial Sequence
  Description of Artificial Sequence: Synthetic oligonucleotide
cagcaatattatactactccgtgcagt

SEQ ID NO: 16164 - protein, 9 aa, Artificial Sequence
  Description of Artificial Sequence: Synthetic peptide
QQYYTTPCS

SEQ ID NO: 16165 - DNA, 27 bp, Artificial Sequence
  Description of Artificial Sequence: Synthetic oligonucleotide
cagcaatattatactactccgtgcagt

SEQ ID NO: 16166 - protein, 9 aa, Artificial Sequence
  Description of Artificial Sequence: Synthetic peptide
QQYYTTPCS

SEQ ID NO: 16167 - DNA, 27 bp, Artificial Sequence
  Description of Artificial Sequence: Synthetic oligonucleotide
atgcaaggtacacactggccgctcact

SEQ ID NO: 16168 - protein, 9 aa, Artificial Sequence
  Description of Artificial Sequence: Synthetic peptide
MQGTHWPLT

SEQ ID NO: 16169 - DNA, 27 bp, Artificial Sequence
  Description of Artificial Sequence: Synthetic oligonucleotide
atgcaaggtacacactggccattcact

SEQ ID NO: 16170 - protein, 9 aa, Artificial Sequence
  Description of Artificial Sequence: Synthetic peptide
MQGTHWPFT

SEQ ID NO: 16171 - DNA, 27 bp, Artificial Sequence
  Description of Artificial Sequence: Synthetic oligonucleotide
ctacagcattatagttatcctcggacg

SEQ ID NO: 16172 - protein, 9 aa, Artificial Sequence
  Description of Artificial Sequence: Synthetic peptide
LQHYSYPRT

SEQ ID NO: 16173 - DNA, 27 bp, Artificial Sequence
  Description of Artificial Sequence: Synthetic oligonucleotide
ctacaacattatagttaccctcggacg

SEQ ID NO: 16174 - protein, 9 aa, Artificial Sequence
  Description of Artificial Sequence: Synthetic peptide
LQHYSYPRT

SEQ ID NO: 16175 - DNA, 30 bp, Artificial Sequence
  Description of Artificial Sequence: Synthetic oligonucleotide
agctcatatacaagcagctacacttgggtg

SEQ ID NO: 16176 - protein, 10 aa, Artificial Sequence
  Description of Artificial Sequence: Synthetic peptide
SSYTSSYTWV

SEQ ID NO: 16177 - DNA, 30 bp, Artificial Sequence
  Description of Artificial Sequence: Synthetic oligonucleotide
gcagcatgggatgacagcctgaatggtccg

SEQ ID NO: 16178 - protein, 10 aa, Artificial Sequence
  Description of Artificial Sequence: Synthetic peptide
AAWDDSLNGP

SEQ ID NO: 16179 - DNA, 30 bp, Artificial Sequence
  Description of Artificial Sequence: Synthetic oligonucleotide
aactcaacagacagcagtggtaatcgggtg

SEQ ID NO: 16180 - protein, 10 aa, Artificial Sequence
  Description of Artificial Sequence: Synthetic peptide
NSTDSSGNRV

SEQ ID NO: 16181 - DNA, 27 bp, Artificial Sequence
  Description of Artificial Sequence: Synthetic oligonucleotide
ctacagcatgatagttaccctctcact

SEQ ID NO: 16182 - protein, 9 aa, Artificial Sequence
  Description of Artificial Sequence: Synthetic peptide
LQHDSYPLT

SEQ ID NO: 16183 - DNA, 27 bp, Artificial Sequence
  Description of Artificial Sequence: Synthetic oligonucleotide
cagcaatattatagtactccgtgcagt

SEQ ID NO: 16184 - protein, 9 aa, Artificial Sequence
  Description of Artificial Sequence: Synthetic peptide
QQYYSTPCS

SEQ ID NO: 16185 - DNA, 27 bp, Artificial Sequence
  Description of Artificial Sequence: Synthetic oligonucleotide
ctacaacattataattacccgctcact

SEQ ID NO: 16186 - protein, 9 aa, Artificial Sequence
  Description of Artificial Sequence: Synthetic peptide
LQHYNYPLT

SEQ ID NO: 16187 - DNA, 27 bp, Artificial Sequence
  Description of Artificial Sequence: Synthetic oligonucleotide
caggcgtgggacaacagcactgtggtg

SEQ ID NO: 16188 - protein, 9 aa, Artificial Sequence
  Description of Artificial Sequence: Synthetic peptide
QAWDNSTVV

SEQ ID NO: 16189 - DNA, 27 bp, Artificial Sequence
  Description of Artificial Sequence: Synthetic oligonucleotide
atacaaggtacgcactggcctttcccc

SEQ ID NO: 16190 - protein, 9 aa, Artificial Sequence
  Description of Artificial Sequence: Synthetic peptide
IQGTHWPFP

SEQ ID NO: 16191 - DNA, 30 bp, Artificial Sequence
  Description of Artificial Sequence: Synthetic oligonucleotide
agctcatatacaagcaccggcactgtggta

SEQ ID NO: 16192 - protein, 10 aa, Artificial Sequence
  Description of Artificial Sequence: Synthetic peptide
SSYTSTGTVV

SEQ ID NO: 16193 - DNA, 30 bp, Artificial Sequence
  Description of Artificial Sequence: Synthetic oligonucleotide
ctacagcataatagttacctccccatcacc

SEQ ID NO: 16194 - protein, 10 aa, Artificial Sequence
  Description of Artificial Sequence: Synthetic peptide
LQHNSYLPIT

SEQ ID NO: 16195 - DNA, 27 bp, Artificial Sequence
  Description of Artificial Sequence: Synthetic oligonucleotide
caacaggctaacagtttcccattcact

SEQ ID NO: 16196 - protein, 9 aa, Artificial Sequence
  Description of Artificial Sequence: Synthetic peptide
QQANSFPFT

SEQ ID NO: 16197 - DNA, 27 bp, Artificial Sequence
  Description of Artificial Sequence: Synthetic oligonucleotide
caacaggctaacagtttcccattcact

SEQ ID NO: 16198 - protein, 9 aa, Artificial Sequence
  Description of Artificial Sequence: Synthetic peptide
QQANSFPFT

SEQ ID NO: 16199 - DNA, 30 bp, Artificial Sequence; identical to SEQ ID NO: 16193
  Description of Artificial Sequence: Synthetic oligonucleotide

SEQ ID NO: 16200 - protein, 10 aa, Artificial Sequence
  Description of Artificial Sequence: Synthetic peptide
LQHNSYLPIT

SEQ ID NO: 16201 - DNA, 27 bp, Artificial Sequence
  Description of Artificial Sequence: Synthetic oligonucleotide
caggcgtgggacaacagcactgcggta

SEQ ID NO: 16202 - protein, 9 aa, Artificial Sequence
  Description of Artificial Sequence: Synthetic peptide
QAWDNSTAV

SEQ ID NO: 16203 - DNA, 27 bp, Artificial Sequence
  Description of Artificial Sequence: Synthetic oligonucleotide
ttgcaaggtacacactggcctctcacc

SEQ ID NO: 16204 - protein, 9 aa, Artificial Sequence
  Description of Artificial Sequence: Synthetic peptide
LQGTHWPLT

SEQ ID NO: 16205 - DNA, 27 bp, Artificial Sequence
  Description of Artificial Sequence: Synthetic oligonucleotide
caggcgtgggacaatagtactgcggta

SEQ ID NO: 16206 - protein, 9 aa, Artificial Sequence
  Description of Artificial Sequence: Synthetic peptide
QAWDNSTAV

SEQ ID NO: 16207 - DNA, 30 bp, Artificial Sequence
  Description of Artificial Sequence: Synthetic oligonucleotide
acctcatatacaagcaccagcactgtggtc

SEQ ID NO: 16208 - protein, 10 aa, Artificial Sequence
  Description of Artificial Sequence: Synthetic peptide
TSYTSTSTVV

SEQ ID NO: 16209 - DNA, 27 bp, Artificial Sequence
  Description of Artificial Sequence: Synthetic oligonucleotide
caggcgtgggacaacagcactgtggtt

SEQ ID NO: 16210 - protein, 9 aa, Artificial Sequence
  Description of Artificial Sequence: Synthetic peptide
QAWDNSTVV

SEQ ID NO: 16211 - DNA, 24 bp, Artificial Sequence
  Description of Artificial Sequence: Synthetic oligonucleotide
caggcgtgggacagcagcactata

SEQ ID NO: 16212 - protein, 8 aa, Artificial Sequence
  Description of Artificial Sequence: Synthetic peptide
QAWDSSTI

SEQ ID NO: 16213 - DNA, 27 bp, Artificial Sequence
  Description of Artificial Sequence: Synthetic oligonucleotide
caggcgtggaacagcagcaatgtggta

SEQ ID NO: 16214 - protein, 9 aa, Artificial Sequence
  Description of Artificial Sequence: Synthetic peptide
QAWNSSNVV

SEQ ID NO: 16215 - DNA, 30 bp, Artificial Sequence
  Description of Artificial Sequence: Synthetic oligonucleotide
caggcgtgggacagcagcacttatgtggta

SEQ ID NO: 16216 - protein, 10 aa, Artificial Sequence
  Description of Artificial Sequence: Synthetic peptide
QAWDSSTYVV

SEQ ID NO: 16217 - DNA, 33 bp, Artificial Sequence
  Description of Artificial Sequence: Synthetic oligonucleotide
caggtgtgggacagtagtagtgatcatgtggta

SEQ ID NO: 16218 - protein, 11 aa, Artificial Sequence
  Description of Artificial Sequence: Synthetic peptide
QVWDSSSDHVV

SEQ ID NO: 16219 - DNA, 39 bp, Artificial Sequence
  Description of Artificial Sequence: Synthetic oligonucleotide
ggagagagccacacgattgatggccaagtcggtgtggta

SEQ ID NO: 16220 - protein, 13 aa, Artificial Sequence
  Description of Artificial Sequence: Synthetic peptide
GESHTIDGQVGVV

SEQ ID NO: 16221 - DNA, 27 bp, Artificial Sequence
  Description of Artificial Sequence: Synthetic oligonucleotide
caggcgtgggacagcagcacagtggta

SEQ ID NO: 16222 - protein, 9 aa, Artificial Sequence
  Description of Artificial Sequence: Synthetic peptide
QAWDSSTVV

SEQ ID NO: 16223 - DNA, 27 bp, Artificial Sequence
  Description of Artificial Sequence: Synthetic oligonucleotide
tttcaaagtatacagcttccgctcact

SEQ ID NO: 16224 - protein, 9 aa, Artificial Sequence
  Description of Artificial Sequence: Synthetic peptide
FQSIQLPLT

SEQ ID NO: 16225 - DNA, 27 bp, Artificial Sequence
  Description of Artificial Sequence: Synthetic oligonucleotide
caacagtatcatagttacccattcact

SEQ ID NO: 16226 - protein, 9 aa, Artificial Sequence
  Description of Artificial Sequence: Synthetic peptide
QQYHSYPFT

SEQ ID NO: 16227 - DNA, 27 bp, Artificial Sequence
  Description of Artificial Sequence: Synthetic oligonucleotide
ctacagcataatagttacccactcact

SEQ ID NO: 16228 - protein, 9 aa, Artificial Sequence
  Description of Artificial Sequence: Synthetic peptide
LQHNSYPLT

SEQ ID NO: 16229 - DNA, 27 bp, Artificial Sequence
  Description of Artificial Sequence: Synthetic oligonucleotide
ctacagcattatagttatatgttcact

SEQ ID NO: 16230 - protein, 9 aa, Artificial Sequence
  Description of Artificial Sequence: Synthetic peptide
LQHYSYMFT

SEQ ID NO: 16231 - DNA, 27 bp, Artificial Sequence
  Description of Artificial Sequence: Synthetic oligonucleotide
ctacagcataatagttacccgtggacg

SEQ ID NO: 16232 - protein, 9 aa, Artificial Sequence
  Description of Artificial Sequence: Synthetic peptide
LQHNSYPWT

SEQ ID NO: 16233 - DNA, 27 bp, Artificial Sequence
  Description of Artificial Sequence: Synthetic oligonucleotide
cttcaacatgctagttacccgctcact

SEQ ID NO: 16234 - protein, 9 aa, Artificial Sequence
  Description of Artificial Sequence: Synthetic peptide
LQHASYPLT

SEQ ID NO: 16235 - DNA, 27 bp, Artificial Sequence
  Description of Artificial Sequence: Synthetic oligonucleotide
ctacagcataatagttacccgctcact

SEQ ID NO: 16236 - protein, 9 aa, Artificial Sequence
  Description of Artificial Sequence: Synthetic peptide
LQHNSYPLT

SEQ ID NO: 16237 - DNA, 27 bp, Artificial Sequence
  Description of Artificial Sequence: Synthetic oligonucleotide
ctacagtataatagttatccattcact

SEQ ID NO: 16238 - protein, 9 aa, Artificial Sequence
  Description of Artificial Sequence: Synthetic peptide
LQYNSYPFT

SEQ ID NO: 16239 - DNA, 27 bp, Artificial Sequence
  Description of Artificial Sequence: Synthetic oligonucleotide
ctacagcaatatagttaccctcggacg

SEQ ID NO: 16240 - protein, 9 aa, Artificial Sequence
  Description of Artificial Sequence: Synthetic peptide
LQQYSYPRT

SEQ ID NO: 16241 - DNA, 27 bp, Artificial Sequence
  Description of Artificial Sequence: Synthetic oligonucleotide
caacagagtcacacttccccgctcact

SEQ ID NO: 16242 - protein, 9 aa, Artificial Sequence
  Description of Artificial Sequence: Synthetic peptide
QQSHTSPLT

SEQ ID NO: 16243 - DNA, 27 bp, Artificial Sequence
  Description of Artificial Sequence: Synthetic oligonucleotide
ctacaacataatacttatccgctcact

SEQ ID NO: 16244 - protein, 9 aa, Artificial Sequence
  Description of Artificial Sequence: Synthetic peptide
LQHNTYPLT

SEQ ID NO: 16245 - DNA, 27 bp, Artificial Sequence
  Description of Artificial Sequence: Synthetic oligonucleotide
ctacagcataatagttacccgctcact

SEQ ID NO: 16246 - protein, 9 aa, Artificial Sequence
  Description of Artificial Sequence: Synthetic peptide
LQHNSYPLT

SEQ ID NO: 16247 - DNA, 27 bp, Artificial Sequence
  Description of Artificial Sequence: Synthetic oligonucleotide
ctacagcatagttcttacccgctcact

SEQ ID NO: 16248 - protein, 9 aa, Artificial Sequence
  Description of Artificial Sequence: Synthetic peptide
LQHSSYPLT

SEQ ID NO: 16249 - DNA, 27 bp, Artificial Sequence
  Description of Artificial Sequence: Synthetic oligonucleotide
ctacagcataatagtttcccgctcact

SEQ ID NO: 16250 - protein, 9 aa, Artificial Sequence
  Description of Artificial Sequence: Synthetic peptide
LQHNSFPLT

SEQ ID NO: 16251 - DNA, 27 bp, Artificial Sequence
  Description of Artificial Sequence: Synthetic oligonucleotide
ctacagcataatagttacccgctcact

SEQ ID NO: 16252 - protein, 9 aa, Artificial Sequence
  Description of Artificial Sequence: Synthetic peptide
LQHNSYPLT

SEQ ID NO: 16253 - DNA, 27 bp, Artificial Sequence
  Description of Artificial Sequence: Synthetic oligonucleotide
caacagagtcacagttccccgctcact

SEQ ID NO: 16254 - protein, 9 aa, Artificial Sequence
  Description of Artificial Sequence: Synthetic peptide
QQSHSSPLT

SEQ ID NO: 16255 - DNA, 27 bp, Artificial Sequence
  Description of Artificial Sequence: Synthetic oligonucleotide
caacaggctaacagtttccctcggacg

SEQ ID NO: 16256 - protein, 9 aa, Artificial Sequence
  Description of Artificial Sequence: Synthetic peptide
QQANSFPRT

SEQ ID NO: 16257 - DNA, 30 bp, Artificial Sequence
  Description of Artificial Sequence: Synthetic oligonucleotide
caacagagttacagaaccccctttttcact

SEQ ID NO: 16258 - protein, 10 aa, Artificial Sequence
  Description of Artificial Sequence: Synthetic peptide
QQSYRTPFFT

SEQ ID NO: 16259 - DNA, 27 bp, Artificial Sequence
  Description of Artificial Sequence: Synthetic oligonucleotide
ctacagcataatagttacccgctcact

SEQ ID NO: 16260 - protein, 9 aa, Artificial Sequence
  Description of Artificial Sequence: Synthetic peptide
LQHNSYPLT

SEQ ID NO: 16261 - DNA, 27 bp, Artificial Sequence
  Description of Artificial Sequence: Synthetic oligonucleotide
ctacagcataatagttacccgctcact

SEQ ID NO: 16262 - protein, 9 aa, Artificial Sequence
  Description of Artificial Sequence: Synthetic peptide
LQHNSYPLT

SEQ ID NO: 16263 - DNA, 27 bp, Artificial Sequence
  Description of Artificial Sequence: Synthetic oligonucleotide
ctacagcataatagttacccgctcact

SEQ ID NO: 16264 - protein, 9 aa, Artificial Sequence
  Description of Artificial Sequence: Synthetic peptide
LQHNSYPLT

SEQ ID NO: 16265 - DNA, 27 bp, Artificial Sequence
  Description of Artificial Sequence: Synthetic oligonucleotide
caacagagttacagtacccctttcact

SEQ ID NO: 16266 - protein, 9 aa, Artificial Sequence
  Description of Artificial Sequence: Synthetic peptide
QQSYSTPFT

SEQ ID NO: 16267 - DNA, 27 bp, Artificial Sequence
  Description of Artificial Sequence: Synthetic oligonucleotide
caacagacttacagtcccccgctcact

SEQ ID NO: 16268 - protein, 9 aa, Artificial Sequence
  Description of Artificial Sequence: Synthetic peptide
QQTYSPPLT

SEQ ID NO: 16269 - DNA, 27 bp, Artificial Sequence
  Description of Artificial Sequence: Synthetic oligonucleotide
ctacagcataatagttacccgctcact

SEQ ID NO: 16270 - protein, 9 aa, Artificial Sequence
  Description of Artificial Sequence: Synthetic peptide
LQHNSYPLT

SEQ ID NO: 16271 - DNA, 30 bp, Artificial Sequence; identical to SEQ ID NO: 16257
  Description of Artificial Sequence: Synthetic oligonucleotide

SEQ ID NO: 16272 - protein, 10 aa, Artificial Sequence
  Description of Artificial Sequence: Synthetic peptide
QQSYRTPFFT

SEQ ID NO: 16273 - DNA, 27 bp, Artificial Sequence
  Description of Artificial Sequence: Synthetic oligonucleotide
ctacaacataatagttacccgtggacg

SEQ ID NO: 16274 - protein, 9 aa, Artificial Sequence
  Description of Artificial Sequence: Synthetic peptide
LQHNSYPWT

SEQ ID NO: 16275 - DNA, 27 bp, Artificial Sequence
  Description of Artificial Sequence: Synthetic oligonucleotide
ctacagcatgccagttacccgctcact

SEQ ID NO: 16276 - protein, 9 aa, Artificial Sequence
  Description of Artificial Sequence: Synthetic peptide
LQHASYPLT

SEQ ID NO: 16277 - DNA, 30 bp, Artificial Sequence
  Description of Artificial Sequence: Synthetic oligonucleotide
caacagagttacagtgcccctccattcact

SEQ ID NO: 16278 - protein, 10 aa, Artificial Sequence
  Description of Artificial Sequence: Synthetic peptide
QQSYSAPPFT

SEQ ID NO: 16279 - DNA, 27 bp, Artificial Sequence
  Description of Artificial Sequence: Synthetic oligonucleotide
ctacagcataatagttacccgctcact

SEQ ID NO: 16280 - protein, 9 aa, Artificial Sequence
  Description of Artificial Sequence: Synthetic peptide
LQHNSYPLT

SEQ ID NO: 16281 - DNA, 27 bp, Artificial Sequence
  Description of Artificial Sequence: Synthetic oligonucleotide
caacagtattatagttatccgctcact

SEQ ID NO: 16282 - protein, 9 aa, Artificial Sequence
  Description of Artificial Sequence: Synthetic peptide
QQYYSYPLT

SEQ ID NO: 16283 - DNA, 27 bp, Artificial Sequence
  Description of Artificial Sequence: Synthetic oligonucleotide
ctacagcataatagttacccattcact

SEQ ID NO: 16284 - protein, 9 aa, Artificial Sequence
  Description of Artificial Sequence: Synthetic peptide
LQHNSYPFT

SEQ ID NO: 16285 - DNA, 27 bp, Artificial Sequence
  Description of Artificial Sequence: Synthetic oligonucleotide
ctacagcataatagttacccgtggacg

SEQ ID NO: 16286 - protein, 9 aa, Artificial Sequence
  Description of Artificial Sequence: Synthetic peptide
LQHNSYPWT

SEQ ID NO: 16287 - DNA, 27 bp, Artificial Sequence
  Description of Artificial Sequence: Synthetic oligonucleotide
ctacagcataatagttacccgtggacg

SEQ ID NO: 16288 - protein, 9 aa, Artificial Sequence
  Description of Artificial Sequence: Synthetic peptide
LQHNSYPWT

SEQ ID NO: 16289 - DNA, 27 bp, Artificial Sequence
  Description of Artificial Sequence: Synthetic oligonucleotide
ttacagtataatagttacccattcact

SEQ ID NO: 16290 - protein, 9 aa, Artificial Sequence
  Description of Artificial Sequence: Synthetic peptide
LQYNSYPFT

SEQ ID NO: 16291 - DNA, 27 bp, Artificial Sequence
  Description of Artificial Sequence: Synthetic oligonucleotide
caacagagttacagtacccctttcact

SEQ ID NO: 16292 - protein, 9 aa, Artificial Sequence
  Description of Artificial Sequence: Synthetic peptide
QQSYSTPFT

SEQ ID NO: 16293 - DNA, 30 bp, Artificial Sequence
  Description of Artificial Sequence: Synthetic oligonucleotide
caacagagttacagaacccccttattcact

SEQ ID NO: 16294 - protein, 10 aa, Artificial Sequence
  Description of Artificial Sequence: Synthetic peptide
QQSYRTPLFT

SEQ ID NO: 16295 - DNA, 27 bp, Artificial Sequence
  Description of Artificial Sequence: Synthetic oligonucleotide
ctacagcataatagttacccgctcact

SEQ ID NO: 16296 - protein, 9 aa, Artificial Sequence
  Description of Artificial Sequence: Synthetic peptide
LQHNSYPLT

SEQ ID NO: 16297 - DNA, 30 bp, Artificial Sequence; identical to SEQ ID NO: 16257
  Description of Artificial Sequence: Synthetic oligonucleotide

SEQ ID NO: 16298 - protein, 10 aa, Artificial Sequence
  Description of Artificial Sequence: Synthetic peptide
QQSYRTPFFT

SEQ ID NO: 16299 - DNA, 30 bp, Artificial Sequence
  Description of Artificial Sequence: Synthetic oligonucleotide
caacagacttacagtacccccttattcgct

SEQ ID NO: 16300 - protein, 10 aa, Artificial Sequence
  Description of Artificial Sequence: Synthetic peptide
QQTYSTPLFA

SEQ ID NO: 16301 - DNA, 27 bp, Artificial Sequence
  Description of Artificial Sequence: Synthetic oligonucleotide
ctacagcatagtagttacccgctcact

SEQ ID NO: 16302 - protein, 9 aa, Artificial Sequence
  Description of Artificial Sequence: Synthetic peptide
LQHSSYPLT

SEQ ID NO: 16303 - DNA, 27 bp, Artificial Sequence
  Description of Artificial Sequence: Synthetic oligonucleotide
caacagtataatacttacccattcact

SEQ ID NO: 16304 - protein, 9 aa, Artificial Sequence
  Description of Artificial Sequence: Synthetic peptide
QQYNTYPFT

SEQ ID NO: 16305 - DNA, 27 bp, Artificial Sequence
  Description of Artificial Sequence: Synthetic oligonucleotide
ctacagcataatggttacccgtggacg

SEQ ID NO: 16306 - protein, 9 aa, Artificial Sequence
  Description of Artificial Sequence: Synthetic peptide
LQHNGYPWT

SEQ ID NO: 16307 - DNA, 27 bp, Artificial Sequence
  Description of Artificial Sequence: Synthetic oligonucleotide
caacagtatcatagtttcccattcact

SEQ ID NO: 16308 - protein, 9 aa, Artificial Sequence
  Description of Artificial Sequence: Synthetic peptide
QQYHSFPFT

SEQ ID NO: 16309 - DNA, 27 bp, Artificial Sequence
  Description of Artificial Sequence: Synthetic oligonucleotide
ctacagcataatagttacccgctcact

SEQ ID NO: 16310 - protein, 9 aa, Artificial Sequence
  Description of Artificial Sequence: Synthetic peptide
LQHNSYPLT

SEQ ID NO: 16311 - DNA, 30 bp, Artificial Sequence
  Description of Artificial Sequence: Synthetic oligonucleotide
atgcaagttctacaaactcctcccctcact

SEQ ID NO: 16312 - protein, 10 aa, Artificial Sequence
  Description of Artificial Sequence: Synthetic peptide
MQVLQTPPLT

SEQ ID NO: 16313 - DNA, 30 bp, Artificial Sequence
  Description of Artificial Sequence: Synthetic oligonucleotide
caacagagttacaatacccccttattcact

SEQ ID NO: 16314 - protein, 10 aa, Artificial Sequence
  Description of Artificial Sequence: Synthetic peptide
QQSYNTPLFT

SEQ ID NO: 16315 - DNA, 30 bp, Artificial Sequence; identical to SEQ ID NO: 16257
  Description of Artificial Sequence: Synthetic oligonucleotide

SEQ ID NO: 16316 - protein, 10 aa, Artificial Sequence
  Description of Artificial Sequence: Synthetic peptide
QQSYRTPFFT

SEQ ID NO: 16317 - DNA, 30 bp, Artificial Sequence
  Description of Artificial Sequence: Synthetic oligonucleotide
caaaagtataacagtgcccctccgatcacc

SEQ ID NO: 16318 - protein, 10 aa, Artificial Sequence
  Description of Artificial Sequence: Synthetic peptide
QKYNSAPPIT

SEQ ID NO: 16319 - DNA, 27 bp, Artificial Sequence
  Description of Artificial Sequence: Synthetic oligonucleotide
caacaggctaacagtttccctcggacg

SEQ ID NO: 16320 - protein, 9 aa, Artificial Sequence
  Description of Artificial Sequence: Synthetic peptide
QQANSFPRT

SEQ ID NO: 16321 - DNA, 30 bp, Artificial Sequence
  Description of Artificial Sequence: Synthetic oligonucleotide
caacagagttacactacccccacgtggacg

SEQ ID NO: 16322 - protein, 10 aa, Artificial Sequence
  Description of Artificial Sequence: Synthetic peptide
QQSYTTPTWT

SEQ ID NO: 16323 - DNA, 27 bp, Artificial Sequence
  Description of Artificial Sequence: Synthetic oligonucleotide
ctacaacataatagttacccgttgacg

SEQ ID NO: 16324 - protein, 9 aa, Artificial Sequence
  Description of Artificial Sequence: Synthetic peptide
LQHNSYPLT

SEQ ID NO: 16325 - DNA, 27 bp, Artificial Sequence
  Description of Artificial Sequence: Synthetic oligonucleotide
cagcagtataataactggcctctgacg

SEQ ID NO: 16326 - protein, 9 aa, Artificial Sequence
  Description of Artificial Sequence: Synthetic peptide
QQYNNWPLT

SEQ ID NO: 16327 - DNA, 30 bp, Artificial Sequence
  Description of Artificial Sequence: Synthetic oligonucleotide
caacagacttacactacccccacgtggacg

SEQ ID NO: 16328 - protein, 10 aa, Artificial Sequence
  Description of Artificial Sequence: Synthetic peptide
QQTYTTPTWT

SEQ ID NO: 16329 - DNA, 27 bp, Artificial Sequence
  Description of Artificial Sequence: Synthetic oligonucleotide
caacagacttacagtcccccgctcact

SEQ ID NO: 16330 - protein, 9 aa, Artificial Sequence
  Description of Artificial Sequence: Synthetic peptide
QQTYSPPLT

SEQ ID NO: 16331 - DNA, 27 bp, Artificial Sequence
  Description of Artificial Sequence: Synthetic oligonucleotide
ctacaacataataattacccgtggacg

SEQ ID NO: 16332 - protein, 9 aa, Artificial Sequence
  Description of Artificial Sequence: Synthetic peptide
LQHNNYPWT

SEQ ID NO: 16333 - DNA, 27 bp, Artificial Sequence
  Description of Artificial Sequence: Synthetic oligonucleotide
ctacagcattataattaccctcgggcg

SEQ ID NO: 16334 - protein, 9 aa, Artificial Sequence
  Description of Artificial Sequence: Synthetic peptide
LQHYNYPRA

SEQ ID NO: 16335 - DNA, 27 bp, Artificial Sequence
  Description of Artificial Sequence: Synthetic oligonucleotide
ctacagcataatagttacccgttcact

SEQ ID NO: 16336 - protein, 9 aa, Artificial Sequence
  Description of Artificial Sequence: Synthetic peptide
LQHNSYPFT

SEQ ID NO: 16337 - DNA, 27 bp, Artificial Sequence
  Description of Artificial Sequence: Synthetic oligonucleotide
caacagtattatagttacccattcact

SEQ ID NO: 16338 - protein, 9 aa, Artificial Sequence
  Description of Artificial Sequence: Synthetic peptide
QQYYSYPFT

SEQ ID NO: 16339 - DNA, 27 bp, Artificial Sequence
  Description of Artificial Sequence: Synthetic oligonucleotide
caacagtataatagttacccgatcacc

SEQ ID NO: 16340 - protein, 9 aa, Artificial Sequence
  Description of Artificial Sequence: Synthetic peptide
QQYNSYPIT

SEQ ID NO: 16341 - DNA, 27 bp, Artificial Sequence
  Description of Artificial Sequence: Synthetic oligonucleotide
ctacagcataatagatacccgctcact

SEQ ID NO: 16342 - protein, 9 aa, Artificial Sequence
  Description of Artificial Sequence: Synthetic peptide
LQHNRYPLT

SEQ ID NO: 16343 - DNA, 27 bp, Artificial Sequence
  Description of Artificial Sequence: Synthetic oligonucleotide
caacagagttacagtacctcgatcacc

SEQ ID NO: 16344 - protein, 9 aa, Artificial Sequence
  Description of Artificial Sequence: Synthetic peptide
QQSYSTSIT

SEQ ID NO: 16345 - DNA, 27 bp, Artificial Sequence
  Description of Artificial Sequence: Synthetic oligonucleotide
ctacaacataataattacccgtggacg

SEQ ID NO: 16346 - protein, 9 aa, Artificial Sequence
  Description of Artificial Sequence: Synthetic peptide
LQHNNYPWT

SEQ ID NO: 16347 - DNA, 30 bp, Artificial Sequence
  Description of Artificial Sequence: Synthetic oligonucleotide
caacagagtttcagaaccccctttttcact

SEQ ID NO: 16348 - protein, 10 aa, Artificial Sequence
  Description of Artificial Sequence: Synthetic peptide
QQSFRTPFFT

SEQ ID NO: 16349 - DNA, 30 bp, Artificial Sequence; identical to SEQ ID NO: 16293
  Description of Artificial Sequence: Synthetic oligonucleotide

SEQ ID NO: 16350 - protein, 10 aa, Artificial Sequence
  Description of Artificial Sequence: Synthetic peptide
QQSYRTPLFT

SEQ ID NO: 16351 - DNA, 30 bp, Artificial Sequence
  Description of Artificial Sequence: Synthetic oligonucleotide
caacagagtttcagaacccccttattcact

SEQ ID NO: 16352 - protein, 10 aa, Artificial Sequence
  Description of Artificial Sequence: Synthetic peptide
QQSFRTPLFT

SEQ ID NO: 16353 - DNA, 30 bp, Artificial Sequence
  Description of Artificial Sequence: Synthetic oligonucleotide
caacagagttacagtacccccacgtggacg

SEQ ID NO: 16354 - protein, 10 aa, Artificial Sequence
  Description of Artificial Sequence: Synthetic peptide
QQSYSTPTWT

SEQ ID NO: 16355 - DNA, 27 bp, Artificial Sequence
  Description of Artificial Sequence: Synthetic oligonucleotide
cagcagtataataactgtcctctgacg

SEQ ID NO: 16356 - protein, 9 aa, Artificial Sequence
  Description of Artificial Sequence: Synthetic peptide
QQYNNCPLT

SEQ ID NO: 16357 - DNA, 30 bp, Artificial Sequence; identical to SEQ ID NO: 16321
  Description of Artificial Sequence: Synthetic oligonucleotide

SEQ ID NO: 16358 - protein, 10 aa, Artificial Sequence
  Description of Artificial Sequence: Synthetic peptide
QQSYTTPTWT

SEQ ID NO: 16359 - DNA, 27 bp, Artificial Sequence
  Description of Artificial Sequence: Synthetic oligonucleotide
ctacagcataatagttacccgttcact

SEQ ID NO: 16360 - protein, 9 aa, Artificial Sequence
  Description of Artificial Sequence: Synthetic peptide
LQHNSYPFT

SEQ ID NO: 16361 - DNA, 27 bp, Artificial Sequence
  Description of Artificial Sequence: Synthetic oligonucleotide
ctacagcatagtagttaccccctcact

SEQ ID NO: 16362 - protein, 9 aa, Artificial Sequence
  Description of Artificial Sequence: Synthetic peptide
LQHSSYPLT

SEQ ID NO: 16363 - DNA, 27 bp, Artificial Sequence
  Description of Artificial Sequence: Synthetic oligonucleotide
caacagtataatagttacccgttcagg

SEQ ID NO: 16364 - protein, 9 aa, Artificial Sequence
  Description of Artificial Sequence: Synthetic peptide
QQYNSYPFR

SEQ ID NO: 16365 - DNA, 27 bp, Artificial Sequence
  Description of Artificial Sequence: Synthetic oligonucleotide
ctacaggataatagttacccattcact

SEQ ID NO: 16366 - protein, 9 aa, Artificial Sequence
  Description of Artificial Sequence: Synthetic peptide
LQDNSYPFT

SEQ ID NO: 16367 - DNA, 27 bp, Artificial Sequence
  Description of Artificial Sequence: Synthetic oligonucleotide
ctacagcataatacttacccgctcact

SEQ ID NO: 16368 - protein, 9 aa, Artificial Sequence
  Description of Artificial Sequence: Synthetic peptide
LQHNTYPLT

SEQ ID NO: 16369 - DNA, 27 bp, Artificial Sequence
  Description of Artificial Sequence: Synthetic oligonucleotide
caacagtatcatagttacccattcact

SEQ ID NO: 16370 - protein, 9 aa, Artificial Sequence
  Description of Artificial Sequence: Synthetic peptide
QQYHSYPFT

SEQ ID NO: 16371 - DNA, 27 bp, Artificial Sequence
  Description of Artificial Sequence: Synthetic oligonucleotide
caacagtataatagttacccattcact

SEQ ID NO: 16372 - protein, 9 aa, Artificial Sequence
  Description of Artificial Sequence: Synthetic peptide
QQYNSYPFT

SEQ ID NO: 16373 - DNA, 27 bp, Artificial Sequence
  Description of Artificial Sequence: Synthetic oligonucleotide
cagcaattttatagtactcctccgacg

SEQ ID NO: 16374 - protein, 9 aa, Artificial Sequence
  Description of Artificial Sequence: Synthetic peptide
QQFYSTPPT

SEQ ID NO: 16375 - DNA, 27 bp, Artificial Sequence
  Description of Artificial Sequence: Synthetic oligonucleotide
ctacaagataatagttacccgttcact

SEQ ID NO: 16376 - protein, 9 aa, Artificial Sequence
  Description of Artificial Sequence: Synthetic peptide
LQDNSYPFT

SEQ ID NO: 16377 - DNA, 27 bp, Artificial Sequence
  Description of Artificial Sequence: Synthetic oligonucleotide
atacagcaaaatagttacccgtggacg

SEQ ID NO: 16378 - protein, 9 aa, Artificial Sequence
  Description of Artificial Sequence: Synthetic peptide
IQQNSYPWT

SEQ ID NO: 16379 - DNA, 30 bp, Artificial Sequence; identical to SEQ ID NO: 16317
  Description of Artificial Sequence: Synthetic oligonucleotide

SEQ ID NO: 16380 - protein, 10 aa, Artificial Sequence
  Description of Artificial Sequence: Synthetic peptide
QKYNSAPPIT

SEQ ID NO: 16381 - DNA, 27 bp, Artificial Sequence
  Description of Artificial Sequence: Synthetic oligonucleotide
ctacagcataatagttatccgctcact

SEQ ID NO: 16382 - protein, 9 aa, Artificial Sequence
  Description of Artificial Sequence: Synthetic peptide
LQHNSYPLT

SEQ ID NO: 16383 - DNA, 27 bp, Artificial Sequence
  Description of Artificial Sequence: Synthetic oligonucleotide
cttcagcataatagttacccgtggacg

SEQ ID NO: 16384 - protein, 9 aa, Artificial Sequence
  Description of Artificial Sequence: Synthetic peptide
LQHNSYPWT

SEQ ID NO: 16385 - DNA, 27 bp, Artificial Sequence
  Description of Artificial Sequence: Synthetic oligonucleotide
caacagacttacagtaccccgctcact

SEQ ID NO: 16386 - protein, 9 aa, Artificial Sequence
  Description of Artificial Sequence: Synthetic peptide
QQTYSTPLT

SEQ ID NO: 16387 - DNA, 27 bp, Artificial Sequence
  Description of Artificial Sequence: Synthetic oligonucleotide
ctacagcatagtacttaccctctcact

SEQ ID NO: 16388 - protein, 9 aa, Artificial Sequence
  Description of Artificial Sequence: Synthetic peptide
LQHSTYPLT

SEQ ID NO: 16389 - DNA, 27 bp, Artificial Sequence
  Description of Artificial Sequence: Synthetic oligonucleotide
caacagttttatagttacccattcact

SEQ ID NO: 16390 - protein, 9 aa, Artificial Sequence
  Description of Artificial Sequence: Synthetic peptide
QQFYSYPFT

SEQ ID NO: 16391 - DNA, 30 bp, Artificial Sequence
  Description of Artificial Sequence: Synthetic oligonucleotide
cagcagtataataactggcccatgtgcagt

SEQ ID NO: 16392 - protein, 10 aa, Artificial Sequence
  Description of Artificial Sequence: Synthetic peptide
QQYNNWPMCS

SEQ ID NO: 16393 - DNA, 30 bp, Artificial Sequence
  Description of Artificial Sequence: Synthetic oligonucleotide
caacagagttacaatacccccacgtggacg

SEQ ID NO: 16394 - protein, 10 aa, Artificial Sequence
  Description of Artificial Sequence: Synthetic peptide
QQSYNTPTWT

SEQ ID NO: 16395 - DNA, 27 bp, Artificial Sequence
  Description of Artificial Sequence: Synthetic oligonucleotide
ctacagcataatagttacccgctcact

SEQ ID NO: 16396 - protein, 9 aa, Artificial Sequence
  Description of Artificial Sequence: Synthetic peptide
LQHNSYPLT

SEQ ID NO: 16397 - DNA, 30 bp, Artificial Sequence; identical to SEQ ID NO: 16257
  Description of Artificial Sequence: Synthetic oligonucleotide

SEQ ID NO: 16398 - protein, 10 aa, Artificial Sequence
  Description of Artificial Sequence: Synthetic peptide
QQSYRTPFFT

SEQ ID NO: 16399 - DNA, 27 bp, Artificial Sequence
  Description of Artificial Sequence: Synthetic oligonucleotide
atgcaaactttacaccttccgtggacg

SEQ ID NO: 16400 - protein, 9 aa, Artificial Sequence
  Description of Artificial Sequence: Synthetic peptide
MQTLHLPWT

SEQ ID NO: 16401 - DNA, 30 bp, Artificial Sequence; identical to SEQ ID NO: 16313
  Description of Artificial Sequence: Synthetic oligonucleotide

SEQ ID NO: 16402 - protein, 10 aa, Artificial Sequence
  Description of Artificial Sequence: Synthetic peptide
QQSYNTPLFT

SEQ ID NO: 16403 - DNA, 27 bp, Artificial Sequence
  Description of Artificial Sequence: Synthetic oligonucleotide
caacagacttacggtacctcgatcacc

SEQ ID NO: 16404 - protein, 9 aa, Artificial Sequence
  Description of Artificial Sequence: Synthetic peptide
QQTYGTSIT

SEQ ID NO: 16405 - DNA, 27 bp, Artificial Sequence
  Description of Artificial Sequence: Synthetic oligonucleotide
ctacagcatagtagttaccctctcact

SEQ ID NO: 16406 - protein, 9 aa, Artificial Sequence
  Description of Artificial Sequence: Synthetic peptide
LQHSSYPLT

SEQ ID NO: 16407 - DNA, 27 bp, Artificial Sequence
  Description of Artificial Sequence: Synthetic oligonucleotide
ctacagcataatagttacccgctcact

SEQ ID NO: 16408 - protein, 9 aa, Artificial Sequence
  Description of Artificial Sequence: Synthetic peptide
LQHNSYPLT

SEQ ID NO: 16409 - DNA, 27 bp, Artificial Sequence
  Description of Artificial Sequence: Synthetic oligonucleotide
ctacagcatagtaattacccgctcact

SEQ ID NO: 16410 - protein, 9 aa, Artificial Sequence
  Description of Artificial Sequence: Synthetic peptide
LQHSNYPLT

SEQ ID NO: 16411 - DNA, 27 bp, Artificial Sequence
  Description of Artificial Sequence: Synthetic oligonucleotide
caacagtataatacttatccattcact

SEQ ID NO: 16412 - protein, 9 aa, Artificial Sequence
  Description of Artificial Sequence: Synthetic peptide
QQYNTYPFT

SEQ ID NO: 16413 - DNA, 27 bp, Artificial Sequence
  Description of Artificial Sequence: Synthetic oligonucleotide
caacagagttacaatatctcattcact

SEQ ID NO: 16414 - protein, 9 aa, Artificial Sequence
  Description of Artificial Sequence: Synthetic peptide
QQSYNISFT

SEQ ID NO: 16415 - DNA, 27 bp, Artificial Sequence
  Description of Artificial Sequence: Synthetic oligonucleotide
ctacagcataatagttacccgtggacg

SEQ ID NO: 16416 - protein, 9 aa, Artificial Sequence
  Description of Artificial Sequence: Synthetic peptide
LQHNSYPWT

SEQ ID NO: 16417 - DNA, 27 bp, Artificial Sequence
  Description of Artificial Sequence: Synthetic oligonucleotide
ctacagcatagtacttacccgctcact

SEQ ID NO: 16418 - protein, 9 aa, Artificial Sequence
  Description of Artificial Sequence: Synthetic peptide
LQHSTYPLT

SEQ ID NO: 16419 - DNA, 27 bp, Artificial Sequence
  Description of Artificial Sequence: Synthetic oligonucleotide
ctacaccactatagttatcctcggacg

SEQ ID NO: 16420 - protein, 9 aa, Artificial Sequence
  Description of Artificial Sequence: Synthetic peptide
LHHYSYPRT

SEQ ID NO: 16421 - DNA, 27 bp, Artificial Sequence
  Description of Artificial Sequence: Synthetic oligonucleotide
ctacagcataatagttacccgctcact

SEQ ID NO: 16422 - protein, 9 aa, Artificial Sequence
  Description of Artificial Sequence: Synthetic peptide
LQHNSYPLT

SEQ ID NO: 16423 - DNA, 27 bp, Artificial Sequence
  Description of Artificial Sequence: Synthetic oligonucleotide
caacagtataatagttacccattcact

SEQ ID NO: 16424 - protein, 9 aa, Artificial Sequence
  Description of Artificial Sequence: Synthetic peptide
QQYNSYPFT

SEQ ID NO: 16425 - DNA, 27 bp, Artificial Sequence
  Description of Artificial Sequence: Synthetic oligonucleotide
caacagtataatagttaccctttcact

SEQ ID NO: 16426 - protein, 9 aa, Artificial Sequence
  Description of Artificial Sequence: Synthetic peptide
QQYNSYPFT

SEQ ID NO: 16427 - DNA, 27 bp, Artificial Sequence
  Description of Artificial Sequence: Synthetic oligonucleotide
ctacagcataatagttacccgtggacg

SEQ ID NO: 16428 - protein, 9 aa, Artificial Sequence
  Description of Artificial Sequence: Synthetic peptide
LQHNSYPWT

SEQ ID NO: 16429 - DNA, 27 bp, Artificial Sequence
  Description of Artificial Sequence: Synthetic oligonucleotide
ctacagcattatagttaccctcggacg

SEQ ID NO: 16430 - protein, 9 aa, Artificial Sequence
  Description of Artificial Sequence: Synthetic peptide
LQHYSYPRT

SEQ ID NO: 16431 - DNA, 27 bp, Artificial Sequence
  Description of Artificial Sequence: Synthetic oligonucleotide
caacagtatcatagttacccgtggacg

SEQ ID NO: 16432 - protein, 9 aa, Artificial Sequence
  Description of Artificial Sequence: Synthetic peptide
QQYHSYPWT

SEQ ID NO: 16433 - DNA, 27 bp, Artificial Sequence
  Description of Artificial Sequence: Synthetic oligonucleotide
ctacagcataatagttacccgctcact

SEQ ID NO: 16434 - protein, 9 aa, Artificial Sequence
  Description of Artificial Sequence: Synthetic peptide
LQHNSYPLT

SEQ ID NO: 16435 - DNA, 30 bp, Artificial Sequence; identical to SEQ ID NO: 16257
  Description of Artificial Sequence: Synthetic oligonucleotide

SEQ ID NO: 16436 - protein, 10 aa, Artificial Sequence
  Description of Artificial Sequence: Synthetic peptide
QQSYRTPFFT

SEQ ID NO: 16437 - DNA, 27 bp, Artificial Sequence
  Description of Artificial Sequence: Synthetic oligonucleotide
ctacagcataatagttaccccctcact

SEQ ID NO: 16438 - protein, 9 aa, Artificial Sequence
  Description of Artificial Sequence: Synthetic peptide
LQHNSYPLT

SEQ ID NO: 16439 - DNA, 27 bp, Artificial Sequence
  Description of Artificial Sequence: Synthetic oligonucleotide
caacagtataatagtttcccgctcact

SEQ ID NO: 16440 - protein, 9 aa, Artificial Sequence
  Description of Artificial Sequence: Synthetic peptide
QQYNSFPLT

SEQ ID NO: 16441 - DNA, 27 bp, Artificial Sequence
  Description of Artificial Sequence: Synthetic oligonucleotide
ctacagcataatagttacccgctcact

SEQ ID NO: 16442 - protein, 9 aa, Artificial Sequence
  Description of Artificial Sequence: Synthetic peptide
LQHNSYPLT

SEQ ID NO: 16443 - DNA, 27 bp, Artificial Sequence
  Description of Artificial Sequence: Synthetic oligonucleotide
atgcaaagtatacagcttccgctctca

SEQ ID NO: 16444 - protein, 9 aa, Artificial Sequence
  Description of Artificial Sequence: Synthetic peptide
MQSIQLPLS

SEQ ID NO: 16445 - DNA, 27 bp, Artificial Sequence
  Description of Artificial Sequence: Synthetic oligonucleotide
cagcagtatggtagctcacctcggacg

SEQ ID NO: 16446 - protein, 9 aa, Artificial Sequence
  Description of Artificial Sequence: Synthetic peptide
QQYGSSPRT

SEQ ID NO: 16447 - DNA, 27 bp, Artificial Sequence
  Description of Artificial Sequence: Synthetic oligonucleotide
ctacagcataatcgttacccgctcact

SEQ ID NO: 16448 - protein, 9 aa, Artificial Sequence
  Description of Artificial Sequence: Synthetic peptide
LQHNRYPLT

SEQ ID NO: 16449 - DNA, 27 bp, Artificial Sequence
  Description of Artificial Sequence: Synthetic oligonucleotide
caacagtatgaaaatctcccgatcacc

SEQ ID NO: 16450 - protein, 9 aa, Artificial Sequence
  Description of Artificial Sequence: Synthetic peptide
QQYENLPIT

SEQ ID NO: 16451 - DNA, 27 bp, Artificial Sequence
  Description of Artificial Sequence: Synthetic oligonucleotide
ctacagcatagtacttaccctctcact

SEQ ID NO: 16452 - protein, 9 aa, Artificial Sequence
  Description of Artificial Sequence: Synthetic peptide
LQHSTYPLT

SEQ ID NO: 16453 - DNA, 27 bp, Artificial Sequence
  Description of Artificial Sequence: Synthetic oligonucleotide
ctacagcattatagttaccctcggacg

SEQ ID NO: 16454 - protein, 9 aa, Artificial Sequence
  Description of Artificial Sequence: Synthetic peptide
LQHYSYPRT

SEQ ID NO: 16455 - DNA, 33 bp, Artificial Sequence
  Description of Artificial Sequence: Synthetic oligonucleotide
caacagacttacaatattcttccggagcgcagt

SEQ ID NO: 16456 - protein, 11 aa, Artificial Sequence
  Description of Artificial Sequence: Synthetic peptide
QQTYNILPERS

SEQ ID NO: 16457 - DNA, 27 bp, Artificial Sequence
  Description of Artificial Sequence: Synthetic oligonucleotide
ctacagcataataattacccgtggacg

SEQ ID NO: 16458 - protein, 9 aa, Artificial Sequence
  Description of Artificial Sequence: Synthetic peptide
LQHNNYPWT

SEQ ID NO: 16459 - DNA, 30 bp, Artificial Sequence; identical to SEQ ID NO: 16293
  Description of Artificial Sequence: Synthetic oligonucleotide

SEQ ID NO: 16460 - protein, 10 aa, Artificial Sequence
  Description of Artificial Sequence: Synthetic peptide
QQSYRTPLFT

SEQ ID NO: 16461 - DNA, 27 bp, Artificial Sequence
  Description of Artificial Sequence: Synthetic oligonucleotide
ctacagcataatagttacccgctcact

SEQ ID NO: 16462 - protein, 9 aa, Artificial Sequence
  Description of Artificial Sequence: Synthetic peptide
LQHNSYPLT

SEQ ID NO: 16463 - DNA, 27 bp, Artificial Sequence
  Description of Artificial Sequence: Synthetic oligonucleotide
ctacagcataatagttacccgctcact

SEQ ID NO: 16464 - protein, 9 aa, Artificial Sequence
  Description of Artificial Sequence: Synthetic peptide
LQHNSYPLT

SEQ ID NO: 16465 - DNA, 27 bp, Artificial Sequence
  Description of Artificial Sequence: Synthetic oligonucleotide
ctgcaacattatagttaccctcggacg

SEQ ID NO: 16466 - protein, 9 aa, Artificial Sequence
  Description of Artificial Sequence: Synthetic peptide
LQHYSYPRT

SEQ ID NO: 16467 - DNA, 27 bp, Artificial Sequence
  Description of Artificial Sequence: Synthetic oligonucleotide
cagcagtattatgatactcctccgacg

SEQ ID NO: 16468 - protein, 9 aa, Artificial Sequence
  Description of Artificial Sequence: Synthetic peptide
QQYYDTPPT

SEQ ID NO: 16469 - DNA, 27 bp, Artificial Sequence
  Description of Artificial Sequence: Synthetic oligonucleotide
atgcaaagtacacagtttccgctcact

SEQ ID NO: 16470 - protein, 9 aa, Artificial Sequence
  Description of Artificial Sequence: Synthetic peptide
MQSTQFPLT

SEQ ID NO: 16471 - DNA, 27 bp, Artificial Sequence
  Description of Artificial Sequence: Synthetic oligonucleotide
caacagtataatagttacccattcact

SEQ ID NO: 16472 - protein, 9 aa, Artificial Sequence
  Description of Artificial Sequence: Synthetic peptide
QQYNSYPFT

SEQ ID NO: 16473 - DNA, 27 bp, Artificial Sequence
  Description of Artificial Sequence: Synthetic oligonucleotide
caacagtatcatagtttcccattcact

SEQ ID NO: 16474 - protein, 9 aa, Artificial Sequence
  Description of Artificial Sequence: Synthetic peptide
QQYHSFPFT

SEQ ID NO: 16475 - DNA, 27 bp, Artificial Sequence
  Description of Artificial Sequence: Synthetic oligonucleotide
ctacaacataatagttacccgtggacg

SEQ ID NO: 16476 - protein, 9 aa, Artificial Sequence
  Description of Artificial Sequence: Synthetic peptide
LQHNSYPWT

SEQ ID NO: 16477 - DNA, 27 bp, Artificial Sequence
  Description of Artificial Sequence: Synthetic oligonucleotide
ctacagcatagtagttacccgctcact

SEQ ID NO: 16478 - protein, 9 aa, Artificial Sequence
  Description of Artificial Sequence: Synthetic peptide
LQHSSYPLT

SEQ ID NO: 16479 - DNA, 24 bp, Artificial Sequence
  Description of Artificial Sequence: Synthetic oligonucleotide
cagcagtatggtagctcacgcagt

SEQ ID NO: 16480 - protein, 8 aa, Artificial Sequence
  Description of Artificial Sequence: Synthetic peptide
QQYGSSRS

SEQ ID NO: 16481 - DNA, 27 bp, Artificial Sequence
  Description of Artificial Sequence: Synthetic oligonucleotide
ctacagcataatagttacccgctcact

SEQ ID NO: 16482 - protein, 9 aa, Artificial Sequence
  Description of Artificial Sequence: Synthetic peptide
LQHNSYPLT

SEQ ID NO: 16483 - DNA, 30 bp, Artificial Sequence
  Description of Artificial Sequence: Synthetic oligonucleotide
caacagagttacagtacccccttattcact

SEQ ID NO: 16484 - protein, 10 aa, Artificial Sequence
  Description of Artificial Sequence: Synthetic peptide
QQSYSTPLFT

SEQ ID NO: 16485 - DNA, 27 bp, Artificial Sequence
  Description of Artificial Sequence: Synthetic oligonucleotide
ctacagcatgccagttacccgctcact

SEQ ID NO: 16486 - protein, 9 aa, Artificial Sequence
  Description of Artificial Sequence: Synthetic peptide
LQHASYPLT

SEQ ID NO: 16487 - DNA, 27 bp, Artificial Sequence
  Description of Artificial Sequence: Synthetic oligonucleotide
ctacagcataatagttacccgtggacg

SEQ ID NO: 16488 - protein, 9 aa, Artificial Sequence
  Description of Artificial Sequence: Synthetic peptide
LQHNSYPWT

SEQ ID NO: 16489 - DNA, 27 bp, Artificial Sequence
  Description of Artificial Sequence: Synthetic oligonucleotide
ctacagcataatagttacccattcact

SEQ ID NO: 16490 - protein, 9 aa, Artificial Sequence
  Description of Artificial Sequence: Synthetic peptide
LQHNSYPFT

SEQ ID NO: 16491 - DNA, 27 bp, Artificial Sequence
  Description of Artificial Sequence: Synthetic oligonucleotide
ctacagcattatagtttccctcggacg

SEQ ID NO: 16492 - protein, 9 aa, Artificial Sequence
  Description of Artificial Sequence: Synthetic peptide
LQHYSFPRT

SEQ ID NO: 16493 - DNA, 27 bp, Artificial Sequence
  Description of Artificial Sequence: Synthetic oligonucleotide
caacagtatgacagtttccctcggacg

SEQ ID NO: 16494 - protein, 9 aa, Artificial Sequence
  Description of Artificial Sequence: Synthetic peptide
QQYDSFPRT

SEQ ID NO: 16495 - DNA, 27 bp, Artificial Sequence
  Description of Artificial Sequence: Synthetic oligonucleotide
ctacagcataatacttacccgtggacg

SEQ ID NO: 16496 - protein, 9 aa, Artificial Sequence
  Description of Artificial Sequence: Synthetic peptide
LQHNTYPWT

SEQ ID NO: 16497 - DNA, 27 bp, Artificial Sequence
  Description of Artificial Sequence: Synthetic oligonucleotide
ctacagcataatagttacccgctcact

SEQ ID NO: 16498 - protein, 9 aa, Artificial Sequence
  Description of Artificial Sequence: Synthetic peptide
LQHNSYPLT

SEQ ID NO: 16499 - DNA, 27 bp, Artificial Sequence
  Description of Artificial Sequence: Synthetic oligonucleotide
caactcagctacagtcccccgtacact

SEQ ID NO: 16500 - protein, 9 aa, Artificial Sequence
  Description of Artificial Sequence: Synthetic peptide
QLSYSPPYT

SEQ ID NO: 16501 - DNA, 27 bp, Artificial Sequence
  Description of Artificial Sequence: Synthetic oligonucleotide
ttgcaaagtatacaatatcccatcacc

SEQ ID NO: 16502 - protein, 9 aa, Artificial Sequence
  Description of Artificial Sequence: Synthetic peptide
LQSIQYPIT

SEQ ID NO: 16503 - DNA, 27 bp, Artificial Sequence
  Description of Artificial Sequence: Synthetic oligonucleotide
cagcagtattatagtactcctccgacg

SEQ ID NO: 16504 - protein, 9 aa, Artificial Sequence
  Description of Artificial Sequence: Synthetic peptide
QQYYSTPPT

SEQ ID NO: 16505 - DNA, 27 bp, Artificial Sequence
  Description of Artificial Sequence: Synthetic oligonucleotide
atgcaaagtatacagcttccgtggacg

SEQ ID NO: 16506 - protein, 9 aa, Artificial Sequence
  Description of Artificial Sequence: Synthetic peptide
MQSIQLPWT

SEQ ID NO: 16507 - DNA, 27 bp, Artificial Sequence
  Description of Artificial Sequence: Synthetic oligonucleotide
ctacagcataatagttacccattcact

SEQ ID NO: 16508 - protein, 9 aa, Artificial Sequence
  Description of Artificial Sequence: Synthetic peptide
LQHNSYPFT

SEQ ID NO: 16509 - DNA, 24 bp, Artificial Sequence
  Description of Artificial Sequence: Synthetic oligonucleotide
atgcattgtacacactggctcctt

SEQ ID NO: 16510 - protein, 8 aa, Artificial Sequence
  Description of Artificial Sequence: Synthetic peptide
MHCTHWLL

SEQ ID NO: 16511 - DNA, 27 bp, Artificial Sequence
  Description of Artificial Sequence: Synthetic oligonucleotide
atgcaaagtatacagcatccgttcact

SEQ ID NO: 16512 - protein, 9 aa, Artificial Sequence
  Description of Artificial Sequence: Synthetic peptide
MQSIQHPFT

SEQ ID NO: 16513 - DNA, 27 bp, Artificial Sequence
  Description of Artificial Sequence: Synthetic oligonucleotide
ctacagcataatacttacccattcact

SEQ ID NO: 16514 - protein, 9 aa, Artificial Sequence
  Description of Artificial Sequence: Synthetic peptide
LQHNTYPFT

SEQ ID NO: 16515 - DNA, 27 bp, Artificial Sequence
  Description of Artificial Sequence: Synthetic oligonucleotide
ctacagcatactagttaccctcctact

SEQ ID NO: 16516 - protein, 9 aa, Artificial Sequence
  Description of Artificial Sequence: Synthetic peptide
LQHTSYPPT

SEQ ID NO: 16517 - DNA, 27 bp, Artificial Sequence
  Description of Artificial Sequence: Synthetic oligonucleotide
atacaacatattatttaccctcctact

SEQ ID NO: 16518 - protein, 9 aa, Artificial Sequence
  Description of Artificial Sequence: Synthetic peptide
IQHIIYPPT

SEQ ID NO: 16519 - DNA, 27 bp, Artificial Sequence
  Description of Artificial Sequence: Synthetic oligonucleotide
ctacagcataatagttaccccttcact

SEQ ID NO: 16520 - protein, 9 aa, Artificial Sequence
  Description of Artificial Sequence: Synthetic peptide
LQHNSYPFT

SEQ ID NO: 16521 - DNA, 27 bp, Artificial Sequence
  Description of Artificial Sequence: Synthetic oligonucleotide
caacagtatcatagttacccattcact

SEQ ID NO: 16522 - protein, 9 aa, Artificial Sequence
  Description of Artificial Sequence: Synthetic peptide
QQYHSYPFT

SEQ ID NO: 16523 - DNA, 27 bp, Artificial Sequence
  Description of Artificial Sequence: Synthetic oligonucleotide
caacagtatcatagttacccattcact

SEQ ID NO: 16524 - protein, 9 aa, Artificial Sequence
  Description of Artificial Sequence: Synthetic peptide
QQYHSYPFT

SEQ ID NO: 16525 - DNA, 30 bp, Artificial Sequence
  Description of Artificial Sequence: Synthetic oligonucleotide
caacagagttacagtacccctacgtggacg

SEQ ID NO: 16526 - protein, 10 aa, Artificial Sequence
  Description of Artificial Sequence: Synthetic peptide
QQSYSTPTWT

SEQ ID NO: 16527 - DNA, 27 bp, Artificial Sequence
  Description of Artificial Sequence: Synthetic oligonucleotide
caacagtctgacagtttccctcggacg

SEQ ID NO: 16528 - protein, 9 aa, Artificial Sequence
  Description of Artificial Sequence: Synthetic peptide
QQSDSFPRT

SEQ ID NO: 16529 - DNA, 27 bp, Artificial Sequence
  Description of Artificial Sequence: Synthetic oligonucleotide
ctacagcataatacttacccgtggacg

SEQ ID NO: 16530 - protein, 9 aa, Artificial Sequence
  Description of Artificial Sequence: Synthetic peptide
LQHNTYPWT

SEQ ID NO: 16531 - DNA, 27 bp, Artificial Sequence
  Description of Artificial Sequence: Synthetic oligonucleotide
cagcagtattatagtactcctccgacg

SEQ ID NO: 16532 - protein, 9 aa, Artificial Sequence
  Description of Artificial Sequence: Synthetic peptide
QQYYSTPPT

SEQ ID NO: 16533 - DNA, 27 bp, Artificial Sequence
  Description of Artificial Sequence: Synthetic oligonucleotide
caacagtataatagttacccattcact

SEQ ID NO: 16534 - protein, 9 aa, Artificial Sequence
  Description of Artificial Sequence: Synthetic peptide
QQYNSYPFT

SEQ ID NO: 16535 - DNA, 27 bp, Artificial Sequence
  Description of Artificial Sequence: Synthetic oligonucleotide
ctacagcatactatttaccctcctact

SEQ ID NO: 16536 - protein, 9 aa, Artificial Sequence
  Description of Artificial Sequence: Synthetic peptide
LQHTIYPPT

SEQ ID NO: 16537 - DNA, 27 bp, Artificial Sequence
  Description of Artificial Sequence: Synthetic oligonucleotide
caacagtatcatagttacccgctcact

SEQ ID NO: 16538 - protein, 9 aa, Artificial Sequence
  Description of Artificial Sequence: Synthetic peptide
QQYHSYPLT

SEQ ID NO: 16539 - DNA, 27 bp, Artificial Sequence
  Description of Artificial Sequence: Synthetic oligonucleotide
ctacagcataatagttacccattcact

SEQ ID NO: 16540 - protein, 9 aa, Artificial Sequence
  Description of Artificial Sequence: Synthetic peptide
LQHNSYPFT

SEQ ID NO: 16541 - DNA, 27 bp, Artificial Sequence
  Description of Artificial Sequence: Synthetic oligonucleotide
ctacagcataatcgttacccgtggacg

SEQ ID NO: 16542 - protein, 9 aa, Artificial Sequence
  Description of Artificial Sequence: Synthetic peptide
LQHNRYPWT

SEQ ID NO: 16543 - DNA, 27 bp, Artificial Sequence
  Description of Artificial Sequence: Synthetic oligonucleotide
ctacagcattataattaccctcgcagt

SEQ ID NO: 16544 - protein, 9 aa, Artificial Sequence
  Description of Artificial Sequence: Synthetic peptide
LQHYNYPRS

SEQ ID NO: 16545 - DNA, 27 bp, Artificial Sequence
  Description of Artificial Sequence: Synthetic oligonucleotide
caacagtattatagttacccattcact

SEQ ID NO: 16546 - protein, 9 aa, Artificial Sequence
  Description of Artificial Sequence: Synthetic peptide
QQYYSYPFT

SEQ ID NO: 16547 - DNA, 27 bp, Artificial Sequence
  Description of Artificial Sequence: Synthetic oligonucleotide
ctacagcataatagttacccattcact

SEQ ID NO: 16548 - protein, 9 aa, Artificial Sequence
  Description of Artificial Sequence: Synthetic peptide
LQHNSYPFT

SEQ ID NO: 16549 - DNA, 27 bp, Artificial Sequence
  Description of Artificial Sequence: Synthetic oligonucleotide
ctacagcataatagttacccgctcact

SEQ ID NO: 16550 - protein, 9 aa, Artificial Sequence
  Description of Artificial Sequence: Synthetic peptide
LQHNSYPLT

SEQ ID NO: 16551 - DNA, 27 bp, Artificial Sequence
  Description of Artificial Sequence: Synthetic oligonucleotide
ctacagcatactatttaccctcctact

SEQ ID NO: 16552 - protein, 9 aa, Artificial Sequence
  Description of Artificial Sequence: Synthetic peptide
LQHTIYPPT

SEQ ID NO: 16553 - DNA, 27 bp, Artificial Sequence
  Description of Artificial Sequence: Synthetic oligonucleotide
caacagagttacagtaccccattcact

SEQ ID NO: 16554 - protein, 9 aa, Artificial Sequence
  Description of Artificial Sequence: Synthetic peptide
QQSYSTPFT

SEQ ID NO: 16555 - DNA, 27 bp, Artificial Sequence
  Description of Artificial Sequence: Synthetic oligonucleotide
ctacagcatattatttaccctcctact

SEQ ID NO: 16556 - protein, 9 aa, Artificial Sequence
  Description of Artificial Sequence: Synthetic peptide
LQHIIYPPT

SEQ ID NO: 16557 - DNA, 27 bp, Artificial Sequence
  Description of Artificial Sequence: Synthetic oligonucleotide
ctacagcataatagttacccgctcact

SEQ ID NO: 16558 - protein, 9 aa, Artificial Sequence
  Description of Artificial Sequence: Synthetic peptide
LQHNSYPLT

SEQ ID NO: 16559 - DNA, 27 bp, Artificial Sequence
  Description of Artificial Sequence: Synthetic oligonucleotide
ctacagcataatagttacccgctcact

SEQ ID NO: 16560 - protein, 9 aa, Artificial Sequence
  Description of Artificial Sequence: Synthetic peptide
LQHNSYPLT

SEQ ID NO: 16561 - DNA, 27 bp, Artificial Sequence
  Description of Artificial Sequence: Synthetic oligonucleotide
cagcaatattatagtactcctccgacg

SEQ ID NO: 16562 - protein, 9 aa, Artificial Sequence
  Description of Artificial Sequence: Synthetic peptide
QQYYSTPPT

SEQ ID NO: 16563 - DNA, 27 bp, Artificial Sequence
  Description of Artificial Sequence: Synthetic oligonucleotide
atgcaaagtataaagcttccgctcact

SEQ ID NO: 16564 - protein, 9 aa, Artificial Sequence
  Description of Artificial Sequence: Synthetic peptide
MQSIKLPLT

SEQ ID NO: 16565 - DNA, 27 bp, Artificial Sequence
  Description of Artificial Sequence: Synthetic oligonucleotide
caacaggctagcagtttcccattcact

SEQ ID NO: 16566 - protein, 9 aa, Artificial Sequence
  Description of Artificial Sequence: Synthetic peptide
QQASSFPFT

SEQ ID NO: 16567 - DNA, 27 bp, Artificial Sequence
  Description of Artificial Sequence: Synthetic oligonucleotide
ctacagcataatcgttacccattcact

SEQ ID NO: 16568 - protein, 9 aa, Artificial Sequence
  Description of Artificial Sequence: Synthetic peptide
LQHNRYPFT

SEQ ID NO: 16569 - DNA, 27 bp, Artificial Sequence
  Description of Artificial Sequence: Synthetic oligonucleotide
ctacagcataatagttacccattcact

SEQ ID NO: 16570 - protein, 9 aa, Artificial Sequence
  Description of Artificial Sequence: Synthetic peptide
LQHNSYPFT

SEQ ID NO: 16571 - DNA, 27 bp, Artificial Sequence
  Description of Artificial Sequence: Synthetic oligonucleotide
caacagagttacagtactccgctcact

SEQ ID NO: 16572 - protein, 9 aa, Artificial Sequence
  Description of Artificial Sequence: Synthetic peptide
QQSYSTPLT

SEQ ID NO: 16573 - DNA, 27 bp, Artificial Sequence
  Description of Artificial Sequence: Synthetic oligonucleotide
ctacagcatactatttaccctcctact

SEQ ID NO: 16574 - protein, 9 aa, Artificial Sequence
  Description of Artificial Sequence: Synthetic peptide
LQHTIYPPT

SEQ ID NO: 16575 - DNA, 27 bp, Artificial Sequence
  Description of Artificial Sequence: Synthetic oligonucleotide
ctacaggataatagttaccctttcact

SEQ ID NO: 16576 - protein, 9 aa, Artificial Sequence
  Description of Artificial Sequence: Synthetic peptide
LQDNSYPFT

SEQ ID NO: 16577 - DNA, 27 bp, Artificial Sequence
  Description of Artificial Sequence: Synthetic oligonucleotide
caacaggctaacagtttcccaatcact

SEQ ID NO: 16578 - protein, 9 aa, Artificial Sequence
  Description of Artificial Sequence: Synthetic peptide
QQANSFPIT

SEQ ID NO: 16579 - DNA, 27 bp, Artificial Sequence
  Description of Artificial Sequence: Synthetic oligonucleotide
atgcaaagtatacagcttccgctcact

SEQ ID NO: 16580 - protein, 9 aa, Artificial Sequence
  Description of Artificial Sequence: Synthetic peptide
MQSIQLPLT

SEQ ID NO: 16581 - DNA, 27 bp, Artificial Sequence
  Description of Artificial Sequence: Synthetic oligonucleotide
caacagtctgacagtttccctcggacg

SEQ ID NO: 16582 - protein, 9 aa, Artificial Sequence
  Description of Artificial Sequence: Synthetic peptide
QQSDSFPRT

SEQ ID NO: 16583 - DNA, 27 bp, Artificial Sequence
  Description of Artificial Sequence: Synthetic oligonucleotide
caacaggctaacagtctcccattcact

SEQ ID NO: 16584 - protein, 9 aa, Artificial Sequence
  Description of Artificial Sequence: Synthetic peptide
QQANSLPFT

SEQ ID NO: 16585 - DNA, 27 bp, Artificial Sequence
  Description of Artificial Sequence: Synthetic oligonucleotide
ctacagcataatagttacccgctcact

SEQ ID NO: 16586 - protein, 9 aa, Artificial Sequence
  Description of Artificial Sequence: Synthetic peptide
LQHNSYPLT

SEQ ID NO: 16587 - DNA, 27 bp, Artificial Sequence
  Description of Artificial Sequence: Synthetic oligonucleotide
caacagtatgataatctcccgatcacc

SEQ ID NO: 16588 - protein, 9 aa, Artificial Sequence
  Description of Artificial Sequence: Synthetic peptide
QQYDNLPIT

SEQ ID NO: 16589 - DNA, 27 bp, Artificial Sequence
  Description of Artificial Sequence: Synthetic oligonucleotide
ctacaggataatagtcatccattcact

SEQ ID NO: 16590 - protein, 9 aa, Artificial Sequence
  Description of Artificial Sequence: Synthetic peptide
LQDNSHPFT

SEQ ID NO: 16591 - DNA, 27 bp, Artificial Sequence
  Description of Artificial Sequence: Synthetic oligonucleotide
caacagggtaacagtttcccattcact

SEQ ID NO: 16592 - protein, 9 aa, Artificial Sequence
  Description of Artificial Sequence: Synthetic peptide
QQGNSFPFT

SEQ ID NO: 16593 - DNA, 27 bp, Artificial Sequence
  Description of Artificial Sequence: Synthetic oligonucleotide
ctacagcataatagttacccgtggacg

SEQ ID NO: 16594 - protein, 9 aa, Artificial Sequence
  Description of Artificial Sequence: Synthetic peptide
LQHNSYPWT

SEQ ID NO: 16595 - DNA, 27 bp, Artificial Sequence
  Description of Artificial Sequence: Synthetic oligonucleotide
caacaggcttacagtttcccgtggacg

SEQ ID NO: 16596 - protein, 9 aa, Artificial Sequence
  Description of Artificial Sequence: Synthetic peptide
QQAYSFPWT

SEQ ID NO: 16597 - DNA, 27 bp, Artificial Sequence
  Description of Artificial Sequence: Synthetic oligonucleotide
ctacagcataatagttacccgctcact

SEQ ID NO: 16598 - protein, 9 aa, Artificial Sequence
  Description of Artificial Sequence: Synthetic peptide
LQHNSYPLT

SEQ ID NO: 16599 - DNA, 27 bp, Artificial Sequence
  Description of Artificial Sequence: Synthetic oligonucleotide
atgcaaagtatacagcttccgtggacg

SEQ ID NO: 16600 - protein, 9 aa, Artificial Sequence
  Description of Artificial Sequence: Synthetic peptide
MQSIQLPWT

SEQ ID NO: 16601 - DNA, 27 bp, Artificial Sequence
  Description of Artificial Sequence: Synthetic oligonucleotide
ctacagcataatagttacccgctcact

SEQ ID NO: 16602 - protein, 9 aa, Artificial Sequence
  Description of Artificial Sequence: Synthetic peptide
LQHNSYPLT

SEQ ID NO: 16603 - DNA, 27 bp, Artificial Sequence
  Description of Artificial Sequence: Synthetic oligonucleotide
atgcaaagtatacagattccgtggacg

SEQ ID NO: 16604 - protein, 9 aa, Artificial Sequence
  Description of Artificial Sequence: Synthetic peptide
MQSIQIPWT

SEQ ID NO: 16605 - DNA, 27 bp, Artificial Sequence
  Description of Artificial Sequence: Synthetic oligonucleotide
ctacagcataatagttacccattcact

SEQ ID NO: 16606 - protein, 9 aa, Artificial Sequence
  Description of Artificial Sequence: Synthetic peptide
LQHNSYPFT

SEQ ID NO: 16607 - DNA, 27 bp, Artificial Sequence
  Description of Artificial Sequence: Synthetic oligonucleotide
ctacagcatactagttaccctcctact

SEQ ID NO: 16608 - protein, 9 aa, Artificial Sequence
  Description of Artificial Sequence: Synthetic peptide
LQHTSYPPT

SEQ ID NO: 16609 - DNA, 27 bp, Artificial Sequence
  Description of Artificial Sequence: Synthetic oligonucleotide
caacagagttacattaccccgctcact

SEQ ID NO: 16610 - protein, 9 aa, Artificial Sequence
  Description of Artificial Sequence: Synthetic peptide
QQSYITPLT

SEQ ID NO: 16611 - DNA, 30 bp, Artificial Sequence
  Description of Artificial Sequence: Synthetic oligonucleotide
cagcagtataataattggcctccgtggccg

SEQ ID NO: 16612 - protein, 10 aa, Artificial Sequence
  Description of Artificial Sequence: Synthetic peptide
QQYNNWPPWP

SEQ ID NO: 16613 - DNA, 27 bp, Artificial Sequence
  Description of Artificial Sequence: Synthetic oligonucleotide
ctacagcattataattaccctcgcagt

SEQ ID NO: 16614 - protein, 9 aa, Artificial Sequence
  Description of Artificial Sequence: Synthetic peptide
LQHYNYPRS

SEQ ID NO: 16615 - DNA, 27 bp, Artificial Sequence
  Description of Artificial Sequence: Synthetic oligonucleotide
ctacagcataatcgttacccgctcact

SEQ ID NO: 16616 - protein, 9 aa, Artificial Sequence
  Description of Artificial Sequence: Synthetic peptide
LQHNRYPLT

SEQ ID NO: 16617 - DNA, 30 bp, Artificial Sequence; identical to SEQ ID NO: 16611
  Description of Artificial Sequence: Synthetic oligonucleotide

SEQ ID NO: 16618 - protein, 10 aa, Artificial Sequence
  Description of Artificial Sequence: Synthetic peptide
QQYNNWPPWP

SEQ ID NO: 16619 - DNA, 27 bp, Artificial Sequence
  Description of Artificial Sequence: Synthetic oligonucleotide
ctacagcataatagttatccgctcact

SEQ ID NO: 16620 - protein, 9 aa, Artificial Sequence
  Description of Artificial Sequence: Synthetic peptide
LQHNSYPLT

SEQ ID NO: 16621 - DNA, 27 bp, Artificial Sequence
  Description of Artificial Sequence: Synthetic oligonucleotide
ctacagcataatagttacccgttcact

SEQ ID NO: 16622 - protein, 9 aa, Artificial Sequence
  Description of Artificial Sequence: Synthetic peptide
LQHNSYPFT

SEQ ID NO: 16623 - DNA, 27 bp, Artificial Sequence
  Description of Artificial Sequence: Synthetic oligonucleotide
ctacagcatactagttaccctcctact

SEQ ID NO: 16624 - protein, 9 aa, Artificial Sequence
  Description of Artificial Sequence: Synthetic peptide
LQHTSYPPT

SEQ ID NO: 16625 - DNA, 27 bp, Artificial Sequence
  Description of Artificial Sequence: Synthetic oligonucleotide
ctgcagcatactatttaccctcctact

SEQ ID NO: 16626 - protein, 9 aa, Artificial Sequence
  Description of Artificial Sequence: Synthetic peptide
LQHTIYPPT

SEQ ID NO: 16627 - DNA, 27 bp, Artificial Sequence
  Description of Artificial Sequence: Synthetic oligonucleotide
caacagtatgataatctcccgatcacc

SEQ ID NO: 16628 - protein, 9 aa, Artificial Sequence
  Description of Artificial Sequence: Synthetic peptide
QQYDNLPIT

SEQ ID NO: 16629 - DNA, 27 bp, Artificial Sequence
  Description of Artificial Sequence: Synthetic oligonucleotide
caacagagttacaatatcccgatcacc

SEQ ID NO: 16630 - protein, 9 aa, Artificial Sequence
  Description of Artificial Sequence: Synthetic peptide
QQSYNIPIT

SEQ ID NO: 16631 - DNA, 27 bp, Artificial Sequence
  Description of Artificial Sequence: Synthetic oligonucleotide
caacagagttacagtactccgctcact

SEQ ID NO: 16632 - protein, 9 aa, Artificial Sequence
  Description of Artificial Sequence: Synthetic peptide
QQSYSTPLT

SEQ ID NO: 16633 - DNA, 27 bp, Artificial Sequence
  Description of Artificial Sequence: Synthetic oligonucleotide
ctccagcatactatttaccctcctact

SEQ ID NO: 16634 - protein, 9 aa, Artificial Sequence
  Description of Artificial Sequence: Synthetic peptide
LQHTIYPPT

SEQ ID NO: 16635 - DNA, 27 bp, Artificial Sequence
  Description of Artificial Sequence: Synthetic oligonucleotide
ctccatcatcctatttaccctcctact

SEQ ID NO: 16636 - protein, 9 aa, Artificial Sequence
  Description of Artificial Sequence: Synthetic peptide
LHHPIYPPT

SEQ ID NO: 16637 - DNA, 27 bp, Artificial Sequence
  Description of Artificial Sequence: Synthetic oligonucleotide
ctacagcataatagttacccgctcact

SEQ ID NO: 16638 - protein, 9 aa, Artificial Sequence
  Description of Artificial Sequence: Synthetic peptide
LQHNSYPLT

SEQ ID NO: 16639 - DNA, 27 bp, Artificial Sequence
  Description of Artificial Sequence: Synthetic oligonucleotide
ctacagcattatagttaccctcctact

SEQ ID NO: 16640 - protein, 9 aa, Artificial Sequence
  Description of Artificial Sequence: Synthetic peptide
LQHYSYPPT

SEQ ID NO: 16641 - DNA, 27 bp, Artificial Sequence
  Description of Artificial Sequence: Synthetic oligonucleotide
caacagtttaatagttaccctctgacg

SEQ ID NO: 16642 - protein, 9 aa, Artificial Sequence
  Description of Artificial Sequence: Synthetic peptide
QQFNSYPLT

SEQ ID NO: 16643 - DNA, 27 bp, Artificial Sequence
  Description of Artificial Sequence: Synthetic oligonucleotide
caacaggctaacagtttccctttcact

SEQ ID NO: 16644 - protein, 9 aa, Artificial Sequence
  Description of Artificial Sequence: Synthetic peptide
QQANSFPFT

SEQ ID NO: 16645 - DNA, 27 bp, Artificial Sequence
  Description of Artificial Sequence: Synthetic oligonucleotide
caacagacttgcagtaccccgctcact

SEQ ID NO: 16646 - protein, 9 aa, Artificial Sequence
  Description of Artificial Sequence: Synthetic peptide
QQTCSTPLT

SEQ ID NO: 16647 - DNA, 27 bp, Artificial Sequence
  Description of Artificial Sequence: Synthetic oligonucleotide
caacaggctaacagtttcccattcact

SEQ ID NO: 16648 - protein, 9 aa, Artificial Sequence
  Description of Artificial Sequence: Synthetic peptide
QQANSFPFT

SEQ ID NO: 16649 - DNA, 27 bp, Artificial Sequence
  Description of Artificial Sequence: Synthetic oligonucleotide
caacaggctaacagtttccctttcact

SEQ ID NO: 16650 - protein, 9 aa, Artificial Sequence
  Description of Artificial Sequence: Synthetic peptide
QQANSFPFT

SEQ ID NO: 16651 - DNA, 27 bp, Artificial Sequence
  Description of Artificial Sequence: Synthetic oligonucleotide
cagcaatattatagttctccgtgcagt

SEQ ID NO: 16652 - protein, 9 aa, Artificial Sequence
  Description of Artificial Sequence: Synthetic peptide
QQYYSSPCS

SEQ ID NO: 16653 - DNA, 27 bp, Artificial Sequence
  Description of Artificial Sequence: Synthetic oligonucleotide
caacagtataatagttacccattcact

SEQ ID NO: 16654 - protein, 9 aa, Artificial Sequence
  Description of Artificial Sequence: Synthetic peptide
QQYNSYPFT

SEQ ID NO: 16655 - DNA, 27 bp, Artificial Sequence
  Description of Artificial Sequence: Synthetic oligonucleotide
caacagagttacagtaccccgtacact

SEQ ID NO: 16656 - protein, 9 aa, Artificial Sequence
  Description of Artificial Sequence: Synthetic peptide
QQSYSTPYT

SEQ ID NO: 16657 - DNA, 27 bp, Artificial Sequence
  Description of Artificial Sequence: Synthetic oligonucleotide
ctacaacatagttcttaccccatcacc

SEQ ID NO: 16658 - protein, 9 aa, Artificial Sequence
  Description of Artificial Sequence: Synthetic peptide
LQHSSYPIT

SEQ ID NO: 16659 - DNA, 27 bp, Artificial Sequence
  Description of Artificial Sequence: Synthetic oligonucleotide
ctacagcatactatttaccctcctact

SEQ ID NO: 16660 - protein, 9 aa, Artificial Sequence
  Description of Artificial Sequence: Synthetic peptide
LQHTIYPPT

SEQ ID NO: 16661 - DNA, 27 bp, Artificial Sequence
  Description of Artificial Sequence: Synthetic oligonucleotide
caacaggctaacagtttcccgttcact

SEQ ID NO: 16662 - protein, 9 aa, Artificial Sequence
  Description of Artificial Sequence: Synthetic peptide
QQANSFPFT

SEQ ID NO: 16663 - DNA, 27 bp, Artificial Sequence
  Description of Artificial Sequence: Synthetic oligonucleotide
caacagagttacagtaccccgtacact

SEQ ID NO: 16664 - protein, 9 aa, Artificial Sequence
  Description of Artificial Sequence: Synthetic peptide
QQSYSTPYT

SEQ ID NO: 16665 - DNA, 27 bp, Artificial Sequence
  Description of Artificial Sequence: Synthetic oligonucleotide
ctacagcatactatttaccctcctact

SEQ ID NO: 16666 - protein, 9 aa, Artificial Sequence
  Description of Artificial Sequence: Synthetic peptide
LQHTIYPPT

SEQ ID NO: 16667 - DNA, 27 bp, Artificial Sequence
  Description of Artificial Sequence: Synthetic oligonucleotide
ctacagcatactatttaccctcctact

SEQ ID NO: 16668 - protein, 9 aa, Artificial Sequence
  Description of Artificial Sequence: Synthetic peptide
LQHTIYPPT

SEQ ID NO: 16669 - DNA, 27 bp, Artificial Sequence
  Description of Artificial Sequence: Synthetic oligonucleotide
ctacagcataatagttaccctcctact

SEQ ID NO: 16670 - protein, 9 aa, Artificial Sequence
  Description of Artificial Sequence: Synthetic peptide
LQHNSYPPT

SEQ ID NO: 16671 - DNA, 27 bp, Artificial Sequence
  Description of Artificial Sequence: Synthetic oligonucleotide
caacagacttacattaccccgctcact

SEQ ID NO: 16672 - protein, 9 aa, Artificial Sequence
  Description of Artificial Sequence: Synthetic peptide
QQTYITPLT

SEQ ID NO: 16673 - DNA, 27 bp, Artificial Sequence
  Description of Artificial Sequence: Synthetic oligonucleotide
ctacagcatactatttaccctcctact

SEQ ID NO: 16674 - protein, 9 aa, Artificial Sequence
  Description of Artificial Sequence: Synthetic peptide
LQHTIYPPT

SEQ ID NO: 16675 - DNA, 27 bp, Artificial Sequence
  Description of Artificial Sequence: Synthetic oligonucleotide
caacaggctaacagtttcccattcact

SEQ ID NO: 16676 - protein, 9 aa, Artificial Sequence
  Description of Artificial Sequence: Synthetic peptide
QQANSFPFT

SEQ ID NO: 16677 - DNA, 27 bp, Artificial Sequence
  Description of Artificial Sequence: Synthetic oligonucleotide
caacagagttacagtaccccattcact

SEQ ID NO: 16678 - protein, 9 aa, Artificial Sequence
  Description of Artificial Sequence: Synthetic peptide
QQSYSTPFT

SEQ ID NO: 16679 - DNA, 27 bp, Artificial Sequence
  Description of Artificial Sequence: Synthetic oligonucleotide
caacaggctaacagtttcccattcact

SEQ ID NO: 16680 - protein, 9 aa, Artificial Sequence
  Description of Artificial Sequence: Synthetic peptide
QQANSFPFT

SEQ ID NO: 16681 - DNA, 27 bp, Artificial Sequence
  Description of Artificial Sequence: Synthetic oligonucleotide
ctacagcataatagttaccctcctact

SEQ ID NO: 16682 - protein, 9 aa, Artificial Sequence
  Description of Artificial Sequence: Synthetic peptide
LQHNSYPPT

SEQ ID NO: 16683 - DNA, 27 bp, Artificial Sequence
  Description of Artificial Sequence: Synthetic oligonucleotide
caacagtataatagttacccattcact

SEQ ID NO: 16684 - protein, 9 aa, Artificial Sequence
  Description of Artificial Sequence: Synthetic peptide
QQYNSYPFT

SEQ ID NO: 16685 - DNA, 27 bp, Artificial Sequence
  Description of Artificial Sequence: Synthetic oligonucleotide
caacagagttacagtaccccgtacact

SEQ ID NO: 16686 - protein, 9 aa, Artificial Sequence
  Description of Artificial Sequence: Synthetic peptide
QQSYSTPYT

SEQ ID NO: 16687 - DNA, 27 bp, Artificial Sequence
  Description of Artificial Sequence: Synthetic oligonucleotide
ctacagcattatagttaccctcctact

SEQ ID NO: 16688 - protein, 9 aa, Artificial Sequence
  Description of Artificial Sequence: Synthetic peptide
LQHYSYPPT

SEQ ID NO: 16689 - DNA, 27 bp, Artificial Sequence
  Description of Artificial Sequence: Synthetic oligonucleotide
ctacagcatactatttaccctcccact

SEQ ID NO: 16690 - protein, 9 aa, Artificial Sequence
  Description of Artificial Sequence: Synthetic peptide
LQHTIYPPT

SEQ ID NO: 16691 - DNA, 27 bp, Artificial Sequence
  Description of Artificial Sequence: Synthetic oligonucleotide
ctacagcatactgtttaccctcctact

SEQ ID NO: 16692 - protein, 9 aa, Artificial Sequence
  Description of Artificial Sequence: Synthetic peptide
LQHTVYPPT

SEQ ID NO: 16693 - DNA, 27 bp, Artificial Sequence
  Description of Artificial Sequence: Synthetic oligonucleotide
ctacagcataatagttacccgtggacg

SEQ ID NO: 16694 - protein, 9 aa, Artificial Sequence
  Description of Artificial Sequence: Synthetic peptide
LQHNSYPWT

SEQ ID NO: 16695 - DNA, 27 bp, Artificial Sequence
  Description of Artificial Sequence: Synthetic oligonucleotide
caacaggctaacattttcccgttcact

SEQ ID NO: 16696 - protein, 9 aa, Artificial Sequence
  Description of Artificial Sequence: Synthetic peptide
QQANIFPFT

SEQ ID NO: 16697 - DNA, 27 bp, Artificial Sequence
  Description of Artificial Sequence: Synthetic oligonucleotide
caacagagttacagtaccccgtacact

SEQ ID NO: 16698 - protein, 9 aa, Artificial Sequence
  Description of Artificial Sequence: Synthetic peptide
QQSYSTPYT

SEQ ID NO: 16699 - DNA, 27 bp, Artificial Sequence
  Description of Artificial Sequence: Synthetic oligonucleotide
caacagagttacagtaccccgtacact

SEQ ID NO: 16700 - protein, 9 aa, Artificial Sequence
  Description of Artificial Sequence: Synthetic peptide
QQSYSTPYT

SEQ ID NO: 16701 - DNA, 27 bp, Artificial Sequence
  Description of Artificial Sequence: Synthetic oligonucleotide
caacagtatgataatctcccgatcacc

SEQ ID NO: 16702 - protein, 9 aa, Artificial Sequence
  Description of Artificial Sequence: Synthetic peptide
QQYDNLPIT

SEQ ID NO: 16703 - DNA, 27 bp, Artificial Sequence
  Description of Artificial Sequence: Synthetic oligonucleotide
caacaggctaacagtttcccattcact

SEQ ID NO: 16704 - protein, 9 aa, Artificial Sequence
  Description of Artificial Sequence: Synthetic peptide
QQANSFPFT

SEQ ID NO: 16705 - DNA, 27 bp, Artificial Sequence
  Description of Artificial Sequence: Synthetic oligonucleotide
caacagtttaatagttaccctccgacg

SEQ ID NO: 16706 - protein, 9 aa, Artificial Sequence
  Description of Artificial Sequence: Synthetic peptide
QQFNSYPPT

SEQ ID NO: 16707 - DNA, 24 bp, Artificial Sequence
  Description of Artificial Sequence: Synthetic oligonucleotide
atgcaaagtaaacagcttcctcct

SEQ ID NO: 16708 - protein, 8 aa, Artificial Sequence
  Description of Artificial Sequence: Synthetic peptide
MQSKQLPP

SEQ ID NO: 16709 - DNA, 27 bp, Artificial Sequence
  Description of Artificial Sequence: Synthetic oligonucleotide
ctacagcatactatttaccctcctact

SEQ ID NO: 16710 - protein, 9 aa, Artificial Sequence
  Description of Artificial Sequence: Synthetic peptide
LQHTIYPPT

SEQ ID NO: 16711 - DNA, 27 bp, Artificial Sequence
  Description of Artificial Sequence: Synthetic oligonucleotide
caccagagttacaatctcccgatcacc

SEQ ID NO: 16712 - protein, 9 aa, Artificial Sequence
  Description of Artificial Sequence: Synthetic peptide
HQSYNLPIT

SEQ ID NO: 16713 - DNA, 27 bp, Artificial Sequence
  Description of Artificial Sequence: Synthetic oligonucleotide
ctacaccacaatagttaccctcctaag

SEQ ID NO: 16714 - protein, 9 aa, Artificial Sequence
  Description of Artificial Sequence: Synthetic peptide
LHHNSYPPK

SEQ ID NO: 16715 - DNA, 27 bp, Artificial Sequence
  Description of Artificial Sequence: Synthetic oligonucleotide
caacagtctgacagtttccctcggacg

SEQ ID NO: 16716 - protein, 9 aa, Artificial Sequence
  Description of Artificial Sequence: Synthetic peptide
QQSDSFPRT

SEQ ID NO: 16717 - DNA, 30 bp, Artificial Sequence
  Description of Artificial Sequence: Synthetic oligonucleotide
caggcgtgggacagcagctcttatgtggta

SEQ ID NO: 16718 - protein, 10 aa, Artificial Sequence
  Description of Artificial Sequence: Synthetic peptide
QAWDSSSYVV

SEQ ID NO: 16719 - DNA, 27 bp, Artificial Sequence
  Description of Artificial Sequence: Synthetic oligonucleotide
caggcgtgggacaacagcactgtggta

SEQ ID NO: 16720 - protein, 9 aa, Artificial Sequence
  Description of Artificial Sequence: Synthetic peptide
QAWDNSTVV

SEQ ID NO: 16721 - DNA, 27 bp, Artificial Sequence
  Description of Artificial Sequence: Synthetic oligonucleotide
caggcgtgggtcaacaacactatgata

SEQ ID NO: 16722 - protein, 9 aa, Artificial Sequence
  Description of Artificial Sequence: Synthetic peptide
QAWVNNTMI

SEQ ID NO: 16723 - DNA, 39 bp, Artificial Sequence
  Description of Artificial Sequence: Synthetic oligonucleotide
ggagagagccacacgatcgatggccaagtcggtgtggta

SEQ ID NO: 16724 - protein, 13 aa, Artificial Sequence
  Description of Artificial Sequence: Synthetic peptide
GESHTIDGQVGVV

SEQ ID NO: 16725 - DNA, 27 bp, Artificial Sequence
  Description of Artificial Sequence: Synthetic oligonucleotide
caggcgtgggacagtagtactgtggta

SEQ ID NO: 16726 - protein, 9 aa, Artificial Sequence
  Description of Artificial Sequence: Synthetic peptide
QAWDSSTVV

SEQ ID NO: 16727 - DNA, 27 bp, Artificial Sequence
  Description of Artificial Sequence: Synthetic oligonucleotide
caggcgtgggacaacaccactgtggta

SEQ ID NO: 16728 - protein, 9 aa, Artificial Sequence
  Description of Artificial Sequence: Synthetic peptide
QAWDNTTVV

SEQ ID NO: 16729 - DNA, 36 bp, Artificial Sequence
  Description of Artificial Sequence: Synthetic oligonucleotide
gcagcatgggatgacagcctgaatggtcatgtggta

SEQ ID NO: 16730 - protein, 12 aa, Artificial Sequence
  Description of Artificial Sequence: Synthetic peptide
AAWDDSLNGHVV

SEQ ID NO: 16731 - DNA, 27 bp, Artificial Sequence
  Description of Artificial Sequence: Synthetic oligonucleotide
caggcgtgggacaacaacactgtgata

SEQ ID NO: 16732 - protein, 9 aa, Artificial Sequence
  Description of Artificial Sequence: Synthetic peptide
QAWDNNTVI

SEQ ID NO: 16733 - DNA, 27 bp, Artificial Sequence
  Description of Artificial Sequence: Synthetic oligonucleotide
caggcgtgggacagcagcactgcggta

SEQ ID NO: 16734 - protein, 9 aa, Artificial Sequence
  Description of Artificial Sequence: Synthetic peptide
QAWDSSTAV

SEQ ID NO: 16735 - DNA, 24 bp, Artificial Sequence
  Description of Artificial Sequence: Synthetic oligonucleotide
caggcgtgggtcaacaacactgta

SEQ ID NO: 16736 - protein, 8 aa, Artificial Sequence
  Description of Artificial Sequence: Synthetic peptide
QAWVNNTV

SEQ ID NO: 16737 - DNA, 24 bp, Artificial Sequence
  Description of Artificial Sequence: Synthetic oligonucleotide
caggcgtgggacagcagcactgta

SEQ ID NO: 16738 - protein, 8 aa, Artificial Sequence
  Description of Artificial Sequence: Synthetic peptide
QAWDSSTV

SEQ ID NO: 16739 - DNA, 27 bp, Artificial Sequence
  Description of Artificial Sequence: Synthetic oligonucleotide
caggcgtgggacaacaacactgtgata

SEQ ID NO: 16740 - protein, 9 aa, Artificial Sequence
  Description of Artificial Sequence: Synthetic peptide
QAWDNNTVI

SEQ ID NO: 16741 - DNA, 30 bp, Artificial Sequence; identical to SEQ ID NO: 16215
  Description of Artificial Sequence: Synthetic oligonucleotide

SEQ ID NO: 16742 - protein, 10 aa, Artificial Sequence
  Description of Artificial Sequence: Synthetic peptide
QAWDSSTYVV

SEQ ID NO: 16743 - DNA, 27 bp, Artificial Sequence
  Description of Artificial Sequence: Synthetic oligonucleotide
caggcgtgggtcaataacactatgata

SEQ ID NO: 16744 - protein, 9 aa, Artificial Sequence
  Description of Artificial Sequence: Synthetic peptide
QAWVNNTMI

SEQ ID NO: 16745 - DNA, 30 bp, Artificial Sequence
  Description of Artificial Sequence: Synthetic oligonucleotide
caggcgtgggacagtagcacttatgtggta

SEQ ID NO: 16746 - protein, 10 aa, Artificial Sequence
  Description of Artificial Sequence: Synthetic peptide
QAWDSSTYVV

SEQ ID NO: 16747 - DNA, 27 bp, Artificial Sequence
  Description of Artificial Sequence: Synthetic oligonucleotide
caggcgtgggacaacagcactgcggta

SEQ ID NO: 16748 - protein, 9 aa, Artificial Sequence
  Description of Artificial Sequence: Synthetic peptide
QAWDNSTAV

SEQ ID NO: 16749 - DNA, 27 bp, Artificial Sequence
  Description of Artificial Sequence: Synthetic oligonucleotide
caggcgtgggacaacaacactgtgata

SEQ ID NO: 16750 - protein, 9 aa, Artificial Sequence
  Description of Artificial Sequence: Synthetic peptide
QAWDNNTVI

SEQ ID NO: 16751 - DNA, 33 bp, Artificial Sequence; identical to SEQ ID NO: 16217
  Description of Artificial Sequence: Synthetic oligonucleotide

SEQ ID NO: 16752 - protein, 11 aa, Artificial Sequence
  Description of Artificial Sequence: Synthetic peptide
QVWDSSSDHVV

SEQ ID NO: 16753 - DNA, 30 bp, Artificial Sequence
  Description of Artificial Sequence: Synthetic oligonucleotide
caggcgtggggcaacagcactgctgtggta

SEQ ID NO: 16754 - protein, 10 aa, Artificial Sequence
  Description of Artificial Sequence: Synthetic peptide
QAWGNSTAVV

SEQ ID NO: 16755 - DNA, 33 bp, Artificial Sequence
  Description of Artificial Sequence: Synthetic oligonucleotide
caggtgtgggatagtagcagtgatcatgtggta

SEQ ID NO: 16756 - protein, 11 aa, Artificial Sequence
  Description of Artificial Sequence: Synthetic peptide
QVWDSSSDHVV

SEQ ID NO: 16757 - DNA, 27 bp, Artificial Sequence
  Description of Artificial Sequence: Synthetic oligonucleotide
caggcgtgggacagcatcactgcagta

SEQ ID NO: 16758 - protein, 9 aa, Artificial Sequence
  Description of Artificial Sequence: Synthetic peptide
QAWDSITAV

SEQ ID NO: 16759 - DNA, 24 bp, Artificial Sequence
  Description of Artificial Sequence: Synthetic oligonucleotide
caggcgtgggacagcagcactgtt

SEQ ID NO: 16760 - protein, 8 aa, Artificial Sequence
  Description of Artificial Sequence: Synthetic peptide
QAWDSSTV

SEQ ID NO: 16761 - DNA, 27 bp, Artificial Sequence
  Description of Artificial Sequence: Synthetic oligonucleotide
caggcgtgggacagcaccaccgtggta

SEQ ID NO: 16762 - protein, 9 aa, Artificial Sequence
  Description of Artificial Sequence: Synthetic peptide
QAWDSTTVV

SEQ ID NO: 16763 - DNA, 30 bp, Artificial Sequence; identical to SEQ ID NO: 16753
  Description of Artificial Sequence: Synthetic oligonucleotide

SEQ ID NO: 16764 - protein, 10 aa, Artificial Sequence
  Description of Artificial Sequence: Synthetic peptide
QAWGNSTAVV

SEQ ID NO: 16765 - DNA, 24 bp, Artificial Sequence
  Description of Artificial Sequence: Synthetic oligonucleotide
caggcgtgggacagcagcacggta

SEQ ID NO: 16766 - protein, 8 aa, Artificial Sequence
  Description of Artificial Sequence: Synthetic peptide
QAWDSSTV

SEQ ID NO: 16767 - DNA, 24 bp, Artificial Sequence
  Description of Artificial Sequence: Synthetic oligonucleotide
caggcgtgggacagcagcactgta

SEQ ID NO: 16768 - protein, 8 aa, Artificial Sequence
  Description of Artificial Sequence: Synthetic peptide
QAWDSSTV

SEQ ID NO: 16769 - DNA, 27 bp, Artificial Sequence
  Description of Artificial Sequence: Synthetic oligonucleotide
caggcgtgggacaacagcactgcggta

SEQ ID NO: 16770 - protein, 9 aa, Artificial Sequence
  Description of Artificial Sequence: Synthetic peptide
QAWDNSTAV

SEQ ID NO: 16771 - DNA, 36 bp, Artificial Sequence; identical to SEQ ID NO: 16729
  Description of Artificial Sequence: Synthetic oligonucleotide

SEQ ID NO: 16772 - protein, 12 aa, Artificial Sequence
  Description of Artificial Sequence: Synthetic peptide
AAWDDSLNGHVV

SEQ ID NO: 16773 - DNA, 30 bp, Artificial Sequence
  Description of Artificial Sequence: Synthetic oligonucleotide
agctcatatacaagcagcatcactgtggta

SEQ ID NO: 16774 - protein, 10 aa, Artificial Sequence
  Description of Artificial Sequence: Synthetic peptide
SSYTSSITVV

SEQ ID NO: 16775 - DNA, 24 bp, Artificial Sequence
  Description of Artificial Sequence: Synthetic oligonucleotide
caggcgtgggtcaacaacactgta

SEQ ID NO: 16776 - protein, 8 aa, Artificial Sequence
  Description of Artificial Sequence: Synthetic peptide
QAWVNNTV

SEQ ID NO: 16777 - DNA, 27 bp, Artificial Sequence
  Description of Artificial Sequence: Synthetic oligonucleotide
caggcgtgggacaacagcactgtggtt

SEQ ID NO: 16778 - protein, 9 aa, Artificial Sequence
  Description of Artificial Sequence: Synthetic peptide
QAWDNSTVV

SEQ ID NO: 16779 - DNA, 27 bp, Artificial Sequence
  Description of Artificial Sequence: Synthetic oligonucleotide
cagcaatattattgtactcctccgacg

SEQ ID NO: 16780 - protein, 9 aa, Artificial Sequence
  Description of Artificial Sequence: Synthetic peptide
QQYYCTPPT

SEQ ID NO: 16781 - DNA, 27 bp, Artificial Sequence
  Description of Artificial Sequence: Synthetic oligonucleotide
caggcgtgggacaacagcactgcggta

SEQ ID NO: 16782 - protein, 9 aa, Artificial Sequence
  Description of Artificial Sequence: Synthetic peptide
QAWDNSTAV

SEQ ID NO: 16783 - DNA, 24 bp, Artificial Sequence
  Description of Artificial Sequence: Synthetic oligonucleotide
cagcagtatggtagttcacgcagt

SEQ ID NO: 16784 - protein, 8 aa, Artificial Sequence
  Description of Artificial Sequence: Synthetic peptide
QQYGSSRS

SEQ ID NO: 16785 - DNA, 27 bp, Artificial Sequence
  Description of Artificial Sequence: Synthetic oligonucleotide
ctacaacataatagttacccgctcact

SEQ ID NO: 16786 - protein, 9 aa, Artificial Sequence
  Description of Artificial Sequence: Synthetic peptide
LQHNSYPLT

SEQ ID NO: 16787 - DNA, 27 bp, Artificial Sequence
  Description of Artificial Sequence: Synthetic oligonucleotide
ctacagcatagtagttacccgctcact

SEQ ID NO: 16788 - protein, 9 aa, Artificial Sequence
  Description of Artificial Sequence: Synthetic peptide
LQHSSYPLT

SEQ ID NO: 16789 - DNA, 27 bp, Artificial Sequence
  Description of Artificial Sequence: Synthetic oligonucleotide
ctacagcataatagtcaccctctcact

SEQ ID NO: 16790 - protein, 9 aa, Artificial Sequence
  Description of Artificial Sequence: Synthetic peptide
LQHNSHPLT

SEQ ID NO: 16791 - DNA, 27 bp, Artificial Sequence
  Description of Artificial Sequence: Synthetic oligonucleotide
caacaggctaacagtttcccgtggacg

SEQ ID NO: 16792 - protein, 9 aa, Artificial Sequence
  Description of Artificial Sequence: Synthetic peptide
QQANSFPWT

SEQ ID NO: 16793 - DNA, 27 bp, Artificial Sequence
  Description of Artificial Sequence: Synthetic oligonucleotide
ctacagcataatagttacccgtggacg

SEQ ID NO: 16794 - protein, 9 aa, Artificial Sequence
  Description of Artificial Sequence: Synthetic peptide
LQHNSYPWT

SEQ ID NO: 16795 - DNA, 27 bp, Artificial Sequence
  Description of Artificial Sequence: Synthetic oligonucleotide
ctacagcatagtgcttacccgctcact

SEQ ID NO: 16796 - protein, 9 aa, Artificial Sequence
  Description of Artificial Sequence: Synthetic peptide
LQHSAYPLT

SEQ ID NO: 16797 - DNA, 27 bp, Artificial Sequence
  Description of Artificial Sequence: Synthetic oligonucleotide
ctacagcatagtagttacccgctcact

SEQ ID NO: 16798 - protein, 9 aa, Artificial Sequence
  Description of Artificial Sequence: Synthetic peptide
LQHSSYPLT

SEQ ID NO: 16799 - DNA, 27 bp, Artificial Sequence
  Description of Artificial Sequence: Synthetic oligonucleotide
ctacagcataatagttacccgctcact

SEQ ID NO: 16800 - protein, 9 aa, Artificial Sequence
  Description of Artificial Sequence: Synthetic peptide
LQHNSYPLT

SEQ ID NO: 16801 - DNA, 27 bp, Artificial Sequence
  Description of Artificial Sequence: Synthetic oligonucleotide
ctacagcataatagttacccgttcact

SEQ ID NO: 16802 - protein, 9 aa, Artificial Sequence
  Description of Artificial Sequence: Synthetic peptide
LQHNSYPFT

SEQ ID NO: 16803 - DNA, 27 bp, Artificial Sequence
  Description of Artificial Sequence: Synthetic oligonucleotide
ctacagcataatagttacccattcact

SEQ ID NO: 16804 - protein, 9 aa, Artificial Sequence
  Description of Artificial Sequence: Synthetic peptide
LQHNSYPFT

SEQ ID NO: 16805 - DNA, 30 bp, Artificial Sequence
  Description of Artificial Sequence: Synthetic oligonucleotide
caacagagttacaatacccccttcttcact

SEQ ID NO: 16806 - protein, 10 aa, Artificial Sequence
  Description of Artificial Sequence: Synthetic peptide
QQSYNTPFFT

SEQ ID NO: 16807 - DNA, 27 bp, Artificial Sequence
  Description of Artificial Sequence: Synthetic oligonucleotide
ctacagcataatagttacccgctcact

SEQ ID NO: 16808 - protein, 9 aa, Artificial Sequence
  Description of Artificial Sequence: Synthetic peptide
LQHNSYPLT

SEQ ID NO: 16809 - DNA, 27 bp, Artificial Sequence
  Description of Artificial Sequence: Synthetic oligonucleotide
ctacagcataatagttacccgctcact

SEQ ID NO: 16810 - protein, 9 aa, Artificial Sequence
  Description of Artificial Sequence: Synthetic peptide
LQHNSYPLT

SEQ ID NO: 16811 - DNA, 27 bp, Artificial Sequence
  Description of Artificial Sequence: Synthetic oligonucleotide
ctacagcataatagttacccgctcact

SEQ ID NO: 16812 - protein, 9 aa, Artificial Sequence
  Description of Artificial Sequence: Synthetic peptide
LQHNSYPLT

SEQ ID NO: 16813 - DNA, 27 bp, Artificial Sequence
  Description of Artificial Sequence: Synthetic oligonucleotide
ctacaacataatagttacccgctcact

SEQ ID NO: 16814 - protein, 9 aa, Artificial Sequence
  Description of Artificial Sequence: Synthetic peptide
LQHNSYPLT

SEQ ID NO: 16815 - DNA, 27 bp, Artificial Sequence
  Description of Artificial Sequence: Synthetic oligonucleotide
caacagtattatagttacccattcact

SEQ ID NO: 16816 - protein, 9 aa, Artificial Sequence
  Description of Artificial Sequence: Synthetic peptide
QQYYSYPFT

SEQ ID NO: 16817 - DNA, 27 bp, Artificial Sequence
  Description of Artificial Sequence: Synthetic oligonucleotide
atacagcataatagttacctgtggacg

SEQ ID NO: 16818 - protein, 9 aa, Artificial Sequence
  Description of Artificial Sequence: Synthetic peptide
IQHNSYLWT

SEQ ID NO: 16819 - DNA, 27 bp, Artificial Sequence
  Description of Artificial Sequence: Synthetic oligonucleotide
caacagacttacagtaccccgctcact

SEQ ID NO: 16820 - protein, 9 aa, Artificial Sequence
  Description of Artificial Sequence: Synthetic peptide
QQTYSTPLT

SEQ ID NO: 16821 - DNA, 27 bp, Artificial Sequence
  Description of Artificial Sequence: Synthetic oligonucleotide
caacagagttacagtccccctttcact

SEQ ID NO: 16822 - protein, 9 aa, Artificial Sequence
  Description of Artificial Sequence: Synthetic peptide
QQSYSPPFT

SEQ ID NO: 16823 - DNA, 30 bp, Artificial Sequence; identical to SEQ ID NO: 16293
  Description of Artificial Sequence: Synthetic oligonucleotide

SEQ ID NO: 16824 - protein, 10 aa, Artificial Sequence
  Description of Artificial Sequence: Synthetic peptide
QQSYRTPLFT

SEQ ID NO: 16825 - DNA, 27 bp, Artificial Sequence
  Description of Artificial Sequence: Synthetic oligonucleotide
cagcagagttacagtccccctctcact

SEQ ID NO: 16826 - protein, 9 aa, Artificial Sequence
  Description of Artificial Sequence: Synthetic peptide
QQSYSPPLT

SEQ ID NO: 16827 - DNA, 27 bp, Artificial Sequence
  Description of Artificial Sequence: Synthetic oligonucleotide
ctacaacataatctttacccgctcact

SEQ ID NO: 16828 - protein, 9 aa, Artificial Sequence
  Description of Artificial Sequence: Synthetic peptide
LQHNLYPLT

SEQ ID NO: 16829 - DNA, 27 bp, Artificial Sequence
  Description of Artificial Sequence: Synthetic oligonucleotide
gtacagcataatagttacccgctcact

SEQ ID NO: 16830 - protein, 9 aa, Artificial Sequence
  Description of Artificial Sequence: Synthetic peptide
VQHNSYPLT

SEQ ID NO: 16831 - DNA, 30 bp, Artificial Sequence
  Description of Artificial Sequence: Synthetic oligonucleotide
caacagagttacagtactcccttattcact

SEQ ID NO: 16832 - protein, 10 aa, Artificial Sequence
  Description of Artificial Sequence: Synthetic peptide
QQSYSTPLFT

SEQ ID NO: 16833 - DNA, 27 bp, Artificial Sequence
  Description of Artificial Sequence: Synthetic oligonucleotide
ctacagcattatagttaccctcggacg

SEQ ID NO: 16834 - protein, 9 aa, Artificial Sequence
  Description of Artificial Sequence: Synthetic peptide
LQHYSYPRT

SEQ ID NO: 16835 - DNA, 27 bp, Artificial Sequence
  Description of Artificial Sequence: Synthetic oligonucleotide
gtacagcattatagttacccgttcact

SEQ ID NO: 16836 - protein, 9 aa, Artificial Sequence
  Description of Artificial Sequence: Synthetic peptide
VQHYSYPFT

SEQ ID NO: 16837 - DNA, 27 bp, Artificial Sequence
  Description of Artificial Sequence: Synthetic oligonucleotide
catcagagtaacagtactcctctcacg

SEQ ID NO: 16838 - protein, 9 aa, Artificial Sequence
  Description of Artificial Sequence: Synthetic peptide
HQSNSTPLT

SEQ ID NO: 16839 - DNA, 27 bp, Artificial Sequence
  Description of Artificial Sequence: Synthetic oligonucleotide
caccagtataatagttaccccttcact

SEQ ID NO: 16840 - protein, 9 aa, Artificial Sequence
  Description of Artificial Sequence: Synthetic peptide
HQYNSYPFT

SEQ ID NO: 16841 - DNA, 27 bp, Artificial Sequence
  Description of Artificial Sequence: Synthetic oligonucleotide
ctacagcataatagttacccgctcact

SEQ ID NO: 16842 - protein, 9 aa, Artificial Sequence
  Description of Artificial Sequence: Synthetic peptide
LQHNSYPLT

SEQ ID NO: 16843 - DNA, 27 bp, Artificial Sequence
  Description of Artificial Sequence: Synthetic oligonucleotide
ctacagcataatagttacccgctcact

SEQ ID NO: 16844 - protein, 9 aa, Artificial Sequence
  Description of Artificial Sequence: Synthetic peptide
LQHNSYPLT

SEQ ID NO: 16845 - DNA, 27 bp, Artificial Sequence
  Description of Artificial Sequence: Synthetic oligonucleotide
atacagcataatagttacctgtggacg

SEQ ID NO: 16846 - protein, 9 aa, Artificial Sequence
  Description of Artificial Sequence: Synthetic peptide
IQHNSYLWT

SEQ ID NO: 16847 - DNA, 30 bp, Artificial Sequence; identical to SEQ ID NO: 16321
  Description of Artificial Sequence: Synthetic oligonucleotide

SEQ ID NO: 16848 - protein, 10 aa, Artificial Sequence
  Description of Artificial Sequence: Synthetic peptide
QQSYTTPTWT

SEQ ID NO: 16849 - DNA, 27 bp, Artificial Sequence
  Description of Artificial Sequence: Synthetic oligonucleotide
ctacacaacagtagttaccctgttaag

SEQ ID NO: 16850 - protein, 9 aa, Artificial Sequence
  Description of Artificial Sequence: Synthetic peptide
LHNSSYPVK

SEQ ID NO: 16851 - DNA, 27 bp, Artificial Sequence
  Description of Artificial Sequence: Synthetic oligonucleotide
ctacagcatcatagttacccgctcact

SEQ ID NO: 16852 - protein, 9 aa, Artificial Sequence
  Description of Artificial Sequence: Synthetic peptide
LQHHSYPLT

SEQ ID NO: 16853 - DNA, 27 bp, Artificial Sequence
  Description of Artificial Sequence: Synthetic oligonucleotide
atacagcataatagttatccgttcact

SEQ ID NO: 16854 - protein, 9 aa, Artificial Sequence
  Description of Artificial Sequence: Synthetic peptide
IQHNSYPFT

SEQ ID NO: 16855 - DNA, 27 bp, Artificial Sequence
  Description of Artificial Sequence: Synthetic oligonucleotide
ttacagcatgaaagttaccctctcact

SEQ ID NO: 16856 - protein, 9 aa, Artificial Sequence
  Description of Artificial Sequence: Synthetic peptide
LQHESYPLT

SEQ ID NO: 16857 - DNA, 30 bp, Artificial Sequence
  Description of Artificial Sequence: Synthetic oligonucleotide
caacagagttacagtacccccttgttcact

SEQ ID NO: 16858 - protein, 10 aa, Artificial Sequence
  Description of Artificial Sequence: Synthetic peptide
QQSYSTPLFT

SEQ ID NO: 16859 - DNA, 27 bp, Artificial Sequence
  Description of Artificial Sequence: Synthetic oligonucleotide
caacagagttacaatatctcattcact

SEQ ID NO: 16860 - protein, 9 aa, Artificial Sequence
  Description of Artificial Sequence: Synthetic peptide
QQSYNISFT

SEQ ID NO: 16861 - DNA, 27 bp, Artificial Sequence
  Description of Artificial Sequence: Synthetic oligonucleotide
caacagtatgataatgtcccgatcacc

SEQ ID NO: 16862 - protein, 9 aa, Artificial Sequence
  Description of Artificial Sequence: Synthetic peptide
QQYDNVPIT

SEQ ID NO: 16863 - DNA, 27 bp, Artificial Sequence
  Description of Artificial Sequence: Synthetic oligonucleotide
caccagtatcacagttacccattcact

SEQ ID NO: 16864 - protein, 9 aa, Artificial Sequence
  Description of Artificial Sequence: Synthetic peptide
HQYHSYPFT

SEQ ID NO: 16865 - DNA, 27 bp, Artificial Sequence
  Description of Artificial Sequence: Synthetic oligonucleotide
caacagtataatagttacccattcact

SEQ ID NO: 16866 - protein, 9 aa, Artificial Sequence
  Description of Artificial Sequence: Synthetic peptide
QQYNSYPFT

SEQ ID NO: 16867 - DNA, 30 bp, Artificial Sequence; identical to SEQ ID NO: 16313
  Description of Artificial Sequence: Synthetic oligonucleotide

SEQ ID NO: 16868 - protein, 10 aa, Artificial Sequence
  Description of Artificial Sequence: Synthetic peptide
QQSYNTPLFT

SEQ ID NO: 16869 - DNA, 27 bp, Artificial Sequence
  Description of Artificial Sequence: Synthetic oligonucleotide
caacagaattacagtccccctctcact

SEQ ID NO: 16870 - protein, 9 aa, Artificial Sequence
  Description of Artificial Sequence: Synthetic peptide
QQNYSPPLT

SEQ ID NO: 16871 - DNA, 27 bp, Artificial Sequence
  Description of Artificial Sequence: Synthetic oligonucleotide
ctgcagcattatagttaccctcggacg

SEQ ID NO: 16872 - protein, 9 aa, Artificial Sequence
  Description of Artificial Sequence: Synthetic peptide
LQHYSYPRT

SEQ ID NO: 16873 - DNA, 27 bp, Artificial Sequence
  Description of Artificial Sequence: Synthetic oligonucleotide
caacagagttacagtacccctttcact

SEQ ID NO: 16874 - protein, 9 aa, Artificial Sequence
  Description of Artificial Sequence: Synthetic peptide
QQSYSTPFT

SEQ ID NO: 16875 - DNA, 27 bp, Artificial Sequence
  Description of Artificial Sequence: Synthetic oligonucleotide
cagcagtatcatgactggcctccgacg

SEQ ID NO: 16876 - protein, 9 aa, Artificial Sequence
  Description of Artificial Sequence: Synthetic peptide
QQYHDWPPT

SEQ ID NO: 16877 - DNA, 27 bp, Artificial Sequence
  Description of Artificial Sequence: Synthetic oligonucleotide
ctacagcattatagttaccctcggacg

SEQ ID NO: 16878 - protein, 9 aa, Artificial Sequence
  Description of Artificial Sequence: Synthetic peptide
LQHYSYPRT

SEQ ID NO: 16879 - DNA, 27 bp, Artificial Sequence
  Description of Artificial Sequence: Synthetic oligonucleotide
caacagtatgataatctcccgatcacc

SEQ ID NO: 16880 - protein, 9 aa, Artificial Sequence
  Description of Artificial Sequence: Synthetic peptide
QQYDNLPIT

SEQ ID NO: 16881 - DNA, 27 bp, Artificial Sequence
  Description of Artificial Sequence: Synthetic oligonucleotide
caacagtatgataatctcccgatcacc

SEQ ID NO: 16882 - protein, 9 aa, Artificial Sequence
  Description of Artificial Sequence: Synthetic peptide
QQYDNLPIT

SEQ ID NO: 16883 - DNA, 27 bp, Artificial Sequence
  Description of Artificial Sequence: Synthetic oligonucleotide
caccagtatcacagttacccattcact

SEQ ID NO: 16884 - protein, 9 aa, Artificial Sequence
  Description of Artificial Sequence: Synthetic peptide
HQYHSYPFT

SEQ ID NO: 16885 - DNA, 27 bp, Artificial Sequence
  Description of Artificial Sequence: Synthetic oligonucleotide
ctacaacattatagtttccctcggacg

SEQ ID NO: 16886 - protein, 9 aa, Artificial Sequence
  Description of Artificial Sequence: Synthetic peptide
LQHYSFPRT

SEQ ID NO: 16887 - DNA, 27 bp, Artificial Sequence
  Description of Artificial Sequence: Synthetic oligonucleotide
caacagagttacagtccccctctcact

SEQ ID NO: 16888 - protein, 9 aa, Artificial Sequence
  Description of Artificial Sequence: Synthetic peptide
QQSYSPPLT

SEQ ID NO: 16889 - DNA, 27 bp, Artificial Sequence
  Description of Artificial Sequence: Synthetic oligonucleotide
ctacagcataatagttacccgctcact

SEQ ID NO: 16890 - protein, 9 aa, Artificial Sequence
  Description of Artificial Sequence: Synthetic peptide
LQHNSYPLT

SEQ ID NO: 16891 - DNA, 27 bp, Artificial Sequence
  Description of Artificial Sequence: Synthetic oligonucleotide
caacagacttacagtactccgctcact

SEQ ID NO: 16892 - protein, 9 aa, Artificial Sequence
  Description of Artificial Sequence: Synthetic peptide
QQTYSTPLT

SEQ ID NO: 16893 - DNA, 27 bp, Artificial Sequence
  Description of Artificial Sequence: Synthetic oligonucleotide
ttacagcatgataattaccctctcact

SEQ ID NO: 16894 - protein, 9 aa, Artificial Sequence
  Description of Artificial Sequence: Synthetic peptide
LQHDNYPLT

SEQ ID NO: 16895 - DNA, 27 bp, Artificial Sequence
  Description of Artificial Sequence: Synthetic oligonucleotide
caacagacttacagtaccccgctcact

SEQ ID NO: 16896 - protein, 9 aa, Artificial Sequence
  Description of Artificial Sequence: Synthetic peptide
QQTYSTPLT

SEQ ID NO: 16897 - DNA, 27 bp, Artificial Sequence
  Description of Artificial Sequence: Synthetic oligonucleotide
caacagagttacagtccccctctcact

SEQ ID NO: 16898 - protein, 9 aa, Artificial Sequence
  Description of Artificial Sequence: Synthetic peptide
QQSYSPPLT

SEQ ID NO: 16899 - DNA, 27 bp, Artificial Sequence
  Description of Artificial Sequence: Synthetic oligonucleotide
gtacagcataatagttacccgctcact

SEQ ID NO: 16900 - protein, 9 aa, Artificial Sequence
  Description of Artificial Sequence: Synthetic peptide
VQHNSYPLT

SEQ ID NO: 16901 - DNA, 30 bp, Artificial Sequence
  Description of Artificial Sequence: Synthetic oligonucleotide
caacagacttacagtagccctccattcact

SEQ ID NO: 16902 - protein, 10 aa, Artificial Sequence
  Description of Artificial Sequence: Synthetic peptide
QQTYSSPPFT

SEQ ID NO: 16903 - DNA, 33 bp, Artificial Sequence
  Description of Artificial Sequence: Synthetic oligonucleotide
caacagacttacaatacccctccggagcgcagt

SEQ ID NO: 16904 - protein, 11 aa, Artificial Sequence
  Description of Artificial Sequence: Synthetic peptide
QQTYNTPPERS

SEQ ID NO: 16905 - DNA, 27 bp, Artificial Sequence
  Description of Artificial Sequence: Synthetic oligonucleotide
cagcaatattatagtactcctccgacg

SEQ ID NO: 16906 - protein, 9 aa, Artificial Sequence
  Description of Artificial Sequence: Synthetic peptide
QQYYSTPPT

SEQ ID NO: 16907 - DNA, 27 bp, Artificial Sequence
  Description of Artificial Sequence: Synthetic oligonucleotide
ctacagtataatagttacccattcact

SEQ ID NO: 16908 - protein, 9 aa, Artificial Sequence
  Description of Artificial Sequence: Synthetic peptide
LQYNSYPFT

SEQ ID NO: 16909 - DNA, 27 bp, Artificial Sequence
  Description of Artificial Sequence: Synthetic oligonucleotide
caacagtatcatagttacccgtggacg

SEQ ID NO: 16910 - protein, 9 aa, Artificial Sequence
  Description of Artificial Sequence: Synthetic peptide
QQYHSYPWT

SEQ ID NO: 16911 - DNA, 27 bp, Artificial Sequence
  Description of Artificial Sequence: Synthetic oligonucleotide
ctacagcataatagttacccgtggacg

SEQ ID NO: 16912 - protein, 9 aa, Artificial Sequence
  Description of Artificial Sequence: Synthetic peptide
LQHNSYPWT

SEQ ID NO: 16913 - DNA, 27 bp, Artificial Sequence
  Description of Artificial Sequence: Synthetic oligonucleotide
caggcgtgggtcaacaacactatgata

SEQ ID NO: 16914 - protein, 9 aa, Artificial Sequence
  Description of Artificial Sequence: Synthetic peptide
QAWVNNTMI

SEQ ID NO: 16915 - DNA, 27 bp, Artificial Sequence
  Description of Artificial Sequence: Synthetic oligonucleotide
caacagtataatagttaccctctcact

SEQ ID NO: 16916 - protein, 9 aa, Artificial Sequence
  Description of Artificial Sequence: Synthetic peptide
QQYNSYPLT

SEQ ID NO: 16917 - DNA, 27 bp, Artificial Sequence
  Description of Artificial Sequence: Synthetic oligonucleotide
caacaggctaacagtttcccattcact

SEQ ID NO: 16918 - protein, 9 aa, Artificial Sequence
  Description of Artificial Sequence: Synthetic peptide
QQANSFPFT

SEQ ID NO: 16919 - DNA, 33 bp, Artificial Sequence; identical to SEQ ID NO: 16903
  Description of Artificial Sequence: Synthetic oligonucleotide

SEQ ID NO: 16920 - protein, 11 aa, Artificial Sequence
  Description of Artificial Sequence: Synthetic peptide
QQTYNTPPERS

SEQ ID NO: 16921 - DNA, 27 bp, Artificial Sequence
  Description of Artificial Sequence: Synthetic oligonucleotide
ctacagcataatagttaccctctcact

SEQ ID NO: 16922 - protein, 9 aa, Artificial Sequence
  Description of Artificial Sequence: Synthetic peptide
LQHNSYPLT

SEQ ID NO: 16923 - DNA, 27 bp, Artificial Sequence
  Description of Artificial Sequence: Synthetic oligonucleotide
ctacaacataatagttacccgtggacg

SEQ ID NO: 16924 - protein, 9 aa, Artificial Sequence
  Description of Artificial Sequence: Synthetic peptide
LQHNSYPWT

SEQ ID NO: 16925 - DNA, 27 bp, Artificial Sequence
  Description of Artificial Sequence: Synthetic oligonucleotide
ctacagcatagtagttacccgttcact

SEQ ID NO: 16926 - protein, 9 aa, Artificial Sequence
  Description of Artificial Sequence: Synthetic peptide
LQHSSYPFT

SEQ ID NO: 16927 - DNA, 27 bp, Artificial Sequence
  Description of Artificial Sequence: Synthetic oligonucleotide
caacagcctcacagtcccccgctcact

SEQ ID NO: 16928 - protein, 9 aa, Artificial Sequence
  Description of Artificial Sequence: Synthetic peptide
QQPHSPPLT

SEQ ID NO: 16929 - DNA, 27 bp, Artificial Sequence
  Description of Artificial Sequence: Synthetic oligonucleotide
ctacaacattatacttaccctcggacg

SEQ ID NO: 16930 - protein, 9 aa, Artificial Sequence
  Description of Artificial Sequence: Synthetic peptide
LQHYTYPRT

SEQ ID NO: 16931 - DNA, 27 bp, Artificial Sequence
  Description of Artificial Sequence: Synthetic oligonucleotide
caacagtataatagttacccattcact

SEQ ID NO: 16932 - protein, 9 aa, Artificial Sequence
  Description of Artificial Sequence: Synthetic peptide
QQYNSYPFT

SEQ ID NO: 16933 - DNA, 27 bp, Artificial Sequence
  Description of Artificial Sequence: Synthetic oligonucleotide
ctacagctttatagttaccctcggacg

SEQ ID NO: 16934 - protein, 9 aa, Artificial Sequence
  Description of Artificial Sequence: Synthetic peptide
LQLYSYPRT

SEQ ID NO: 16935 - DNA, 27 bp, Artificial Sequence
  Description of Artificial Sequence: Synthetic oligonucleotide
ctacagcataatagttacccgctcact

SEQ ID NO: 16936 - protein, 9 aa, Artificial Sequence
  Description of Artificial Sequence: Synthetic peptide
LQHNSYPLT

SEQ ID NO: 16937 - DNA, 27 bp, Artificial Sequence
  Description of Artificial Sequence: Synthetic oligonucleotide
ctacagcataatagttacccgctcact

SEQ ID NO: 16938 - protein, 9 aa, Artificial Sequence
  Description of Artificial Sequence: Synthetic peptide
LQHNSYPLT

SEQ ID NO: 16939 - DNA, 27 bp, Artificial Sequence
  Description of Artificial Sequence: Synthetic oligonucleotide
ctacaacattatagtttccctcggacg

SEQ ID NO: 16940 - protein, 9 aa, Artificial Sequence
  Description of Artificial Sequence: Synthetic peptide
LQHYSFPRT

SEQ ID NO: 16941 - DNA, 30 bp, Artificial Sequence; identical to SEQ ID NO: 16257
  Description of Artificial Sequence: Synthetic oligonucleotide

SEQ ID NO: 16942 - protein, 10 aa, Artificial Sequence
  Description of Artificial Sequence: Synthetic peptide
QQSYRTPFFT

SEQ ID NO: 16943 - DNA, 27 bp, Artificial Sequence
  Description of Artificial Sequence: Synthetic oligonucleotide
ctacaggataatagttatccgttcact

SEQ ID NO: 16944 - protein, 9 aa, Artificial Sequence
  Description of Artificial Sequence: Synthetic peptide
LQDNSYPFT

SEQ ID NO: 16945 - DNA, 27 bp, Artificial Sequence
  Description of Artificial Sequence: Synthetic oligonucleotide
ctacagcataatagttacgcgctcact

SEQ ID NO: 16946 - protein, 9 aa, Artificial Sequence
  Description of Artificial Sequence: Synthetic peptide
LQHNSYALT

SEQ ID NO: 16947 - DNA, 27 bp, Artificial Sequence
  Description of Artificial Sequence: Synthetic oligonucleotide
ctacatcaatatagttaccctcggacg

SEQ ID NO: 16948 - protein, 9 aa, Artificial Sequence
  Description of Artificial Sequence: Synthetic peptide
LHQYSYPRT

SEQ ID NO: 16949 - DNA, 27 bp, Artificial Sequence
  Description of Artificial Sequence: Synthetic oligonucleotide
caacagtataatagttaccctctcact

SEQ ID NO: 16950 - protein, 9 aa, Artificial Sequence
  Description of Artificial Sequence: Synthetic peptide
QQYNSYPLT

SEQ ID NO: 16951 - DNA, 27 bp, Artificial Sequence
  Description of Artificial Sequence: Synthetic oligonucleotide
ctacagcatagtaattaccctctcact

SEQ ID NO: 16952 - protein, 9 aa, Artificial Sequence
  Description of Artificial Sequence: Synthetic peptide
LQHSNYPLT

SEQ ID NO: 16953 - DNA, 27 bp, Artificial Sequence
  Description of Artificial Sequence: Synthetic oligonucleotide
caacagtataatagttacccattcact

SEQ ID NO: 16954 - protein, 9 aa, Artificial Sequence
  Description of Artificial Sequence: Synthetic peptide
QQYNSYPFT

SEQ ID NO: 16955 - DNA, 27 bp, Artificial Sequence
  Description of Artificial Sequence: Synthetic oligonucleotide
ctacagcataatagttatccgctcact

SEQ ID NO: 16956 - protein, 9 aa, Artificial Sequence
  Description of Artificial Sequence: Synthetic peptide
LQHNSYPLT

SEQ ID NO: 16957 - DNA, 27 bp, Artificial Sequence
  Description of Artificial Sequence: Synthetic oligonucleotide
ctactgcattatagttaccctcggacg

SEQ ID NO: 16958 - protein, 9 aa, Artificial Sequence
  Description of Artificial Sequence: Synthetic peptide
LLHYSYPRT

SEQ ID NO: 16959 - DNA, 27 bp, Artificial Sequence
  Description of Artificial Sequence: Synthetic oligonucleotide
ctacaacataatagttacccgtggacg

SEQ ID NO: 16960 - protein, 9 aa, Artificial Sequence
  Description of Artificial Sequence: Synthetic peptide
LQHNSYPWT

SEQ ID NO: 16961 - DNA, 27 bp, Artificial Sequence
  Description of Artificial Sequence: Synthetic oligonucleotide
caacagtatgataatctcccgatcacc

SEQ ID NO: 16962 - protein, 9 aa, Artificial Sequence
  Description of Artificial Sequence: Synthetic peptide
QQYDNLPIT

SEQ ID NO: 16963 - DNA, 27 bp, Artificial Sequence
  Description of Artificial Sequence: Synthetic oligonucleotide
ctacagcatagtaattaccctctcact

SEQ ID NO: 16964 - protein, 9 aa, Artificial Sequence
  Description of Artificial Sequence: Synthetic peptide
LQHSNYPLT

SEQ ID NO: 16965 - DNA, 27 bp, Artificial Sequence
  Description of Artificial Sequence: Synthetic oligonucleotide
caacagtatgaaaatctcccgatcact

SEQ ID NO: 16966 - protein, 9 aa, Artificial Sequence
  Description of Artificial Sequence: Synthetic peptide
QQYENLPIT

SEQ ID NO: 16967 - DNA, 27 bp, Artificial Sequence
  Description of Artificial Sequence: Synthetic oligonucleotide
caacagtatgataatctcccgatcacc

SEQ ID NO: 16968 - protein, 9 aa, Artificial Sequence
  Description of Artificial Sequence: Synthetic peptide
QQYDNLPIT

SEQ ID NO: 16969 - DNA, 27 bp, Artificial Sequence
  Description of Artificial Sequence: Synthetic oligonucleotide
ctacagcataatagttacccgctcact

SEQ ID NO: 16970 - protein, 9 aa, Artificial Sequence
  Description of Artificial Sequence: Synthetic peptide
LQHNSYPLT

SEQ ID NO: 16971 - DNA, 27 bp, Artificial Sequence
  Description of Artificial Sequence: Synthetic oligonucleotide
caaaagtatgacagtgccccattcact

SEQ ID NO: 16972 - protein, 9 aa, Artificial Sequence
  Description of Artificial Sequence: Synthetic peptide
QKYDSAPFT

SEQ ID NO: 16973 - DNA, 27 bp, Artificial Sequence
  Description of Artificial Sequence: Synthetic oligonucleotide
caacagacttacagtaccccgctcact

SEQ ID NO: 16974 - protein, 9 aa, Artificial Sequence
  Description of Artificial Sequence: Synthetic peptide
QQTYSTPLT

SEQ ID NO: 16975 - DNA, 30 bp, Artificial Sequence; identical to SEQ ID NO: 16257
  Description of Artificial Sequence: Synthetic oligonucleotide

SEQ ID NO: 16976 - protein, 10 aa, Artificial Sequence
  Description of Artificial Sequence: Synthetic peptide
QQSYRTPFFT

SEQ ID NO: 16977 - DNA, 27 bp, Artificial Sequence
  Description of Artificial Sequence: Synthetic oligonucleotide
caacagacttacagtcttccgctcact

SEQ ID NO: 16978 - protein, 9 aa, Artificial Sequence
  Description of Artificial Sequence: Synthetic peptide
QQTYSLPLT

SEQ ID NO: 16979 - DNA, 27 bp, Artificial Sequence
  Description of Artificial Sequence: Synthetic oligonucleotide
caacagtatcatagttacccattcact

SEQ ID NO: 16980 - protein, 9 aa, Artificial Sequence
  Description of Artificial Sequence: Synthetic peptide
QQYHSYPFT

SEQ ID NO: 16981 - DNA, 27 bp, Artificial Sequence
  Description of Artificial Sequence: Synthetic oligonucleotide
ctacagcataatagttacccgctcact

SEQ ID NO: 16982 - protein, 9 aa, Artificial Sequence
  Description of Artificial Sequence: Synthetic peptide
LQHNSYPLT

SEQ ID NO: 16983 - DNA, 30 bp, Artificial Sequence; identical to SEQ ID NO: 16293
  Description of Artificial Sequence: Synthetic oligonucleotide

SEQ ID NO: 16984 - protein, 10 aa, Artificial Sequence
  Description of Artificial Sequence: Synthetic peptide
QQSYRTPLFT

SEQ ID NO: 16985 - DNA, 27 bp, Artificial Sequence
  Description of Artificial Sequence: Synthetic oligonucleotide
ctacagcataatagttacccgctcact

SEQ ID NO: 16986 - protein, 9 aa, Artificial Sequence
  Description of Artificial Sequence: Synthetic peptide
LQHNSYPLT

SEQ ID NO: 16987 - DNA, 27 bp, Artificial Sequence
  Description of Artificial Sequence: Synthetic oligonucleotide
caacagtataatagttacccattcact

SEQ ID NO: 16988 - protein, 9 aa, Artificial Sequence
  Description of Artificial Sequence: Synthetic peptide
QQYNSYPFT

SEQ ID NO: 16989 - DNA, 27 bp, Artificial Sequence
  Description of Artificial Sequence: Synthetic oligonucleotide
caacagtatgaaaatctcccgatcacc

SEQ ID NO: 16990 - protein, 9 aa, Artificial Sequence
  Description of Artificial Sequence: Synthetic peptide
QQYENLPIT

SEQ ID NO: 16991 - DNA, 27 bp, Artificial Sequence
  Description of Artificial Sequence: Synthetic oligonucleotide
ctacagtataatggttacccattcact

SEQ ID NO: 16992 - protein, 9 aa, Artificial Sequence
  Description of Artificial Sequence: Synthetic peptide
LQYNGYPFT

SEQ ID NO: 16993 - DNA, 27 bp, Artificial Sequence
  Description of Artificial Sequence: Synthetic oligonucleotide
caacaatatgataatctcccgctcact

SEQ ID NO: 16994 - protein, 9 aa, Artificial Sequence
  Description of Artificial Sequence: Synthetic peptide
QQYDNLPLT

SEQ ID NO: 16995 - DNA, 27 bp, Artificial Sequence
  Description of Artificial Sequence: Synthetic oligonucleotide
ctacagcataatagttacccgctcact

SEQ ID NO: 16996 - protein, 9 aa, Artificial Sequence
  Description of Artificial Sequence: Synthetic peptide
LQHNSYPLT

SEQ ID NO: 16997 - DNA, 27 bp, Artificial Sequence
  Description of Artificial Sequence: Synthetic oligonucleotide
ctacagcattatagttaccctcggacg

SEQ ID NO: 16998 - protein, 9 aa, Artificial Sequence
  Description of Artificial Sequence: Synthetic peptide
LQHYSYPRT

SEQ ID NO: 16999 - DNA, 30 bp, Artificial Sequence; identical to SEQ ID NO: 16483
  Description of Artificial Sequence: Synthetic oligonucleotide

SEQ ID NO: 17000 - protein, 10 aa, Artificial Sequence
  Description of Artificial Sequence: Synthetic peptide
QQSYSTPLFT

SEQ ID NO: 17001 - DNA, 27 bp, Artificial Sequence
  Description of Artificial Sequence: Synthetic oligonucleotide
ctacagcataatagttacccgctcact

SEQ ID NO: 17002 - protein, 9 aa, Artificial Sequence
  Description of Artificial Sequence: Synthetic peptide
LQHNSYPLT

SEQ ID NO: 17003 - DNA, 27 bp, Artificial Sequence
  Description of Artificial Sequence: Synthetic oligonucleotide
caacagtatgataatctcccgatcacc

SEQ ID NO: 17004 - protein, 9 aa, Artificial Sequence
  Description of Artificial Sequence: Synthetic peptide
QQYDNLPIT

SEQ ID NO: 17005 - DNA, 27 bp, Artificial Sequence
  Description of Artificial Sequence: Synthetic oligonucleotide
ctacagcataatagttaccctctcact

SEQ ID NO: 17006 - protein, 9 aa, Artificial Sequence
  Description of Artificial Sequence: Synthetic peptide
LQHNSYPLT

SEQ ID NO: 17007 - DNA, 30 bp, Artificial Sequence
  Description of Artificial Sequence: Synthetic oligonucleotide
caacagagttacagtacccccttattcagt

SEQ ID NO: 17008 - protein, 10 aa, Artificial Sequence
  Description of Artificial Sequence: Synthetic peptide
QQSYSTPLFS

SEQ ID NO: 17009 - DNA, 27 bp, Artificial Sequence
  Description of Artificial Sequence: Synthetic oligonucleotide
ctacagcatagtagttaccctctcact

SEQ ID NO: 17010 - protein, 9 aa, Artificial Sequence
  Description of Artificial Sequence: Synthetic peptide
LQHSSYPLT

SEQ ID NO: 17011 - DNA, 27 bp, Artificial Sequence
  Description of Artificial Sequence: Synthetic oligonucleotide
caacagtatgatagttacccattcact

SEQ ID NO: 17012 - protein, 9 aa, Artificial Sequence
  Description of Artificial Sequence: Synthetic peptide
QQYDSYPFT

SEQ ID NO: 17013 - DNA, 27 bp, Artificial Sequence
  Description of Artificial Sequence: Synthetic oligonucleotide
ctacagcatagtagttacccgctcact

SEQ ID NO: 17014 - protein, 9 aa, Artificial Sequence
  Description of Artificial Sequence: Synthetic peptide
LQHSSYPLT

SEQ ID NO: 17015 - DNA, 27 bp, Artificial Sequence
  Description of Artificial Sequence: Synthetic oligonucleotide
ctacagcataatagttacccgctcact

SEQ ID NO: 17016 - protein, 9 aa, Artificial Sequence
  Description of Artificial Sequence: Synthetic peptide
LQHNSYPLT

SEQ ID NO: 17017 - DNA, 27 bp, Artificial Sequence
  Description of Artificial Sequence: Synthetic oligonucleotide
atgcaagctctacaaactcctatcacc

SEQ ID NO: 17018 - protein, 9 aa, Artificial Sequence
  Description of Artificial Sequence: Synthetic peptide
MQALQTPIT

SEQ ID NO: 17019 - DNA, 27 bp, Artificial Sequence
  Description of Artificial Sequence: Synthetic oligonucleotide
ctacaccatagtaattaccctctcact

SEQ ID NO: 17020 - protein, 9 aa, Artificial Sequence
  Description of Artificial Sequence: Synthetic peptide
LHHSNYPLT

SEQ ID NO: 17021 - DNA, 27 bp, Artificial Sequence
  Description of Artificial Sequence: Synthetic oligonucleotide
cagcaatattttagtactccattcact

SEQ ID NO: 17022 - protein, 9 aa, Artificial Sequence
  Description of Artificial Sequence: Synthetic peptide
QQYFSTPFT

SEQ ID NO: 17023 - DNA, 27 bp, Artificial Sequence
  Description of Artificial Sequence: Synthetic oligonucleotide
ctacagcataatagttatccgtggacg

SEQ ID NO: 17024 - protein, 9 aa, Artificial Sequence
  Description of Artificial Sequence: Synthetic peptide
LQHNSYPWT

SEQ ID NO: 17025 - DNA, 27 bp, Artificial Sequence
  Description of Artificial Sequence: Synthetic oligonucleotide
ctacagtatcatagttacccattcact

SEQ ID NO: 17026 - protein, 9 aa, Artificial Sequence
  Description of Artificial Sequence: Synthetic peptide
LQYHSYPFT

SEQ ID NO: 17027 - DNA, 27 bp, Artificial Sequence
  Description of Artificial Sequence: Synthetic oligonucleotide
atgcaagctctacaaactcctctcacc

SEQ ID NO: 17028 - protein, 9 aa, Artificial Sequence
  Description of Artificial Sequence: Synthetic peptide
MQALQTPLT

SEQ ID NO: 17029 - DNA, 27 bp, Artificial Sequence
  Description of Artificial Sequence: Synthetic oligonucleotide
ctacaacatactagttacccgctcact

SEQ ID NO: 17030 - protein, 9 aa, Artificial Sequence
  Description of Artificial Sequence: Synthetic peptide
LQHTSYPLT

SEQ ID NO: 17031 - DNA, 27 bp, Artificial Sequence
  Description of Artificial Sequence: Synthetic oligonucleotide
ctacagcatagtagttacccgctcact

SEQ ID NO: 17032 - protein, 9 aa, Artificial Sequence
  Description of Artificial Sequence: Synthetic peptide
LQHSSYPLT

SEQ ID NO: 17033 - DNA, 30 bp, Artificial Sequence; identical to SEQ ID NO: 16257
  Description of Artificial Sequence: Synthetic oligonucleotide

SEQ ID NO: 17034 - protein, 10 aa, Artificial Sequence
  Description of Artificial Sequence: Synthetic peptide
QQSYRTPFFT

SEQ ID NO: 17035 - DNA, 27 bp, Artificial Sequence
  Description of Artificial Sequence: Synthetic oligonucleotide
ctacagcataatagttacccgctcact

SEQ ID NO: 17036 - protein, 9 aa, Artificial Sequence
  Description of Artificial Sequence: Synthetic peptide
LQHNSYPLT

SEQ ID NO: 17037 - DNA, 27 bp, Artificial Sequence
  Description of Artificial Sequence: Synthetic oligonucleotide
caacagtttgataatctcccgatcacc

SEQ ID NO: 17038 - protein, 9 aa, Artificial Sequence
  Description of Artificial Sequence: Synthetic peptide
QQFDNLPIT

SEQ ID NO: 17039 - DNA, 27 bp, Artificial Sequence
  Description of Artificial Sequence: Synthetic oligonucleotide
cagcagacttacagtaccccgctcact

SEQ ID NO: 17040 - protein, 9 aa, Artificial Sequence
  Description of Artificial Sequence: Synthetic peptide
QQTYSTPLT

SEQ ID NO: 17041 - DNA, 27 bp, Artificial Sequence
  Description of Artificial Sequence: Synthetic oligonucleotide
cagcaatattatactactccgtgcagt

SEQ ID NO: 17042 - protein, 9 aa, Artificial Sequence
  Description of Artificial Sequence: Synthetic peptide
QQYYTTPCS

SEQ ID NO: 17043 - DNA, 30 bp, Artificial Sequence; identical to SEQ ID NO: 16313
  Description of Artificial Sequence: Synthetic oligonucleotide

SEQ ID NO: 17044 - protein, 10 aa, Artificial Sequence
  Description of Artificial Sequence: Synthetic peptide
QQSYNTPLFT

SEQ ID NO: 17045 - DNA, 27 bp, Artificial Sequence
  Description of Artificial Sequence: Synthetic oligonucleotide
ctacagcataatagttacccgtggacg

SEQ ID NO: 17046 - protein, 9 aa, Artificial Sequence
  Description of Artificial Sequence: Synthetic peptide
LQHNSYPWT

SEQ ID NO: 17047 - DNA, 27 bp, Artificial Sequence
  Description of Artificial Sequence: Synthetic oligonucleotide
ctacagcataatagttacccgctcact

SEQ ID NO: 17048 - protein, 9 aa, Artificial Sequence
  Description of Artificial Sequence: Synthetic peptide
LQHNSYPLT

SEQ ID NO: 17049 - DNA, 27 bp, Artificial Sequence
  Description of Artificial Sequence: Synthetic oligonucleotide
ctacagcataatagttacccgtggacg

SEQ ID NO: 17050 - protein, 9 aa, Artificial Sequence
  Description of Artificial Sequence: Synthetic peptide
LQHNSYPWT

SEQ ID NO: 17051 - DNA, 27 bp, Artificial Sequence
  Description of Artificial Sequence: Synthetic oligonucleotide
ctacagcataatagttacccgtggacg

SEQ ID NO: 17052 - protein, 9 aa, Artificial Sequence
  Description of Artificial Sequence: Synthetic peptide
LQHNSYPWT

SEQ ID NO: 17053 - DNA, 27 bp, Artificial Sequence
  Description of Artificial Sequence: Synthetic oligonucleotide
ctacaacataatagttacccgtggacg

SEQ ID NO: 17054 - protein, 9 aa, Artificial Sequence
  Description of Artificial Sequence: Synthetic peptide
LQHNSYPWT

SEQ ID NO: 17055 - DNA, 27 bp, Artificial Sequence
  Description of Artificial Sequence: Synthetic oligonucleotide
caggcgtggaacaacagcactgtggta

SEQ ID NO: 17056 - protein, 9 aa, Artificial Sequence
  Description of Artificial Sequence: Synthetic peptide
QAWNNSTVV

SEQ ID NO: 17057 - DNA, 27 bp, Artificial Sequence
  Description of Artificial Sequence: Synthetic oligonucleotide
caggcgtgggacagcagcactgtggtt

SEQ ID NO: 17058 - protein, 9 aa, Artificial Sequence
  Description of Artificial Sequence: Synthetic peptide
QAWDSSTVV

SEQ ID NO: 17059 - DNA, 30 bp, Artificial Sequence
  Description of Artificial Sequence: Synthetic oligonucleotide
caacagggttacaatacccccacgtggacg

SEQ ID NO: 17060 - protein, 10 aa, Artificial Sequence
  Description of Artificial Sequence: Synthetic peptide
QQGYNTPTWT

SEQ ID NO: 17061 - DNA, 33 bp, Artificial Sequence; identical to SEQ ID NO: 16903
  Description of Artificial Sequence: Synthetic oligonucleotide

SEQ ID NO: 17062 - protein, 11 aa, Artificial Sequence
  Description of Artificial Sequence: Synthetic peptide
QQTYNTPPERS

SEQ ID NO: 17063 - DNA, 30 bp, Artificial Sequence
  Description of Artificial Sequence: Synthetic oligonucleotide
caaaagtataacagtgcccctccgctcacc

SEQ ID NO: 17064 - protein, 10 aa, Artificial Sequence
  Description of Artificial Sequence: Synthetic peptide
QKYNSAPPLT

SEQ ID NO: 17065 - DNA, 27 bp, Artificial Sequence
  Description of Artificial Sequence: Synthetic oligonucleotide
caacagagtaactttttcccgctcact

SEQ ID NO: 17066 - protein, 9 aa, Artificial Sequence
  Description of Artificial Sequence: Synthetic peptide
QQSNFFPLT

SEQ ID NO: 17067 - DNA, 27 bp, Artificial Sequence
  Description of Artificial Sequence: Synthetic oligonucleotide
caacagtatcatagttacccattcact

SEQ ID NO: 17068 - protein, 9 aa, Artificial Sequence
  Description of Artificial Sequence: Synthetic peptide
QQYHSYPFT

SEQ ID NO: 17069 - DNA, 30 bp, Artificial Sequence
  Description of Artificial Sequence: Synthetic oligonucleotide
ctacatcataataattacctccccatcacc

SEQ ID NO: 17070 - protein, 10 aa, Artificial Sequence
  Description of Artificial Sequence: Synthetic peptide
LHHNNYLPIT

SEQ ID NO: 17071 - DNA, 27 bp, Artificial Sequence
  Description of Artificial Sequence: Synthetic oligonucleotide
caacagagttacaacttcccgctcact

SEQ ID NO: 17072 - protein, 9 aa, Artificial Sequence
  Description of Artificial Sequence: Synthetic peptide
QQSYNFPLT

SEQ ID NO: 17073 - DNA, 27 bp, Artificial Sequence
  Description of Artificial Sequence: Synthetic oligonucleotide
caggcgtgggacaacaacactgtggta

SEQ ID NO: 17074 - protein, 9 aa, Artificial Sequence
  Description of Artificial Sequence: Synthetic peptide
QAWDNNTVV

SEQ ID NO: 17075 - DNA, 27 bp, Artificial Sequence
  Description of Artificial Sequence: Synthetic oligonucleotide
caggcgtgggacaacagcactgtggta

SEQ ID NO: 17076 - protein, 9 aa, Artificial Sequence
  Description of Artificial Sequence: Synthetic peptide
QAWDNSTVV

SEQ ID NO: 17077 - DNA, 27 bp, Artificial Sequence
  Description of Artificial Sequence: Synthetic oligonucleotide
caacagtataatagtttcccattcact

SEQ ID NO: 17078 - protein, 9 aa, Artificial Sequence
  Description of Artificial Sequence: Synthetic peptide
QQYNSFPFT

SEQ ID NO: 17079 - DNA, 30 bp, Artificial Sequence
  Description of Artificial Sequence: Synthetic oligonucleotide
agctcatatacaaggagcagcactgtggta

SEQ ID NO: 17080 - protein, 10 aa, Artificial Sequence
  Description of Artificial Sequence: Synthetic peptide
SSYTRSSTVV

SEQ ID NO: 17081 - DNA, 27 bp, Artificial Sequence
  Description of Artificial Sequence: Synthetic oligonucleotide
cagcaatattatagtactccgtgcagt

SEQ ID NO: 17082 - protein, 9 aa, Artificial Sequence
  Description of Artificial Sequence: Synthetic peptide
QQYYSTPCS

SEQ ID NO: 17083 - DNA, 27 bp, Artificial Sequence
  Description of Artificial Sequence: Synthetic oligonucleotide
caggcgtgggacagcagcactgcggta

SEQ ID NO: 17084 - protein, 9 aa, Artificial Sequence
  Description of Artificial Sequence: Synthetic peptide
QAWDSSTAV

SEQ ID NO: 17085 - DNA, 27 bp, Artificial Sequence
  Description of Artificial Sequence: Synthetic oligonucleotide
caacagtataatagttacccattcact

SEQ ID NO: 17086 - protein, 9 aa, Artificial Sequence
  Description of Artificial Sequence: Synthetic peptide
QQYNSYPFT

SEQ ID NO: 17087 - DNA, 27 bp, Artificial Sequence
  Description of Artificial Sequence: Synthetic oligonucleotide
caacaggctaacagtttcccattcact

SEQ ID NO: 17088 - protein, 9 aa, Artificial Sequence
  Description of Artificial Sequence: Synthetic peptide
QQANSFPFT

SEQ ID NO: 17089 - DNA, 27 bp, Artificial Sequence
  Description of Artificial Sequence: Synthetic oligonucleotide
caggcgtggaacagcagcaatgtggta

SEQ ID NO: 17090 - protein, 9 aa, Artificial Sequence
  Description of Artificial Sequence: Synthetic peptide
QAWNSSNVV

SEQ ID NO: 17091 - DNA, 27 bp, Artificial Sequence
  Description of Artificial Sequence: Synthetic oligonucleotide
cagcaatattctagtactccgtggacg

SEQ ID NO: 17092 - protein, 9 aa, Artificial Sequence
  Description of Artificial Sequence: Synthetic peptide
QQYSSTPWT

SEQ ID NO: 17093 - DNA, 30 bp, Artificial Sequence
  Description of Artificial Sequence: Synthetic oligonucleotide
atgcaaggtgcacactggcctccgatcacc

SEQ ID NO: 17094 - protein, 10 aa, Artificial Sequence
  Description of Artificial Sequence: Synthetic peptide
MQGAHWPPIT

SEQ ID NO: 17095 - DNA, 27 bp, Artificial Sequence
  Description of Artificial Sequence: Synthetic oligonucleotide
cagcaatattatagtactccgtgcagt

SEQ ID NO: 17096 - protein, 9 aa, Artificial Sequence
  Description of Artificial Sequence: Synthetic peptide
QQYYSTPCS

SEQ ID NO: 17097 - DNA, 27 bp, Artificial Sequence
  Description of Artificial Sequence: Synthetic oligonucleotide
cagcaatattacagtactccgtgcagt

SEQ ID NO: 17098 - protein, 9 aa, Artificial Sequence
  Description of Artificial Sequence: Synthetic peptide
QQYYSTPCS

SEQ ID NO: 17099 - DNA, 27 bp, Artificial Sequence
  Description of Artificial Sequence: Synthetic oligonucleotide
cagcaatattatagtagtccgtgcagt

SEQ ID NO: 17100 - protein, 9 aa, Artificial Sequence
  Description of Artificial Sequence: Synthetic peptide
QQYYSSPCS

SEQ ID NO: 17101 - DNA, 27 bp, Artificial Sequence
  Description of Artificial Sequence: Synthetic oligonucleotide
caacaggctaacagtttcccattcact

SEQ ID NO: 17102 - protein, 9 aa, Artificial Sequence
  Description of Artificial Sequence: Synthetic peptide
QQANSFPFT

SEQ ID NO: 17103 - DNA, 27 bp, Artificial Sequence
  Description of Artificial Sequence: Synthetic oligonucleotide
caacaatattatacttctccgtgcagt

SEQ ID NO: 17104 - protein, 9 aa, Artificial Sequence
  Description of Artificial Sequence: Synthetic peptide
QQYYTSPCS

SEQ ID NO: 17105 - DNA, 27 bp, Artificial Sequence
  Description of Artificial Sequence: Synthetic oligonucleotide
cagcaatattatagttctccgtgcagt

SEQ ID NO: 17106 - protein, 9 aa, Artificial Sequence
  Description of Artificial Sequence: Synthetic peptide
QQYYSSPCS

SEQ ID NO: 17107 - DNA, 27 bp, Artificial Sequence
  Description of Artificial Sequence: Synthetic oligonucleotide
caacagtataatagttatccattcact

SEQ ID NO: 17108 - protein, 9 aa, Artificial Sequence
  Description of Artificial Sequence: Synthetic peptide
QQYNSYPFT

SEQ ID NO: 17109 - DNA, 27 bp, Artificial Sequence
  Description of Artificial Sequence: Synthetic oligonucleotide
ctacagcatactatttcccctcctact

SEQ ID NO: 17110 - protein, 9 aa, Artificial Sequence
  Description of Artificial Sequence: Synthetic peptide
LQHTISPPT

SEQ ID NO: 17111 - DNA, 24 bp, Artificial Sequence
  Description of Artificial Sequence: Synthetic oligonucleotide
atgcaaggtatacactggctcact

SEQ ID NO: 17112 - protein, 8 aa, Artificial Sequence
  Description of Artificial Sequence: Synthetic peptide
MQGIHWLT

SEQ ID NO: 17113 - DNA, 27 bp, Artificial Sequence
  Description of Artificial Sequence: Synthetic oligonucleotide
caacagtatcatagttacccgctcacc

SEQ ID NO: 17114 - protein, 9 aa, Artificial Sequence
  Description of Artificial Sequence: Synthetic peptide
QQYHSYPLT

SEQ ID NO: 17115 - DNA, 27 bp, Artificial Sequence
  Description of Artificial Sequence: Synthetic oligonucleotide
ctacagcatactatttaccctcctact

SEQ ID NO: 17116 - protein, 9 aa, Artificial Sequence
  Description of Artificial Sequence: Synthetic peptide
LQHTIYPPT

SEQ ID NO: 17117 - DNA, 27 bp, Artificial Sequence
  Description of Artificial Sequence: Synthetic oligonucleotide
caacagagttacagtatcccgatcacc

SEQ ID NO: 17118 - protein, 9 aa, Artificial Sequence
  Description of Artificial Sequence: Synthetic peptide
QQSYSIPIT

SEQ ID NO: 17119 - DNA, 27 bp, Artificial Sequence
  Description of Artificial Sequence: Synthetic oligonucleotide
cagcaatattatacttctccgtgcagt

SEQ ID NO: 17120 - protein, 9 aa, Artificial Sequence
  Description of Artificial Sequence: Synthetic peptide
QQYYTSPCS

SEQ ID NO: 17121 - DNA, 27 bp, Artificial Sequence
  Description of Artificial Sequence: Synthetic oligonucleotide
ctacagcatactatttaccctcctact

SEQ ID NO: 17122 - protein, 9 aa, Artificial Sequence
  Description of Artificial Sequence: Synthetic peptide
LQHTIYPPT

SEQ ID NO: 17123 - DNA, 39 bp, Artificial Sequence
  Description of Artificial Sequence: Synthetic oligonucleotide
ggagagagccacccgattgatggccaagtcggtgtggta

SEQ ID NO: 17124 - protein, 13 aa, Artificial Sequence
  Description of Artificial Sequence: Synthetic peptide
GESHPIDGQVGVV

SEQ ID NO: 17125 - DNA, 30 bp, Artificial Sequence; identical to SEQ ID NO: 16215
  Description of Artificial Sequence: Synthetic oligonucleotide

SEQ ID NO: 17126 - protein, 10 aa, Artificial Sequence
  Description of Artificial Sequence: Synthetic peptide
QAWDSSTYVV

SEQ ID NO: 17127 - DNA, 27 bp, Artificial Sequence
  Description of Artificial Sequence: Synthetic oligonucleotide
ctacaacataatagttacccgctcact

SEQ ID NO: 17128 - protein, 9 aa, Artificial Sequence
  Description of Artificial Sequence: Synthetic peptide
LQHNSYPLT

SEQ ID NO: 17129 - DNA, 27 bp, Artificial Sequence
  Description of Artificial Sequence: Synthetic oligonucleotide
caacagtattatagttacccgatcacc

SEQ ID NO: 17130 - protein, 9 aa, Artificial Sequence
  Description of Artificial Sequence: Synthetic peptide
QQYYSYPIT

SEQ ID NO: 17131 - DNA, 27 bp, Artificial Sequence
  Description of Artificial Sequence: Synthetic oligonucleotide
caacaggctaacagtttcccattcact

SEQ ID NO: 17132 - protein, 9 aa, Artificial Sequence
  Description of Artificial Sequence: Synthetic peptide
QQANSFPFT

SEQ ID NO: 17133 - DNA, 27 bp, Artificial Sequence
  Description of Artificial Sequence: Synthetic oligonucleotide
caggcgtgggacaacaacactgtggta

SEQ ID NO: 17134 - protein, 9 aa, Artificial Sequence
  Description of Artificial Sequence: Synthetic peptide
QAWDNNTVV

SEQ ID NO: 17135 - DNA, 27 bp, Artificial Sequence
  Description of Artificial Sequence: Synthetic oligonucleotide
ctacagtatcatagttatctattcact

SEQ ID NO: 17136 - protein, 9 aa, Artificial Sequence
  Description of Artificial Sequence: Synthetic peptide
LQYHSYLFT

SEQ ID NO: 17137 - DNA, 24 bp, Artificial Sequence
  Description of Artificial Sequence: Synthetic oligonucleotide
caggcgtgggacagcagcactgta

SEQ ID NO: 17138 - protein, 8 aa, Artificial Sequence
  Description of Artificial Sequence: Synthetic peptide
QAWDSSTV

SEQ ID NO: 17139 - DNA, 27 bp, Artificial Sequence
  Description of Artificial Sequence: Synthetic oligonucleotide
caacagtataatagttacccgctcact

SEQ ID NO: 17140 - protein, 9 aa, Artificial Sequence
  Description of Artificial Sequence: Synthetic peptide
QQYNSYPLT

SEQ ID NO: 17141 - DNA, 27 bp, Artificial Sequence
  Description of Artificial Sequence: Synthetic oligonucleotide
cagcaatataatagttacccattcact

SEQ ID NO: 17142 - protein, 9 aa, Artificial Sequence
  Description of Artificial Sequence: Synthetic peptide
QQYNSYPFT

SEQ ID NO: 17143 - DNA, 27 bp, Artificial Sequence
  Description of Artificial Sequence: Synthetic oligonucleotide
caacagtatcatagttacccgctcact

SEQ ID NO: 17144 - protein, 9 aa, Artificial Sequence
  Description of Artificial Sequence: Synthetic peptide
QQYHSYPLT

SEQ ID NO: 17145 - DNA, 27 bp, Artificial Sequence
  Description of Artificial Sequence: Synthetic oligonucleotide
ctacagtattatagttacccgctcact

SEQ ID NO: 17146 - protein, 9 aa, Artificial Sequence
  Description of Artificial Sequence: Synthetic peptide
LQYYSYPLT

SEQ ID NO: 17147 - DNA, 33 bp, Artificial Sequence
  Description of Artificial Sequence: Synthetic oligonucleotide
caacagagttacaatacccctccggagtgcaat

SEQ ID NO: 17148 - protein, 11 aa, Artificial Sequence
  Description of Artificial Sequence: Synthetic peptide
QQSYNTPPECN

SEQ ID NO: 17149 - DNA, 27 bp, Artificial Sequence
  Description of Artificial Sequence: Synthetic oligonucleotide
ctacaacattatacttacccgctcact

SEQ ID NO: 17150 - protein, 9 aa, Artificial Sequence
  Description of Artificial Sequence: Synthetic peptide
LQHYTYPLT

SEQ ID NO: 17151 - DNA, 27 bp, Artificial Sequence
  Description of Artificial Sequence: Synthetic oligonucleotide
caggcgtgggacagcagcactgcggta

SEQ ID NO: 17152 - protein, 9 aa, Artificial Sequence
  Description of Artificial Sequence: Synthetic peptide
QAWDSSTAV

SEQ ID NO: 17153 - DNA, 27 bp, Artificial Sequence
  Description of Artificial Sequence: Synthetic oligonucleotide
cagcaatattataatactccagtcact

SEQ ID NO: 17154 - protein, 9 aa, Artificial Sequence
  Description of Artificial Sequence: Synthetic peptide
QQYYNTPVT

SEQ ID NO: 17155 - DNA, 27 bp, Artificial Sequence
  Description of Artificial Sequence: Synthetic oligonucleotide
cagcaatattataatactccagtcact

SEQ ID NO: 17156 - protein, 9 aa, Artificial Sequence
  Description of Artificial Sequence: Synthetic peptide
QQYYNTPVT

SEQ ID NO: 17157 - DNA, 27 bp, Artificial Sequence
  Description of Artificial Sequence: Synthetic oligonucleotide
caggcgtgggacaacagcactgcggta

SEQ ID NO: 17158 - protein, 9 aa, Artificial Sequence
  Description of Artificial Sequence: Synthetic peptide
QAWDNSTAV

SEQ ID NO: 17159 - DNA, 27 bp, Artificial Sequence
  Description of Artificial Sequence: Synthetic oligonucleotide
atgcaaggtacacactggcctctcacc

SEQ ID NO: 17160 - protein, 9 aa, Artificial Sequence
  Description of Artificial Sequence: Synthetic peptide
MQGTHWPLT

SEQ ID NO: 17161 - DNA, 27 bp, Artificial Sequence
  Description of Artificial Sequence: Synthetic oligonucleotide
cagcaatattatgatactccattcact

SEQ ID NO: 17162 - protein, 9 aa, Artificial Sequence
  Description of Artificial Sequence: Synthetic peptide
QQYYDTPFT

SEQ ID NO: 17163 - DNA, 27 bp, Artificial Sequence
  Description of Artificial Sequence: Synthetic oligonucleotide
cagcagtattatagtactcctccgacg

SEQ ID NO: 17164 - protein, 9 aa, Artificial Sequence
  Description of Artificial Sequence: Synthetic peptide
QQYYSTPPT

SEQ ID NO: 17165 - DNA, 27 bp, Artificial Sequence
  Description of Artificial Sequence: Synthetic oligonucleotide
caacagacttacagtaccccgctcact

SEQ ID NO: 17166 - protein, 9 aa, Artificial Sequence
  Description of Artificial Sequence: Synthetic peptide
QQTYSTPLT

SEQ ID NO: 17167 - DNA, 27 bp, Artificial Sequence
  Description of Artificial Sequence: Synthetic oligonucleotide
caacaggctaacagtttcccattcact

SEQ ID NO: 17168 - protein, 9 aa, Artificial Sequence
  Description of Artificial Sequence: Synthetic peptide
QQANSFPFT

SEQ ID NO: 17169 - DNA, 27 bp, Artificial Sequence
  Description of Artificial Sequence: Synthetic oligonucleotide
caacaggctaacagtttcccattcact

SEQ ID NO: 17170 - protein, 9 aa, Artificial Sequence
  Description of Artificial Sequence: Synthetic peptide
QQANSFPFT

SEQ ID NO: 17171 - DNA, 27 bp, Artificial Sequence
  Description of Artificial Sequence: Synthetic oligonucleotide
cagcaatattatagtagtccgtggacg

SEQ ID NO: 17172 - protein, 9 aa, Artificial Sequence
  Description of Artificial Sequence: Synthetic peptide
QQYYSSPWT

SEQ ID NO: 17173 - DNA, 27 bp, Artificial Sequence
  Description of Artificial Sequence: Synthetic oligonucleotide
ctacaacattatagttaccctcgcagt

SEQ ID NO: 17174 - protein, 9 aa, Artificial Sequence
  Description of Artificial Sequence: Synthetic peptide
LQHYSYPRS

SEQ ID NO: 17175 - DNA, 27 bp, Artificial Sequence
  Description of Artificial Sequence: Synthetic oligonucleotide
ttacagcattataattaccctcgcagt

SEQ ID NO: 17176 - protein, 9 aa, Artificial Sequence
  Description of Artificial Sequence: Synthetic peptide
LQHYNYPRS

SEQ ID NO: 17177 - DNA, 27 bp, Artificial Sequence
  Description of Artificial Sequence: Synthetic oligonucleotide
caacagagttacagtccccctctcact

SEQ ID NO: 17178 - protein, 9 aa, Artificial Sequence
  Description of Artificial Sequence: Synthetic peptide
QQSYSPPLT

SEQ ID NO: 17179 - DNA, 27 bp, Artificial Sequence
  Description of Artificial Sequence: Synthetic oligonucleotide
caacagagttacagtaccccgtacact

SEQ ID NO: 17180 - protein, 9 aa, Artificial Sequence
  Description of Artificial Sequence: Synthetic peptide
QQSYSTPYT

SEQ ID NO: 17181 - DNA, 27 bp, Artificial Sequence
  Description of Artificial Sequence: Synthetic oligonucleotide
cagcaatattatgatactccattcact

SEQ ID NO: 17182 - protein, 9 aa, Artificial Sequence
  Description of Artificial Sequence: Synthetic peptide
QQYYDTPFT

SEQ ID NO: 17183 - DNA, 27 bp, Artificial Sequence
  Description of Artificial Sequence: Synthetic oligonucleotide
ctacagcataatagttacccattcact

SEQ ID NO: 17184 - protein, 9 aa, Artificial Sequence
  Description of Artificial Sequence: Synthetic peptide
LQHNSYPFT

SEQ ID NO: 17185 - DNA, 27 bp, Artificial Sequence
  Description of Artificial Sequence: Synthetic oligonucleotide
caacagactaacagtttcccgtggacg

SEQ ID NO: 17186 - protein, 9 aa, Artificial Sequence
  Description of Artificial Sequence: Synthetic peptide
QQTNSFPWT

SEQ ID NO: 17187 - DNA, 27 bp, Artificial Sequence
  Description of Artificial Sequence: Synthetic oligonucleotide
ctacagcataatagttaccctctcact

SEQ ID NO: 17188 - protein, 9 aa, Artificial Sequence
  Description of Artificial Sequence: Synthetic peptide
LQHNSYPLT

SEQ ID NO: 17189 - DNA, 27 bp, Artificial Sequence
  Description of Artificial Sequence: Synthetic oligonucleotide
caacagtattatagttacccattcact

SEQ ID NO: 17190 - protein, 9 aa, Artificial Sequence
  Description of Artificial Sequence: Synthetic peptide
QQYYSYPFT

SEQ ID NO: 17191 - DNA, 27 bp, Artificial Sequence
  Description of Artificial Sequence: Synthetic oligonucleotide
caacagactaacagtttcccgtggacg

SEQ ID NO: 17192 - protein, 9 aa, Artificial Sequence
  Description of Artificial Sequence: Synthetic peptide
QQTNSFPWT

SEQ ID NO: 17193 - DNA, 27 bp, Artificial Sequence
  Description of Artificial Sequence: Synthetic oligonucleotide
ctacagcatactagtttcccattcact

SEQ ID NO: 17194 - protein, 9 aa, Artificial Sequence
  Description of Artificial Sequence: Synthetic peptide
LQHTSFPFT

SEQ ID NO: 17195 - DNA, 27 bp, Artificial Sequence
  Description of Artificial Sequence: Synthetic oligonucleotide
cagcaatattatagtactcctccgacg

SEQ ID NO: 17196 - protein, 9 aa, Artificial Sequence
  Description of Artificial Sequence: Synthetic peptide
QQYYSTPPT

SEQ ID NO: 17197 - DNA, 27 bp, Artificial Sequence
  Description of Artificial Sequence: Synthetic oligonucleotide
caacagactaacagtttcccgtggacg

SEQ ID NO: 17198 - protein, 9 aa, Artificial Sequence
  Description of Artificial Sequence: Synthetic peptide
QQTNSFPWT

SEQ ID NO: 17199 - DNA, 27 bp, Artificial Sequence
  Description of Artificial Sequence: Synthetic oligonucleotide
ctacagcataatagtttcccattcact

SEQ ID NO: 17200 - protein, 9 aa, Artificial Sequence
  Description of Artificial Sequence: Synthetic peptide
LQHNSFPFT

SEQ ID NO: 17201 - DNA, 27 bp, Artificial Sequence
  Description of Artificial Sequence: Synthetic oligonucleotide
caacaggctaacagtctcccattcact

SEQ ID NO: 17202 - protein, 9 aa, Artificial Sequence
  Description of Artificial Sequence: Synthetic peptide
QQANSLPFT

SEQ ID NO: 17203 - DNA, 27 bp, Artificial Sequence
  Description of Artificial Sequence: Synthetic oligonucleotide
atgcaaagtatacagcttccgtggacg

SEQ ID NO: 17204 - protein, 9 aa, Artificial Sequence
  Description of Artificial Sequence: Synthetic peptide
MQSIQLPWT

SEQ ID NO: 17205 - DNA, 27 bp, Artificial Sequence
  Description of Artificial Sequence: Synthetic oligonucleotide
ctactgcattataattaccctcggacg

SEQ ID NO: 17206 - protein, 9 aa, Artificial Sequence
  Description of Artificial Sequence: Synthetic peptide
LLHYNYPRT

SEQ ID NO: 17207 - DNA, 27 bp, Artificial Sequence
  Description of Artificial Sequence: Synthetic oligonucleotide
ctacagcatagtagttaccctctcact

SEQ ID NO: 17208 - protein, 9 aa, Artificial Sequence
  Description of Artificial Sequence: Synthetic peptide
LQHSSYPLT

SEQ ID NO: 17209 - DNA, 27 bp, Artificial Sequence
  Description of Artificial Sequence: Synthetic oligonucleotide
ctacagcattatagttaccctcggacg

SEQ ID NO: 17210 - protein, 9 aa, Artificial Sequence
  Description of Artificial Sequence: Synthetic peptide
LQHYSYPRT

SEQ ID NO: 17211 - DNA, 27 bp, Artificial Sequence
  Description of Artificial Sequence: Synthetic oligonucleotide
caacaggctaacagtttcccattcact

SEQ ID NO: 17212 - protein, 9 aa, Artificial Sequence
  Description of Artificial Sequence: Synthetic peptide
QQANSFPFT

SEQ ID NO: 17213 - DNA, 27 bp, Artificial Sequence
  Description of Artificial Sequence: Synthetic oligonucleotide
ctacagcattatagtttcccgtggacg

SEQ ID NO: 17214 - protein, 9 aa, Artificial Sequence
  Description of Artificial Sequence: Synthetic peptide
LQHYSFPWT

SEQ ID NO: 17215 - DNA, 27 bp, Artificial Sequence
  Description of Artificial Sequence: Synthetic oligonucleotide
cagcagtatggtagttcaccgtggacg

SEQ ID NO: 17216 - protein, 9 aa, Artificial Sequence
  Description of Artificial Sequence: Synthetic peptide
QQYGSSPWT

SEQ ID NO: 17217 - DNA, 27 bp, Artificial Sequence
  Description of Artificial Sequence: Synthetic oligonucleotide
ctacagcataatagttacccattcact

SEQ ID NO: 17218 - protein, 9 aa, Artificial Sequence
  Description of Artificial Sequence: Synthetic peptide
LQHNSYPFT

SEQ ID NO: 17219 - DNA, 27 bp, Artificial Sequence
  Description of Artificial Sequence: Synthetic oligonucleotide
ctccaccattataattaccctcggacg

SEQ ID NO: 17220 - protein, 9 aa, Artificial Sequence
  Description of Artificial Sequence: Synthetic peptide
LHHYNYPRT

SEQ ID NO: 17221 - DNA, 27 bp, Artificial Sequence
  Description of Artificial Sequence: Synthetic oligonucleotide
atgcaaagtatccaccttccgttcact

SEQ ID NO: 17222 - protein, 9 aa, Artificial Sequence
  Description of Artificial Sequence: Synthetic peptide
MQSIHLPFT

SEQ ID NO: 17223 - DNA, 27 bp, Artificial Sequence
  Description of Artificial Sequence: Synthetic oligonucleotide
ctacagcattatagttaccctcggacg

SEQ ID NO: 17224 - protein, 9 aa, Artificial Sequence
  Description of Artificial Sequence: Synthetic peptide
LQHYSYPRT

SEQ ID NO: 17225 - DNA, 27 bp, Artificial Sequence
  Description of Artificial Sequence: Synthetic oligonucleotide
caacagactaacagtttcccgtggacg

SEQ ID NO: 17226 - protein, 9 aa, Artificial Sequence
  Description of Artificial Sequence: Synthetic peptide
QQTNSFPWT

SEQ ID NO: 17227 - DNA, 27 bp, Artificial Sequence
  Description of Artificial Sequence: Synthetic oligonucleotide
atgcaaactctacaaactccattcact

SEQ ID NO: 17228 - protein, 9 aa, Artificial Sequence
  Description of Artificial Sequence: Synthetic peptide
MQTLQTPFT

SEQ ID NO: 17229 - DNA, 27 bp, Artificial Sequence
  Description of Artificial Sequence: Synthetic oligonucleotide
caacagtctaacagtttcccgtggacg

SEQ ID NO: 17230 - protein, 9 aa, Artificial Sequence
  Description of Artificial Sequence: Synthetic peptide
QQSNSFPWT

SEQ ID NO: 17231 - DNA, 27 bp, Artificial Sequence
  Description of Artificial Sequence: Synthetic oligonucleotide
ctacaacataatagttacccgctcact

SEQ ID NO: 17232 - protein, 9 aa, Artificial Sequence
  Description of Artificial Sequence: Synthetic peptide
LQHNSYPLT

SEQ ID NO: 17233 - DNA, 27 bp, Artificial Sequence
  Description of Artificial Sequence: Synthetic oligonucleotide
ctacagcatactagtttcccattcact

SEQ ID NO: 17234 - protein, 9 aa, Artificial Sequence
  Description of Artificial Sequence: Synthetic peptide
LQHTSFPFT

SEQ ID NO: 17235 - DNA, 27 bp, Artificial Sequence
  Description of Artificial Sequence: Synthetic oligonucleotide
ctacagcattatagttaccctcggacg

SEQ ID NO: 17236 - protein, 9 aa, Artificial Sequence
  Description of Artificial Sequence: Synthetic peptide
LQHYSYPRT

SEQ ID NO: 17237 - DNA, 27 bp, Artificial Sequence
  Description of Artificial Sequence: Synthetic oligonucleotide
caacaggctaacagtctccctttcact

SEQ ID NO: 17238 - protein, 9 aa, Artificial Sequence
  Description of Artificial Sequence: Synthetic peptide
QQANSLPFT

SEQ ID NO: 17239 - DNA, 27 bp, Artificial Sequence
  Description of Artificial Sequence: Synthetic oligonucleotide
ctacagcattataattaccctcggacg

SEQ ID NO: 17240 - protein, 9 aa, Artificial Sequence
  Description of Artificial Sequence: Synthetic peptide
LQHYNYPRT

SEQ ID NO: 17241 - DNA, 27 bp, Artificial Sequence
  Description of Artificial Sequence: Synthetic oligonucleotide
caacagactaacagtttcccgtggacg

SEQ ID NO: 17242 - protein, 9 aa, Artificial Sequence
  Description of Artificial Sequence: Synthetic peptide
QQTNSFPWT

SEQ ID NO: 17243 - DNA, 27 bp, Artificial Sequence
  Description of Artificial Sequence: Synthetic oligonucleotide
caacaggctaacagtttcccattcact

SEQ ID NO: 17244 - protein, 9 aa, Artificial Sequence
  Description of Artificial Sequence: Synthetic peptide
QQANSFPFT

SEQ ID NO: 17245 - DNA, 27 bp, Artificial Sequence
  Description of Artificial Sequence: Synthetic oligonucleotide
caacactattatagttacccattcact

SEQ ID NO: 17246 - protein, 9 aa, Artificial Sequence
  Description of Artificial Sequence: Synthetic peptide
QHYYSYPFT

SEQ ID NO: 17247 - DNA, 27 bp, Artificial Sequence
  Description of Artificial Sequence: Synthetic oligonucleotide
ctacagcataatagttacccgctcact

SEQ ID NO: 17248 - protein, 9 aa, Artificial Sequence
  Description of Artificial Sequence: Synthetic peptide
LQHNSYPLT

SEQ ID NO: 17249 - DNA, 27 bp, Artificial Sequence
  Description of Artificial Sequence: Synthetic oligonucleotide
atgcaaagtatacagcttccgtggacg

SEQ ID NO: 17250 - protein, 9 aa, Artificial Sequence
  Description of Artificial Sequence: Synthetic peptide
MQSIQLPWT

SEQ ID NO: 17251 - DNA, 27 bp, Artificial Sequence
  Description of Artificial Sequence: Synthetic oligonucleotide
ctacagcattatagttaccctcggacg

SEQ ID NO: 17252 - protein, 9 aa, Artificial Sequence
  Description of Artificial Sequence: Synthetic peptide
LQHYSYPRT

SEQ ID NO: 17253 - DNA, 27 bp, Artificial Sequence
  Description of Artificial Sequence: Synthetic oligonucleotide
ctacagcataatagttaccctctcact

SEQ ID NO: 17254 - protein, 9 aa, Artificial Sequence
  Description of Artificial Sequence: Synthetic peptide
LQHNSYPLT

SEQ ID NO: 17255 - DNA, 27 bp, Artificial Sequence
  Description of Artificial Sequence: Synthetic oligonucleotide
ctacagcattatagtttcccgtggacg

SEQ ID NO: 17256 - protein, 9 aa, Artificial Sequence
  Description of Artificial Sequence: Synthetic peptide
LQHYSFPWT

SEQ ID NO: 17257 - DNA, 27 bp, Artificial Sequence
  Description of Artificial Sequence: Synthetic oligonucleotide
caacagactaacagtttcccgtggacg

SEQ ID NO: 17258 - protein, 9 aa, Artificial Sequence
  Description of Artificial Sequence: Synthetic peptide
QQTNSFPWT

SEQ ID NO: 17259 - DNA, 27 bp, Artificial Sequence
  Description of Artificial Sequence: Synthetic oligonucleotide
ctacagcataatagttaccctctcact

SEQ ID NO: 17260 - protein, 9 aa, Artificial Sequence
  Description of Artificial Sequence: Synthetic peptide
LQHNSYPLT

SEQ ID NO: 17261 - DNA, 27 bp, Artificial Sequence
  Description of Artificial Sequence: Synthetic oligonucleotide
ctacagcataatagttaccctctcact

SEQ ID NO: 17262 - protein, 9 aa, Artificial Sequence
  Description of Artificial Sequence: Synthetic peptide
LQHNSYPLT

SEQ ID NO: 17263 - DNA, 27 bp, Artificial Sequence
  Description of Artificial Sequence: Synthetic oligonucleotide
atgcacagtatacagtatccgctcacg

SEQ ID NO: 17264 - protein, 9 aa, Artificial Sequence
  Description of Artificial Sequence: Synthetic peptide
MHSIQYPLT

SEQ ID NO: 17265 - DNA, 27 bp, Artificial Sequence
  Description of Artificial Sequence: Synthetic oligonucleotide
cttcagcatactagtttcccattcact

SEQ ID NO: 17266 - protein, 9 aa, Artificial Sequence
  Description of Artificial Sequence: Synthetic peptide
LQHTSFPFT

SEQ ID NO: 17267 - DNA, 27 bp, Artificial Sequence
  Description of Artificial Sequence: Synthetic oligonucleotide
ctgcaacataatagttacccgctcact

SEQ ID NO: 17268 - protein, 9 aa, Artificial Sequence
  Description of Artificial Sequence: Synthetic peptide
LQHNSYPLT

SEQ ID NO: 17269 - DNA, 27 bp, Artificial Sequence
  Description of Artificial Sequence: Synthetic oligonucleotide
atgcaaagtatacagcttccgtggacg

SEQ ID NO: 17270 - protein, 9 aa, Artificial Sequence
  Description of Artificial Sequence: Synthetic peptide
MQSIQLPWT

SEQ ID NO: 17271 - DNA, 27 bp, Artificial Sequence
  Description of Artificial Sequence: Synthetic oligonucleotide
ctacagcataatagttacccgctcact

SEQ ID NO: 17272 - protein, 9 aa, Artificial Sequence
  Description of Artificial Sequence: Synthetic peptide
LQHNSYPLT

SEQ ID NO: 17273 - DNA, 27 bp, Artificial Sequence
  Description of Artificial Sequence: Synthetic oligonucleotide
atgcaagttctacaaactccattcact

SEQ ID NO: 17274 - protein, 9 aa, Artificial Sequence
  Description of Artificial Sequence: Synthetic peptide
MQVLQTPFT

SEQ ID NO: 17275 - DNA, 27 bp, Artificial Sequence
  Description of Artificial Sequence: Synthetic oligonucleotide
atgcaaagtacacaacttccgtggacg

SEQ ID NO: 17276 - protein, 9 aa, Artificial Sequence
  Description of Artificial Sequence: Synthetic peptide
MQSTQLPWT

SEQ ID NO: 17277 - DNA, 27 bp, Artificial Sequence
  Description of Artificial Sequence: Synthetic oligonucleotide
caacaggttaacagtttcccgtggacg

SEQ ID NO: 17278 - protein, 9 aa, Artificial Sequence
  Description of Artificial Sequence: Synthetic peptide
QQVNSFPWT

SEQ ID NO: 17279 - DNA, 27 bp, Artificial Sequence
  Description of Artificial Sequence: Synthetic oligonucleotide
ctacaacatactagtttcccattcact

SEQ ID NO: 17280 - protein, 9 aa, Artificial Sequence
  Description of Artificial Sequence: Synthetic peptide
LQHTSFPFT

SEQ ID NO: 17281 - DNA, 27 bp, Artificial Sequence
  Description of Artificial Sequence: Synthetic oligonucleotide
ctacagcataatttttacccgtggacg

SEQ ID NO: 17282 - protein, 9 aa, Artificial Sequence
  Description of Artificial Sequence: Synthetic peptide
LQHNFYPWT

SEQ ID NO: 17283 - DNA, 27 bp, Artificial Sequence
  Description of Artificial Sequence: Synthetic oligonucleotide
caacagagtaacagtattccattcact

SEQ ID NO: 17284 - protein, 9 aa, Artificial Sequence
  Description of Artificial Sequence: Synthetic peptide
QQSNSIPFT

SEQ ID NO: 17285 - DNA, 27 bp, Artificial Sequence
  Description of Artificial Sequence: Synthetic oligonucleotide
ctacagcaatatagttatcctcggacg

SEQ ID NO: 17286 - protein, 9 aa, Artificial Sequence
  Description of Artificial Sequence: Synthetic peptide
LQQYSYPRT

SEQ ID NO: 17287 - DNA, 27 bp, Artificial Sequence
  Description of Artificial Sequence: Synthetic oligonucleotide
caacagactaacagtattccattcact

SEQ ID NO: 17288 - protein, 9 aa, Artificial Sequence
  Description of Artificial Sequence: Synthetic peptide
QQTNSIPFT

SEQ ID NO: 17289 - DNA, 27 bp, Artificial Sequence
  Description of Artificial Sequence: Synthetic oligonucleotide
caacaggctaacagtttcccgtggacg

SEQ ID NO: 17290 - protein, 9 aa, Artificial Sequence
  Description of Artificial Sequence: Synthetic peptide
QQANSFPWT

SEQ ID NO: 17291 - DNA, 27 bp, Artificial Sequence
  Description of Artificial Sequence: Synthetic oligonucleotide
ctacagcataatcgttacccgtggacg

SEQ ID NO: 17292 - protein, 9 aa, Artificial Sequence
  Description of Artificial Sequence: Synthetic peptide
LQHNRYPWT

SEQ ID NO: 17293 - DNA, 27 bp, Artificial Sequence
  Description of Artificial Sequence: Synthetic oligonucleotide
caacagacttacagtaacccactcact

SEQ ID NO: 17294 - protein, 9 aa, Artificial Sequence
  Description of Artificial Sequence: Synthetic peptide
QQTYSNPLT

SEQ ID NO: 17295 - DNA, 27 bp, Artificial Sequence
  Description of Artificial Sequence: Synthetic oligonucleotide
ctacagcataatagttacccgctcact

SEQ ID NO: 17296 - protein, 9 aa, Artificial Sequence
  Description of Artificial Sequence: Synthetic peptide
LQHNSYPLT

SEQ ID NO: 17297 - DNA, 27 bp, Artificial Sequence
  Description of Artificial Sequence: Synthetic oligonucleotide
caacagacttacagtaacccgctcact

SEQ ID NO: 17298 - protein, 9 aa, Artificial Sequence
  Description of Artificial Sequence: Synthetic peptide
QQTYSNPLT

SEQ ID NO: 17299 - DNA, 27 bp, Artificial Sequence
  Description of Artificial Sequence: Synthetic oligonucleotide
caacagacttacagtaacccgctcact

SEQ ID NO: 17300 - protein, 9 aa, Artificial Sequence
  Description of Artificial Sequence: Synthetic peptide
QQTYSNPLT

SEQ ID NO: 17301 - DNA, 27 bp, Artificial Sequence
  Description of Artificial Sequence: Synthetic oligonucleotide
ctacagcataatagttacccgctcact

SEQ ID NO: 17302 - protein, 9 aa, Artificial Sequence
  Description of Artificial Sequence: Synthetic peptide
LQHNSYPLT

SEQ ID NO: 17303 - DNA, 27 bp, Artificial Sequence
  Description of Artificial Sequence: Synthetic oligonucleotide
atgcaaagtatacagattccgatcacc

SEQ ID NO: 17304 - protein, 9 aa, Artificial Sequence
  Description of Artificial Sequence: Synthetic peptide
MQSIQIPIT

SEQ ID NO: 17305 - DNA, 27 bp, Artificial Sequence
  Description of Artificial Sequence: Synthetic oligonucleotide
caacagtctaacagtttcccattcact

SEQ ID NO: 17306 - protein, 9 aa, Artificial Sequence
  Description of Artificial Sequence: Synthetic peptide
QQSNSFPFT

SEQ ID NO: 17307 - DNA, 27 bp, Artificial Sequence
  Description of Artificial Sequence: Synthetic oligonucleotide
atgcaaagtatgcagcttccgatcacc

SEQ ID NO: 17308 - protein, 9 aa, Artificial Sequence
  Description of Artificial Sequence: Synthetic peptide
MQSMQLPIT

SEQ ID NO: 17309 - DNA, 27 bp, Artificial Sequence
  Description of Artificial Sequence: Synthetic oligonucleotide
caacagactaacagtttcccgttcact

SEQ ID NO: 17310 - protein, 9 aa, Artificial Sequence
  Description of Artificial Sequence: Synthetic peptide
QQTNSFPFT

SEQ ID NO: 17311 - DNA, 27 bp, Artificial Sequence
  Description of Artificial Sequence: Synthetic oligonucleotide
ctacagcataatagttaccctctcact

SEQ ID NO: 17312 - protein, 9 aa, Artificial Sequence
  Description of Artificial Sequence: Synthetic peptide
LQHNSYPLT

SEQ ID NO: 17313 - DNA, 27 bp, Artificial Sequence
  Description of Artificial Sequence: Synthetic oligonucleotide
atgcaaagtatgcagcttccgattatc

SEQ ID NO: 17314 - protein, 9 aa, Artificial Sequence
  Description of Artificial Sequence: Synthetic peptide
MQSMQLPII

SEQ ID NO: 17315 - DNA, 27 bp, Artificial Sequence
  Description of Artificial Sequence: Synthetic oligonucleotide
atgcaaagtatacagtatccgatcacc

SEQ ID NO: 17316 - protein, 9 aa, Artificial Sequence
  Description of Artificial Sequence: Synthetic peptide
MQSIQYPIT

SEQ ID NO: 17317 - DNA, 27 bp, Artificial Sequence
  Description of Artificial Sequence: Synthetic oligonucleotide
caacaggctaacagtttcccattcact

SEQ ID NO: 17318 - protein, 9 aa, Artificial Sequence
  Description of Artificial Sequence: Synthetic peptide
QQANSFPFT

SEQ ID NO: 17319 - DNA, 27 bp, Artificial Sequence
  Description of Artificial Sequence: Synthetic oligonucleotide
caacagagttacagtatcccattcact

SEQ ID NO: 17320 - protein, 9 aa, Artificial Sequence
  Description of Artificial Sequence: Synthetic peptide
QQSYSIPFT

SEQ ID NO: 17321 - DNA, 27 bp, Artificial Sequence
  Description of Artificial Sequence: Synthetic oligonucleotide
ctacagcatactagtttcccattcact

SEQ ID NO: 17322 - protein, 9 aa, Artificial Sequence
  Description of Artificial Sequence: Synthetic peptide
LQHTSFPFT

SEQ ID NO: 17323 - DNA, 27 bp, Artificial Sequence
  Description of Artificial Sequence: Synthetic oligonucleotide
caacagagtaacagtcttccattcact

SEQ ID NO: 17324 - protein, 9 aa, Artificial Sequence
  Description of Artificial Sequence: Synthetic peptide
QQSNSLPFT

SEQ ID NO: 17325 - DNA, 27 bp, Artificial Sequence
  Description of Artificial Sequence: Synthetic oligonucleotide
ctacagtataatagttacccgttcact

SEQ ID NO: 17326 - protein, 9 aa, Artificial Sequence
  Description of Artificial Sequence: Synthetic peptide
LQYNSYPFT

SEQ ID NO: 17327 - DNA, 27 bp, Artificial Sequence
  Description of Artificial Sequence: Synthetic oligonucleotide
caacagagtaacagtattccattcact

SEQ ID NO: 17328 - protein, 9 aa, Artificial Sequence
  Description of Artificial Sequence: Synthetic peptide
QQSNSIPFT

SEQ ID NO: 17329 - DNA, 27 bp, Artificial Sequence
  Description of Artificial Sequence: Synthetic oligonucleotide
ctacagcataatagttacccgtggacg

SEQ ID NO: 17330 - protein, 9 aa, Artificial Sequence
  Description of Artificial Sequence: Synthetic peptide
LQHNSYPWT

SEQ ID NO: 17331 - DNA, 27 bp, Artificial Sequence
  Description of Artificial Sequence: Synthetic oligonucleotide
caacagagttacattgccccattcact

SEQ ID NO: 17332 - protein, 9 aa, Artificial Sequence
  Description of Artificial Sequence: Synthetic peptide
QQSYIAPFT

SEQ ID NO: 17333 - DNA, 27 bp, Artificial Sequence
  Description of Artificial Sequence: Synthetic oligonucleotide
atgcaaagtatacagcttccattcact

SEQ ID NO: 17334 - protein, 9 aa, Artificial Sequence
  Description of Artificial Sequence: Synthetic peptide
MQSIQLPFT

SEQ ID NO: 17335 - DNA, 27 bp, Artificial Sequence
  Description of Artificial Sequence: Synthetic oligonucleotide
caacagtatgataatcttccattcact

SEQ ID NO: 17336 - protein, 9 aa, Artificial Sequence
  Description of Artificial Sequence: Synthetic peptide
QQYDNLPFT

SEQ ID NO: 17337 - DNA, 27 bp, Artificial Sequence
  Description of Artificial Sequence: Synthetic oligonucleotide
ctacagcataatagttacccattcact

SEQ ID NO: 17338 - protein, 9 aa, Artificial Sequence
  Description of Artificial Sequence: Synthetic peptide
LQHNSYPFT

SEQ ID NO: 17339 - DNA, 27 bp, Artificial Sequence
  Description of Artificial Sequence: Synthetic oligonucleotide
caacagtattatagttacccattcact

SEQ ID NO: 17340 - protein, 9 aa, Artificial Sequence
  Description of Artificial Sequence: Synthetic peptide
QQYYSYPFT

SEQ ID NO: 17341 - DNA, 27 bp, Artificial Sequence
  Description of Artificial Sequence: Synthetic oligonucleotide
caacaaactaacagtttcccattcact

SEQ ID NO: 17342 - protein, 9 aa, Artificial Sequence
  Description of Artificial Sequence: Synthetic peptide
QQTNSFPFT

SEQ ID NO: 17343 - DNA, 27 bp, Artificial Sequence
  Description of Artificial Sequence: Synthetic oligonucleotide
caacaggctcacagtttcccgtggacg

SEQ ID NO: 17344 - protein, 9 aa, Artificial Sequence
  Description of Artificial Sequence: Synthetic peptide
QQAHSFPWT

SEQ ID NO: 17345 - DNA, 27 bp, Artificial Sequence
  Description of Artificial Sequence: Synthetic oligonucleotide
caacaggctaacagtttcccattcact

SEQ ID NO: 17346 - protein, 9 aa, Artificial Sequence
  Description of Artificial Sequence: Synthetic peptide
QQANSFPFT

SEQ ID NO: 17347 - DNA, 27 bp, Artificial Sequence
  Description of Artificial Sequence: Synthetic oligonucleotide
ctacagcataatagttacccgtggacg

SEQ ID NO: 17348 - protein, 9 aa, Artificial Sequence
  Description of Artificial Sequence: Synthetic peptide
LQHNSYPWT

SEQ ID NO: 17349 - DNA, 27 bp, Artificial Sequence
  Description of Artificial Sequence: Synthetic oligonucleotide
caacaggctaaaagtttcccattcact

SEQ ID NO: 17350 - protein, 9 aa, Artificial Sequence
  Description of Artificial Sequence: Synthetic peptide
QQAKSFPFT

SEQ ID NO: 17351 - DNA, 27 bp, Artificial Sequence
  Description of Artificial Sequence: Synthetic oligonucleotide
ctacagcataatagttacccattcact

SEQ ID NO: 17352 - protein, 9 aa, Artificial Sequence
  Description of Artificial Sequence: Synthetic peptide
LQHNSYPFT

SEQ ID NO: 17353 - DNA, 27 bp, Artificial Sequence
  Description of Artificial Sequence: Synthetic oligonucleotide
caacagagttacagtatcccattcact

SEQ ID NO: 17354 - protein, 9 aa, Artificial Sequence
  Description of Artificial Sequence: Synthetic peptide
QQSYSIPFT

SEQ ID NO: 17355 - DNA, 27 bp, Artificial Sequence
  Description of Artificial Sequence: Synthetic oligonucleotide
ctacagcataatagttacccattcact

SEQ ID NO: 17356 - protein, 9 aa, Artificial Sequence
  Description of Artificial Sequence: Synthetic peptide
LQHNSYPFT

SEQ ID NO: 17357 - DNA, 27 bp, Artificial Sequence
  Description of Artificial Sequence: Synthetic oligonucleotide
ctacagcataatagttacccgttcact

SEQ ID NO: 17358 - protein, 9 aa, Artificial Sequence
  Description of Artificial Sequence: Synthetic peptide
LQHNSYPFT

SEQ ID NO: 17359 - DNA, 27 bp, Artificial Sequence
  Description of Artificial Sequence: Synthetic oligonucleotide
caacaggctaaaagtttcccattcact

SEQ ID NO: 17360 - protein, 9 aa, Artificial Sequence
  Description of Artificial Sequence: Synthetic peptide
QQAKSFPFT

SEQ ID NO: 17361 - DNA, 27 bp, Artificial Sequence
  Description of Artificial Sequence: Synthetic oligonucleotide
ctgcagcataatagctaccctctcact

SEQ ID NO: 17362 - protein, 9 aa, Artificial Sequence
  Description of Artificial Sequence: Synthetic peptide
LQHNSYPLT

SEQ ID NO: 17363 - DNA, 27 bp, Artificial Sequence
  Description of Artificial Sequence: Synthetic oligonucleotide
caacagactaacagtttcccgtggacg

SEQ ID NO: 17364 - protein, 9 aa, Artificial Sequence
  Description of Artificial Sequence: Synthetic peptide
QQTNSFPWT

SEQ ID NO: 17365 - DNA, 27 bp, Artificial Sequence
  Description of Artificial Sequence: Synthetic oligonucleotide
caacagtataatagtttccctttcact

SEQ ID NO: 17366 - protein, 9 aa, Artificial Sequence
  Description of Artificial Sequence: Synthetic peptide
QQYNSFPFT

SEQ ID NO: 17367 - DNA, 27 bp, Artificial Sequence
  Description of Artificial Sequence: Synthetic oligonucleotide
caacagtgtgataatctcccgctcact

SEQ ID NO: 17368 - protein, 9 aa, Artificial Sequence
  Description of Artificial Sequence: Synthetic peptide
QQCDNLPLT

SEQ ID NO: 17369 - DNA, 27 bp, Artificial Sequence
  Description of Artificial Sequence: Synthetic oligonucleotide
ctacagcataatagttacccattcact

SEQ ID NO: 17370 - protein, 9 aa, Artificial Sequence
  Description of Artificial Sequence: Synthetic peptide
LQHNSYPFT

SEQ ID NO: 17371 - DNA, 27 bp, Artificial Sequence
  Description of Artificial Sequence: Synthetic oligonucleotide
atgcaaagtatacagtatccgatcacc

SEQ ID NO: 17372 - protein, 9 aa, Artificial Sequence
  Description of Artificial Sequence: Synthetic peptide
MQSIQYPIT

SEQ ID NO: 17373 - DNA, 27 bp, Artificial Sequence
  Description of Artificial Sequence: Synthetic oligonucleotide
caacagtataatagttatcctccgacg

SEQ ID NO: 17374 - protein, 9 aa, Artificial Sequence
  Description of Artificial Sequence: Synthetic peptide
QQYNSYPPT

SEQ ID NO: 17375 - DNA, 27 bp, Artificial Sequence
  Description of Artificial Sequence: Synthetic oligonucleotide
caacaggctaaaagtttcccattcact

SEQ ID NO: 17376 - protein, 9 aa, Artificial Sequence
  Description of Artificial Sequence: Synthetic peptide
QQAKSFPFT

SEQ ID NO: 17377 - DNA, 27 bp, Artificial Sequence
  Description of Artificial Sequence: Synthetic oligonucleotide
ctacagtataatagttatccattcact

SEQ ID NO: 17378 - protein, 9 aa, Artificial Sequence
  Description of Artificial Sequence: Synthetic peptide
LQYNSYPFT

SEQ ID NO: 17379 - DNA, 27 bp, Artificial Sequence
  Description of Artificial Sequence: Synthetic oligonucleotide
ctacaggataatagttacccattcact

SEQ ID NO: 17380 - protein, 9 aa, Artificial Sequence
  Description of Artificial Sequence: Synthetic peptide
LQDNSYPFT

SEQ ID NO: 17381 - DNA, 27 bp, Artificial Sequence
  Description of Artificial Sequence: Synthetic oligonucleotide
ctacaacataatagatacccgctcact

SEQ ID NO: 17382 - protein, 9 aa, Artificial Sequence
  Description of Artificial Sequence: Synthetic peptide
LQHNRYPLT

SEQ ID NO: 17383 - DNA, 27 bp, Artificial Sequence
  Description of Artificial Sequence: Synthetic oligonucleotide
caacagagtttcagtaccccattcact

SEQ ID NO: 17384 - protein, 9 aa, Artificial Sequence
  Description of Artificial Sequence: Synthetic peptide
QQSFSTPFT

SEQ ID NO: 17385 - DNA, 27 bp, Artificial Sequence
  Description of Artificial Sequence: Synthetic oligonucleotide
catcagtatgataatctcccgctcact

SEQ ID NO: 17386 - protein, 9 aa, Artificial Sequence
  Description of Artificial Sequence: Synthetic peptide
HQYDNLPLT

SEQ ID NO: 17387 - DNA, 27 bp, Artificial Sequence
  Description of Artificial Sequence: Synthetic oligonucleotide
caacagtatcatagttacccactcact

SEQ ID NO: 17388 - protein, 9 aa, Artificial Sequence
  Description of Artificial Sequence: Synthetic peptide
QQYHSYPLT

SEQ ID NO: 17389 - DNA, 27 bp, Artificial Sequence
  Description of Artificial Sequence: Synthetic oligonucleotide
caacagagttacagtaccccgttcacc

SEQ ID NO: 17390 - protein, 9 aa, Artificial Sequence
  Description of Artificial Sequence: Synthetic peptide
QQSYSTPFT

SEQ ID NO: 17391 - DNA, 27 bp, Artificial Sequence
  Description of Artificial Sequence: Synthetic oligonucleotide
ctacaacataatcgttacccgctcact

SEQ ID NO: 17392 - protein, 9 aa, Artificial Sequence
  Description of Artificial Sequence: Synthetic peptide
LQHNRYPLT

SEQ ID NO: 17393 - DNA, 27 bp, Artificial Sequence
  Description of Artificial Sequence: Synthetic oligonucleotide
caacagtgtgataatctcccgctcact

SEQ ID NO: 17394 - protein, 9 aa, Artificial Sequence
  Description of Artificial Sequence: Synthetic peptide
QQCDNLPLT

SEQ ID NO: 17395 - DNA, 27 bp, Artificial Sequence
  Description of Artificial Sequence: Synthetic oligonucleotide
cagcaggctaacagtttcccattcact

SEQ ID NO: 17396 - protein, 9 aa, Artificial Sequence
  Description of Artificial Sequence: Synthetic peptide
QQANSFPFT

SEQ ID NO: 17397 - DNA, 30 bp, Artificial Sequence
  Description of Artificial Sequence: Synthetic oligonucleotide
cagcagtttgaaagctcacccatgtgcagt

SEQ ID NO: 17398 - protein, 10 aa, Artificial Sequence
  Description of Artificial Sequence: Synthetic peptide
QQFESSPMCS

SEQ ID NO: 17399 - DNA, 27 bp, Artificial Sequence
  Description of Artificial Sequence: Synthetic oligonucleotide
ctacagcataatagttacccattcact

SEQ ID NO: 17400 - protein, 9 aa, Artificial Sequence
  Description of Artificial Sequence: Synthetic peptide
LQHNSYPFT

SEQ ID NO: 17401 - DNA, 27 bp, Artificial Sequence
  Description of Artificial Sequence: Synthetic oligonucleotide
ctacaacataatagttacccattcact

SEQ ID NO: 17402 - protein, 9 aa, Artificial Sequence
  Description of Artificial Sequence: Synthetic peptide
LQHNSYPFT

SEQ ID NO: 17403 - DNA, 27 bp, Artificial Sequence
  Description of Artificial Sequence: Synthetic oligonucleotide
caacaggctaacagtttcccgtggacg

SEQ ID NO: 17404 - protein, 9 aa, Artificial Sequence
  Description of Artificial Sequence: Synthetic peptide
QQANSFPWT

SEQ ID NO: 17405 - DNA, 27 bp, Artificial Sequence
  Description of Artificial Sequence: Synthetic oligonucleotide
ctacagtataatagttacccgtggacg

SEQ ID NO: 17406 - protein, 9 aa, Artificial Sequence
  Description of Artificial Sequence: Synthetic peptide
LQYNSYPWT

SEQ ID NO: 17407 - DNA, 27 bp, Artificial Sequence
  Description of Artificial Sequence: Synthetic oligonucleotide
atgcaaagtatacagtttccattcact

SEQ ID NO: 17408 - protein, 9 aa, Artificial Sequence
  Description of Artificial Sequence: Synthetic peptide
MQSIQFPFT

SEQ ID NO: 17409 - DNA, 27 bp, Artificial Sequence
  Description of Artificial Sequence: Synthetic oligonucleotide
ctacagcataatcgttacccgctcact

SEQ ID NO: 17410 - protein, 9 aa, Artificial Sequence
  Description of Artificial Sequence: Synthetic peptide
LQHNRYPLT

SEQ ID NO: 17411 - DNA, 27 bp, Artificial Sequence
  Description of Artificial Sequence: Synthetic oligonucleotide
ctacatcataatacttacccattcact

SEQ ID NO: 17412 - protein, 9 aa, Artificial Sequence
  Description of Artificial Sequence: Synthetic peptide
LHHNTYPFT

SEQ ID NO: 17413 - DNA, 27 bp, Artificial Sequence
  Description of Artificial Sequence: Synthetic oligonucleotide
caacaggctaacagtttcccattcact

SEQ ID NO: 17414 - protein, 9 aa, Artificial Sequence
  Description of Artificial Sequence: Synthetic peptide
QQANSFPFT

SEQ ID NO: 17415 - DNA, 27 bp, Artificial Sequence
  Description of Artificial Sequence: Synthetic oligonucleotide
cagcagtattataactggcctctcact

SEQ ID NO: 17416 - protein, 9 aa, Artificial Sequence
  Description of Artificial Sequence: Synthetic peptide
QQYYNWPLT

SEQ ID NO: 17417 - DNA, 27 bp, Artificial Sequence
  Description of Artificial Sequence: Synthetic oligonucleotide
atgcaaagtatacagcttccattcact

SEQ ID NO: 17418 - protein, 9 aa, Artificial Sequence
  Description of Artificial Sequence: Synthetic peptide
MQSIQLPFT

SEQ ID NO: 17419 - DNA, 27 bp, Artificial Sequence
  Description of Artificial Sequence: Synthetic oligonucleotide
atgcaaagtatactgtatccgatcacc

SEQ ID NO: 17420 - protein, 9 aa, Artificial Sequence
  Description of Artificial Sequence: Synthetic peptide
MQSILYPIT

SEQ ID NO: 17421 - DNA, 27 bp, Artificial Sequence
  Description of Artificial Sequence: Synthetic oligonucleotide
ctacaacataatagttacccattcact

SEQ ID NO: 17422 - protein, 9 aa, Artificial Sequence
  Description of Artificial Sequence: Synthetic peptide
LQHNSYPFT

SEQ ID NO: 17423 - DNA, 27 bp, Artificial Sequence
  Description of Artificial Sequence: Synthetic oligonucleotide
caacagtatcatagtttccctctcact

SEQ ID NO: 17424 - protein, 9 aa, Artificial Sequence
  Description of Artificial Sequence: Synthetic peptide
QQYHSFPLT

SEQ ID NO: 17425 - DNA, 27 bp, Artificial Sequence
  Description of Artificial Sequence: Synthetic oligonucleotide
ctacagcataatagttaccctctcact

SEQ ID NO: 17426 - protein, 9 aa, Artificial Sequence
  Description of Artificial Sequence: Synthetic peptide
LQHNSYPLT

SEQ ID NO: 17427 - DNA, 27 bp, Artificial Sequence
  Description of Artificial Sequence: Synthetic oligonucleotide
atacaaagtatacaacttccgatcacc

SEQ ID NO: 17428 - protein, 9 aa, Artificial Sequence
  Description of Artificial Sequence: Synthetic peptide
IQSIQLPIT

SEQ ID NO: 17429 - DNA, 27 bp, Artificial Sequence
  Description of Artificial Sequence: Synthetic oligonucleotide
caacagtgtgataatctcccgctcact

SEQ ID NO: 17430 - protein, 9 aa, Artificial Sequence
  Description of Artificial Sequence: Synthetic peptide
QQCDNLPLT

SEQ ID NO: 17431 - DNA, 27 bp, Artificial Sequence
  Description of Artificial Sequence: Synthetic oligonucleotide
caacagagttacagtccccctctcact

SEQ ID NO: 17432 - protein, 9 aa, Artificial Sequence
  Description of Artificial Sequence: Synthetic peptide
QQSYSPPLT

SEQ ID NO: 17433 - DNA, 27 bp, Artificial Sequence
  Description of Artificial Sequence: Synthetic oligonucleotide
caacagactaacagtttcccattcact

SEQ ID NO: 17434 - protein, 9 aa, Artificial Sequence
  Description of Artificial Sequence: Synthetic peptide
QQTNSFPFT

SEQ ID NO: 17435 - DNA, 27 bp, Artificial Sequence
  Description of Artificial Sequence: Synthetic oligonucleotide
ctacagcataatcgttacccattcact

SEQ ID NO: 17436 - protein, 9 aa, Artificial Sequence
  Description of Artificial Sequence: Synthetic peptide
LQHNRYPFT

SEQ ID NO: 17437 - DNA, 24 bp, Artificial Sequence
  Description of Artificial Sequence: Synthetic oligonucleotide
caacagtatgataatctgatcacc

SEQ ID NO: 17438 - protein, 8 aa, Artificial Sequence
  Description of Artificial Sequence: Synthetic peptide
QQYDNLIT

SEQ ID NO: 17439 - DNA, 27 bp, Artificial Sequence
  Description of Artificial Sequence: Synthetic oligonucleotide
caacagtataatagttatcctctcact

SEQ ID NO: 17440 - protein, 9 aa, Artificial Sequence
  Description of Artificial Sequence: Synthetic peptide
QQYNSYPLT

SEQ ID NO: 17441 - DNA, 27 bp, Artificial Sequence
  Description of Artificial Sequence: Synthetic oligonucleotide
cagcaatattatagtactcctccgacg

SEQ ID NO: 17442 - protein, 9 aa, Artificial Sequence
  Description of Artificial Sequence: Synthetic peptide
QQYYSTPPT

SEQ ID NO: 17443 - DNA, 27 bp, Artificial Sequence
  Description of Artificial Sequence: Synthetic oligonucleotide
ctacaggataatagtcacccgttcact

SEQ ID NO: 17444 - protein, 9 aa, Artificial Sequence
  Description of Artificial Sequence: Synthetic peptide
LQDNSHPFT

SEQ ID NO: 17445 - DNA, 27 bp, Artificial Sequence
  Description of Artificial Sequence: Synthetic oligonucleotide
caacagagttacagtaccccattcact

SEQ ID NO: 17446 - protein, 9 aa, Artificial Sequence
  Description of Artificial Sequence: Synthetic peptide
QQSYSTPFT

SEQ ID NO: 17447 - DNA, 27 bp, Artificial Sequence
  Description of Artificial Sequence: Synthetic oligonucleotide
ctacagtataatagttacccattcact

SEQ ID NO: 17448 - protein, 9 aa, Artificial Sequence
  Description of Artificial Sequence: Synthetic peptide
LQYNSYPFT

SEQ ID NO: 17449 - DNA, 27 bp, Artificial Sequence
  Description of Artificial Sequence: Synthetic oligonucleotide
caacaggctaacagtttcccattcact

SEQ ID NO: 17450 - protein, 9 aa, Artificial Sequence
  Description of Artificial Sequence: Synthetic peptide
QQANSFPFT

SEQ ID NO: 17451 - DNA, 27 bp, Artificial Sequence
  Description of Artificial Sequence: Synthetic oligonucleotide
caacagacttacagtccccctctcact

SEQ ID NO: 17452 - protein, 9 aa, Artificial Sequence
  Description of Artificial Sequence: Synthetic peptide
QQTYSPPLT

SEQ ID NO: 17453 - DNA, 27 bp, Artificial Sequence
  Description of Artificial Sequence: Synthetic oligonucleotide
caacaggctaacagtttcccattcact

SEQ ID NO: 17454 - protein, 9 aa, Artificial Sequence
  Description of Artificial Sequence: Synthetic peptide
QQANSFPFT

SEQ ID NO: 17455 - DNA, 27 bp, Artificial Sequence
  Description of Artificial Sequence: Synthetic oligonucleotide
caacaggctaacagtttcccattcact

SEQ ID NO: 17456 - protein, 9 aa, Artificial Sequence
  Description of Artificial Sequence: Synthetic peptide
QQANSFPFT

SEQ ID NO: 17457 - DNA, 27 bp, Artificial Sequence
  Description of Artificial Sequence: Synthetic oligonucleotide
ctacagcataatagttatccgtggacg

SEQ ID NO: 17458 - protein, 9 aa, Artificial Sequence
  Description of Artificial Sequence: Synthetic peptide
LQHNSYPWT

SEQ ID NO: 17459 - DNA, 27 bp, Artificial Sequence
  Description of Artificial Sequence: Synthetic oligonucleotide
ctacagcataatcgttaccctttcact

SEQ ID NO: 17460 - protein, 9 aa, Artificial Sequence
  Description of Artificial Sequence: Synthetic peptide
LQHNRYPFT

SEQ ID NO: 17461 - DNA, 27 bp, Artificial Sequence
  Description of Artificial Sequence: Synthetic oligonucleotide
atgcaaagtacacagcttccgctcacc

SEQ ID NO: 17462 - protein, 9 aa, Artificial Sequence
  Description of Artificial Sequence: Synthetic peptide
MQSTQLPLT

SEQ ID NO: 17463 - DNA, 27 bp, Artificial Sequence
  Description of Artificial Sequence: Synthetic oligonucleotide
ctacagcataatagttacccgtggacg

SEQ ID NO: 17464 - protein, 9 aa, Artificial Sequence
  Description of Artificial Sequence: Synthetic peptide
LQHNSYPWT

SEQ ID NO: 17465 - DNA, 27 bp, Artificial Sequence
  Description of Artificial Sequence: Synthetic oligonucleotide
atgcaaagtatacagcttccgctcact

SEQ ID NO: 17466 - protein, 9 aa, Artificial Sequence
  Description of Artificial Sequence: Synthetic peptide
MQSIQLPLT

SEQ ID NO: 17467 - DNA, 27 bp, Artificial Sequence
  Description of Artificial Sequence: Synthetic oligonucleotide
ctacagcataatagttaccctttcact

SEQ ID NO: 17468 - protein, 9 aa, Artificial Sequence
  Description of Artificial Sequence: Synthetic peptide
LQHNSYPFT

SEQ ID NO: 17469 - DNA, 27 bp, Artificial Sequence
  Description of Artificial Sequence: Synthetic oligonucleotide
ctacagcataatagttacccgtggacg

SEQ ID NO: 17470 - protein, 9 aa, Artificial Sequence
  Description of Artificial Sequence: Synthetic peptide
LQHNSYPWT

SEQ ID NO: 17471 - DNA, 27 bp, Artificial Sequence
  Description of Artificial Sequence: Synthetic oligonucleotide
cagcaatattatagtactccgtgcagt

SEQ ID NO: 17472 - protein, 9 aa, Artificial Sequence
  Description of Artificial Sequence: Synthetic peptide
QQYYSTPCS

SEQ ID NO: 17473 - DNA, 27 bp, Artificial Sequence
  Description of Artificial Sequence: Synthetic oligonucleotide
caacaatataaaagtcacccattcact

SEQ ID NO: 17474 - protein, 9 aa, Artificial Sequence
  Description of Artificial Sequence: Synthetic peptide
QQYKSHPFT

SEQ ID NO: 17475 - DNA, 27 bp, Artificial Sequence
  Description of Artificial Sequence: Synthetic oligonucleotide
ctacagtttcatagttacccattcact

SEQ ID NO: 17476 - protein, 9 aa, Artificial Sequence
  Description of Artificial Sequence: Synthetic peptide
LQFHSYPFT

SEQ ID NO: 17477 - DNA, 27 bp, Artificial Sequence
  Description of Artificial Sequence: Synthetic oligonucleotide
ctacagcatagtagttacccgctcact

SEQ ID NO: 17478 - protein, 9 aa, Artificial Sequence
  Description of Artificial Sequence: Synthetic peptide
LQHSSYPLT

SEQ ID NO: 17479 - DNA, 27 bp, Artificial Sequence
  Description of Artificial Sequence: Synthetic oligonucleotide
cagcagtataataactggccattcact

SEQ ID NO: 17480 - protein, 9 aa, Artificial Sequence
  Description of Artificial Sequence: Synthetic peptide
QQYNNWPFT

SEQ ID NO: 17481 - DNA, 27 bp, Artificial Sequence
  Description of Artificial Sequence: Synthetic oligonucleotide
caacaggctaacagtttcccgtggacg

SEQ ID NO: 17482 - protein, 9 aa, Artificial Sequence
  Description of Artificial Sequence: Synthetic peptide
QQANSFPWT

SEQ ID NO: 17483 - DNA, 27 bp, Artificial Sequence
  Description of Artificial Sequence: Synthetic oligonucleotide
atgcaaagtataaagtatccgctcact

SEQ ID NO: 17484 - protein, 9 aa, Artificial Sequence
  Description of Artificial Sequence: Synthetic peptide
MQSIKYPLT

SEQ ID NO: 17485 - DNA, 27 bp, Artificial Sequence
  Description of Artificial Sequence: Synthetic oligonucleotide
caacagagttacaatatttcattcact

SEQ ID NO: 17486 - protein, 9 aa, Artificial Sequence
  Description of Artificial Sequence: Synthetic peptide
QQSYNISFT

SEQ ID NO: 17487 - DNA, 27 bp, Artificial Sequence
  Description of Artificial Sequence: Synthetic oligonucleotide
caacagagttacaatatttcattcact

SEQ ID NO: 17488 - protein, 9 aa, Artificial Sequence
  Description of Artificial Sequence: Synthetic peptide
QQSYNISFT

SEQ ID NO: 17489 - DNA, 27 bp, Artificial Sequence
  Description of Artificial Sequence: Synthetic oligonucleotide
ctacagcataatagttacccgtggacg

SEQ ID NO: 17490 - protein, 9 aa, Artificial Sequence
  Description of Artificial Sequence: Synthetic peptide
LQHNSYPWT

SEQ ID NO: 17491 - DNA, 27 bp, Artificial Sequence
  Description of Artificial Sequence: Synthetic oligonucleotide
ctacagcattatagttaccctcgcagt

SEQ ID NO: 17492 - protein, 9 aa, Artificial Sequence
  Description of Artificial Sequence: Synthetic peptide
LQHYSYPRS

SEQ ID NO: 17493 - DNA, 27 bp, Artificial Sequence
  Description of Artificial Sequence: Synthetic oligonucleotide
atgcaaagtatacagcttccgctcact

SEQ ID NO: 17494 - protein, 9 aa, Artificial Sequence
  Description of Artificial Sequence: Synthetic peptide
MQSIQLPLT

SEQ ID NO: 17495 - DNA, 27 bp, Artificial Sequence
  Description of Artificial Sequence: Synthetic oligonucleotide
cagcaatattatagtattccgtgcagt

SEQ ID NO: 17496 - protein, 9 aa, Artificial Sequence
  Description of Artificial Sequence: Synthetic peptide
QQYYSIPCS

SEQ ID NO: 17497 - DNA, 27 bp, Artificial Sequence
  Description of Artificial Sequence: Synthetic oligonucleotide
cagcaatattatagtactcctccgacg

SEQ ID NO: 17498 - protein, 9 aa, Artificial Sequence
  Description of Artificial Sequence: Synthetic peptide
QQYYSTPPT

SEQ ID NO: 17499 - DNA, 27 bp, Artificial Sequence
  Description of Artificial Sequence: Synthetic oligonucleotide
caacagagttacagtatcccgtggacg

SEQ ID NO: 17500 - protein, 9 aa, Artificial Sequence
  Description of Artificial Sequence: Synthetic peptide
QQSYSIPWT

SEQ ID NO: 17501 - DNA, 30 bp, Artificial Sequence
  Description of Artificial Sequence: Synthetic oligonucleotide
ctacaacataatagtttccctccgtggacg

SEQ ID NO: 17502 - protein, 10 aa, Artificial Sequence
  Description of Artificial Sequence: Synthetic peptide
LQHNSFPPWT

SEQ ID NO: 17503 - DNA, 27 bp, Artificial Sequence
  Description of Artificial Sequence: Synthetic oligonucleotide
ctgcaagctctacaaactcctctcacc

SEQ ID NO: 17504 - protein, 9 aa, Artificial Sequence
  Description of Artificial Sequence: Synthetic peptide
LQALQTPLT

SEQ ID NO: 17505 - DNA, 27 bp, Artificial Sequence
  Description of Artificial Sequence: Synthetic oligonucleotide
caacagagttacagtaccccattcact

SEQ ID NO: 17506 - protein, 9 aa, Artificial Sequence
  Description of Artificial Sequence: Synthetic peptide
QQSYSTPFT

SEQ ID NO: 17507 - DNA, 27 bp, Artificial Sequence
  Description of Artificial Sequence: Synthetic oligonucleotide
caacagacttacagtcccccgctcact

SEQ ID NO: 17508 - protein, 9 aa, Artificial Sequence
  Description of Artificial Sequence: Synthetic peptide
QQTYSPPLT

SEQ ID NO: 17509 - DNA, 27 bp, Artificial Sequence
  Description of Artificial Sequence: Synthetic oligonucleotide
ctacagcatagtaattaccctctcact

SEQ ID NO: 17510 - protein, 9 aa, Artificial Sequence
  Description of Artificial Sequence: Synthetic peptide
LQHSNYPLT

SEQ ID NO: 17511 - DNA, 27 bp, Artificial Sequence
  Description of Artificial Sequence: Synthetic oligonucleotide
ctacagtataatagttacccattcact

SEQ ID NO: 17512 - protein, 9 aa, Artificial Sequence
  Description of Artificial Sequence: Synthetic peptide
LQYNSYPFT

SEQ ID NO: 17513 - DNA, 27 bp, Artificial Sequence
  Description of Artificial Sequence: Synthetic oligonucleotide
ctacagcataatagttatccgctcact

SEQ ID NO: 17514 - protein, 9 aa, Artificial Sequence
  Description of Artificial Sequence: Synthetic peptide
LQHNSYPLT

SEQ ID NO: 17515 - DNA, 27 bp, Artificial Sequence
  Description of Artificial Sequence: Synthetic oligonucleotide
cagcagtataatgactggccgtgtagt

SEQ ID NO: 17516 - protein, 9 aa, Artificial Sequence
  Description of Artificial Sequence: Synthetic peptide
QQYNDWPCS

SEQ ID NO: 17517 - DNA, 30 bp, Artificial Sequence
  Description of Artificial Sequence: Synthetic oligonucleotide
ctacagtataatagttaccctccgtggacg

SEQ ID NO: 17518 - protein, 10 aa, Artificial Sequence
  Description of Artificial Sequence: Synthetic peptide
LQYNSYPPWT

SEQ ID NO: 17519 - DNA, 27 bp, Artificial Sequence
  Description of Artificial Sequence: Synthetic oligonucleotide
caacagactaacagtttccctctcact

SEQ ID NO: 17520 - protein, 9 aa, Artificial Sequence
  Description of Artificial Sequence: Synthetic peptide
QQTNSFPLT

SEQ ID NO: 17521 - DNA, 27 bp, Artificial Sequence
  Description of Artificial Sequence: Synthetic oligonucleotide
catcagtataatagtttcccatttaag

SEQ ID NO: 17522 - protein, 9 aa, Artificial Sequence
  Description of Artificial Sequence: Synthetic peptide
HQYNSFPFK

SEQ ID NO: 17523 - DNA, 27 bp, Artificial Sequence
  Description of Artificial Sequence: Synthetic oligonucleotide
ctacaggataatagttacccattcact

SEQ ID NO: 17524 - protein, 9 aa, Artificial Sequence
  Description of Artificial Sequence: Synthetic peptide
LQDNSYPFT

SEQ ID NO: 17525 - DNA, 27 bp, Artificial Sequence
  Description of Artificial Sequence: Synthetic oligonucleotide
ctacagcataatagttacccattcact

SEQ ID NO: 17526 - protein, 9 aa, Artificial Sequence
  Description of Artificial Sequence: Synthetic peptide
LQHNSYPFT

SEQ ID NO: 17527 - DNA, 27 bp, Artificial Sequence
  Description of Artificial Sequence: Synthetic oligonucleotide
caacagagttacaatatttcattcact

SEQ ID NO: 17528 - protein, 9 aa, Artificial Sequence
  Description of Artificial Sequence: Synthetic peptide
QQSYNISFT

SEQ ID NO: 17529 - DNA, 27 bp, Artificial Sequence
  Description of Artificial Sequence: Synthetic oligonucleotide
cagcagtataatgactggccgtgcagt

SEQ ID NO: 17530 - protein, 9 aa, Artificial Sequence
  Description of Artificial Sequence: Synthetic peptide
QQYNDWPCS

SEQ ID NO: 17531 - DNA, 27 bp, Artificial Sequence
  Description of Artificial Sequence: Synthetic oligonucleotide
ctacagcataatagttacccattcact

SEQ ID NO: 17532 - protein, 9 aa, Artificial Sequence
  Description of Artificial Sequence: Synthetic peptide
LQHNSYPFT

SEQ ID NO: 17533 - DNA, 27 bp, Artificial Sequence
  Description of Artificial Sequence: Synthetic oligonucleotide
caacagggtaacagtttcccattcact

SEQ ID NO: 17534 - protein, 9 aa, Artificial Sequence
  Description of Artificial Sequence: Synthetic peptide
QQGNSFPFT

SEQ ID NO: 17535 - DNA, 27 bp, Artificial Sequence
  Description of Artificial Sequence: Synthetic oligonucleotide
ctacagtatggtagtttcccattcact

SEQ ID NO: 17536 - protein, 9 aa, Artificial Sequence
  Description of Artificial Sequence: Synthetic peptide
LQYGSFPFT

SEQ ID NO: 17537 - DNA, 27 bp, Artificial Sequence
  Description of Artificial Sequence: Synthetic oligonucleotide
caacaggctaacagtttcccattcact

SEQ ID NO: 17538 - protein, 9 aa, Artificial Sequence
  Description of Artificial Sequence: Synthetic peptide
QQANSFPFT

SEQ ID NO: 17539 - DNA, 27 bp, Artificial Sequence
  Description of Artificial Sequence: Synthetic oligonucleotide
cagcagtatagtaactggccattcact

SEQ ID NO: 17540 - protein, 9 aa, Artificial Sequence
  Description of Artificial Sequence: Synthetic peptide
QQYSNWPFT

SEQ ID NO: 17541 - DNA, 30 bp, Artificial Sequence; identical to SEQ ID NO: 17501
  Description of Artificial Sequence: Synthetic oligonucleotide

SEQ ID NO: 17542 - protein, 10 aa, Artificial Sequence
  Description of Artificial Sequence: Synthetic peptide
LQHNSFPPWT

SEQ ID NO: 17543 - DNA, 27 bp, Artificial Sequence
  Description of Artificial Sequence: Synthetic oligonucleotide
caacaggctaacagtttcccgtggacg

SEQ ID NO: 17544 - protein, 9 aa, Artificial Sequence
  Description of Artificial Sequence: Synthetic peptide
QQANSFPWT

SEQ ID NO: 17545 - DNA, 27 bp, Artificial Sequence
  Description of Artificial Sequence: Synthetic oligonucleotide
cagcaatattatagtactccgtggacg

SEQ ID NO: 17546 - protein, 9 aa, Artificial Sequence
  Description of Artificial Sequence: Synthetic peptide
QQYYSTPWT

SEQ ID NO: 17547 - DNA, 27 bp, Artificial Sequence
  Description of Artificial Sequence: Synthetic oligonucleotide
cagcaatattatagtaatccgtgtagt

SEQ ID NO: 17548 - protein, 9 aa, Artificial Sequence
  Description of Artificial Sequence: Synthetic peptide
QQYYSNPCS

SEQ ID NO: 17549 - DNA, 27 bp, Artificial Sequence
  Description of Artificial Sequence: Synthetic oligonucleotide
cagcagtatgataactggccattcact

SEQ ID NO: 17550 - protein, 9 aa, Artificial Sequence
  Description of Artificial Sequence: Synthetic peptide
QQYDNWPFT

SEQ ID NO: 17551 - DNA, 27 bp, Artificial Sequence
  Description of Artificial Sequence: Synthetic oligonucleotide
cagcagtttaataactggccattcact

SEQ ID NO: 17552 - protein, 9 aa, Artificial Sequence
  Description of Artificial Sequence: Synthetic peptide
QQFNNWPFT

SEQ ID NO: 17553 - DNA, 27 bp, Artificial Sequence
  Description of Artificial Sequence: Synthetic oligonucleotide
ctacagcataatagttacccattcact

SEQ ID NO: 17554 - protein, 9 aa, Artificial Sequence
  Description of Artificial Sequence: Synthetic peptide
LQHNSYPFT

SEQ ID NO: 17555 - DNA, 27 bp, Artificial Sequence
  Description of Artificial Sequence: Synthetic oligonucleotide
cagcaatattatagtactcctccgacg

SEQ ID NO: 17556 - protein, 9 aa, Artificial Sequence
  Description of Artificial Sequence: Synthetic peptide
QQYYSTPPT

SEQ ID NO: 17557 - DNA, 27 bp, Artificial Sequence
  Description of Artificial Sequence: Synthetic oligonucleotide
cagcagtataataactggccattcact

SEQ ID NO: 17558 - protein, 9 aa, Artificial Sequence
  Description of Artificial Sequence: Synthetic peptide
QQYNNWPFT

SEQ ID NO: 17559 - DNA, 27 bp, Artificial Sequence
  Description of Artificial Sequence: Synthetic oligonucleotide
ctccagcataataatttcccattcact

SEQ ID NO: 17560 - protein, 9 aa, Artificial Sequence
  Description of Artificial Sequence: Synthetic peptide
LQHNNFPFT

SEQ ID NO: 17561 - DNA, 27 bp, Artificial Sequence
  Description of Artificial Sequence: Synthetic oligonucleotide
cagcagtataataactggccattcact

SEQ ID NO: 17562 - protein, 9 aa, Artificial Sequence
  Description of Artificial Sequence: Synthetic peptide
QQYNNWPFT

SEQ ID NO: 17563 - DNA, 27 bp, Artificial Sequence
  Description of Artificial Sequence: Synthetic oligonucleotide
atgcaaagtatacagcttccgctcact

SEQ ID NO: 17564 - protein, 9 aa, Artificial Sequence
  Description of Artificial Sequence: Synthetic peptide
MQSIQLPLT

SEQ ID NO: 17565 - DNA, 27 bp, Artificial Sequence
  Description of Artificial Sequence: Synthetic oligonucleotide
cagcaatattttagtattccgtgcagt

SEQ ID NO: 17566 - protein, 9 aa, Artificial Sequence
  Description of Artificial Sequence: Synthetic peptide
QQYFSIPCS

SEQ ID NO: 17567 - DNA, 27 bp, Artificial Sequence
  Description of Artificial Sequence: Synthetic oligonucleotide
cagcaatatggtacctcaccgtggacg

SEQ ID NO: 17568 - protein, 9 aa, Artificial Sequence
  Description of Artificial Sequence: Synthetic peptide
QQYGTSPWT

SEQ ID NO: 17569 - DNA, 30 bp, Artificial Sequence
  Description of Artificial Sequence: Synthetic oligonucleotide
caacagagttacagtacccctatgttcagt

SEQ ID NO: 17570 - protein, 10 aa, Artificial Sequence
  Description of Artificial Sequence: Synthetic peptide
QQSYSTPMFS

SEQ ID NO: 17571 - DNA, 27 bp, Artificial Sequence
  Description of Artificial Sequence: Synthetic oligonucleotide
caccagtatggtaactcaccattcact

SEQ ID NO: 17572 - protein, 9 aa, Artificial Sequence
  Description of Artificial Sequence: Synthetic peptide
HQYGNSPFT

SEQ ID NO: 17573 - DNA, 27 bp, Artificial Sequence
  Description of Artificial Sequence: Synthetic oligonucleotide
ctacagcataatagttacccgctcact

SEQ ID NO: 17574 - protein, 9 aa, Artificial Sequence
  Description of Artificial Sequence: Synthetic peptide
LQHNSYPLT

SEQ ID NO: 17575 - DNA, 27 bp, Artificial Sequence
  Description of Artificial Sequence: Synthetic oligonucleotide
ctacagcataatagttacccgtggacg

SEQ ID NO: 17576 - protein, 9 aa, Artificial Sequence
  Description of Artificial Sequence: Synthetic peptide
LQHNSYPWT

SEQ ID NO: 17577 - DNA, 27 bp, Artificial Sequence
  Description of Artificial Sequence: Synthetic oligonucleotide
caacagagtttcagtaattcgatcacc

SEQ ID NO: 17578 - protein, 9 aa, Artificial Sequence
  Description of Artificial Sequence: Synthetic peptide
QQSFSNSIT

SEQ ID NO: 17579 - DNA, 27 bp, Artificial Sequence
  Description of Artificial Sequence: Synthetic oligonucleotide
ctacagcataatagttacccgtggacg

SEQ ID NO: 17580 - protein, 9 aa, Artificial Sequence
  Description of Artificial Sequence: Synthetic peptide
LQHNSYPWT

SEQ ID NO: 17581 - DNA, 27 bp, Artificial Sequence
  Description of Artificial Sequence: Synthetic oligonucleotide
cagcaatattttagtactcctccgacg

SEQ ID NO: 17582 - protein, 9 aa, Artificial Sequence
  Description of Artificial Sequence: Synthetic peptide
QQYFSTPPT

SEQ ID NO: 17583 - DNA, 27 bp, Artificial Sequence
  Description of Artificial Sequence: Synthetic oligonucleotide
caacagagttacagtaccccattcact

SEQ ID NO: 17584 - protein, 9 aa, Artificial Sequence
  Description of Artificial Sequence: Synthetic peptide
QQSYSTPFT

SEQ ID NO: 17585 - DNA, 27 bp, Artificial Sequence
  Description of Artificial Sequence: Synthetic oligonucleotide
caacagagttacggtatccccatcacc

SEQ ID NO: 17586 - protein, 9 aa, Artificial Sequence
  Description of Artificial Sequence: Synthetic peptide
QQSYGIPIT

SEQ ID NO: 17587 - DNA, 27 bp, Artificial Sequence
  Description of Artificial Sequence: Synthetic oligonucleotide
caacaatatcatagttacccattcact

SEQ ID NO: 17588 - protein, 9 aa, Artificial Sequence
  Description of Artificial Sequence: Synthetic peptide
QQYHSYPFT

SEQ ID NO: 17589 - DNA, 27 bp, Artificial Sequence
  Description of Artificial Sequence: Synthetic oligonucleotide
caacagattaacagtttccctctcact

SEQ ID NO: 17590 - protein, 9 aa, Artificial Sequence
  Description of Artificial Sequence: Synthetic peptide
QQINSFPLT

SEQ ID NO: 17591 - DNA, 27 bp, Artificial Sequence
  Description of Artificial Sequence: Synthetic oligonucleotide
caacagacttacagtcccccgctcact

SEQ ID NO: 17592 - protein, 9 aa, Artificial Sequence
  Description of Artificial Sequence: Synthetic peptide
QQTYSPPLT

SEQ ID NO: 17593 - DNA, 27 bp, Artificial Sequence
  Description of Artificial Sequence: Synthetic oligonucleotide
ctacagcataatagttacccgctcact

SEQ ID NO: 17594 - protein, 9 aa, Artificial Sequence
  Description of Artificial Sequence: Synthetic peptide
LQHNSYPLT

SEQ ID NO: 17595 - DNA, 27 bp, Artificial Sequence
  Description of Artificial Sequence: Synthetic oligonucleotide
ctacagcattatagttaccctcggacg

SEQ ID NO: 17596 - protein, 9 aa, Artificial Sequence
  Description of Artificial Sequence: Synthetic peptide
LQHYSYPRT

SEQ ID NO: 17597 - DNA, 27 bp, Artificial Sequence
  Description of Artificial Sequence: Synthetic oligonucleotide
caacagagttacaatatttcgttcact

SEQ ID NO: 17598 - protein, 9 aa, Artificial Sequence
  Description of Artificial Sequence: Synthetic peptide
QQSYNISFT

SEQ ID NO: 17599 - DNA, 27 bp, Artificial Sequence
  Description of Artificial Sequence: Synthetic oligonucleotide
ctacaccattatagttaccctcggacg

SEQ ID NO: 17600 - protein, 9 aa, Artificial Sequence
  Description of Artificial Sequence: Synthetic peptide
LHHYSYPRT

SEQ ID NO: 17601 - DNA, 27 bp, Artificial Sequence
  Description of Artificial Sequence: Synthetic oligonucleotide
atgcaaagtatacaggttccgtggacg

SEQ ID NO: 17602 - protein, 9 aa, Artificial Sequence
  Description of Artificial Sequence: Synthetic peptide
MQSIQVPWT

SEQ ID NO: 17603 - DNA, 27 bp, Artificial Sequence
  Description of Artificial Sequence: Synthetic oligonucleotide
caacagattaacagtttccctctcact

SEQ ID NO: 17604 - protein, 9 aa, Artificial Sequence
  Description of Artificial Sequence: Synthetic peptide
QQINSFPLT

SEQ ID NO: 17605 - DNA, 27 bp, Artificial Sequence
  Description of Artificial Sequence: Synthetic oligonucleotide
ctacagcataatggttacccattcact

SEQ ID NO: 17606 - protein, 9 aa, Artificial Sequence
  Description of Artificial Sequence: Synthetic peptide
LQHNGYPFT

SEQ ID NO: 17607 - DNA, 27 bp, Artificial Sequence
  Description of Artificial Sequence: Synthetic oligonucleotide
caacagagtgataatctcccgtgcagt

SEQ ID NO: 17608 - protein, 9 aa, Artificial Sequence
  Description of Artificial Sequence: Synthetic peptide
QQSDNLPCS

SEQ ID NO: 17609 - DNA, 27 bp, Artificial Sequence
  Description of Artificial Sequence: Synthetic oligonucleotide
caacaggctaacagttttccattcact

SEQ ID NO: 17610 - protein, 9 aa, Artificial Sequence
  Description of Artificial Sequence: Synthetic peptide
QQANSFPFT

SEQ ID NO: 17611 - DNA, 27 bp, Artificial Sequence
  Description of Artificial Sequence: Synthetic oligonucleotide
caacggccttacaatgccccgctcact

SEQ ID NO: 17612 - protein, 9 aa, Artificial Sequence
  Description of Artificial Sequence: Synthetic peptide
QRPYNAPLT

SEQ ID NO: 17613 - DNA, 27 bp, Artificial Sequence
  Description of Artificial Sequence: Synthetic oligonucleotide
caacaggttaacagtttccctctcact

SEQ ID NO: 17614 - protein, 9 aa, Artificial Sequence
  Description of Artificial Sequence: Synthetic peptide
QQVNSFPLT

SEQ ID NO: 17615 - DNA, 27 bp, Artificial Sequence
  Description of Artificial Sequence: Synthetic oligonucleotide
ccactgtataaaagttatccactcact

SEQ ID NO: 17616 - protein, 9 aa, Artificial Sequence
  Description of Artificial Sequence: Synthetic peptide
PLYKSYPLT

SEQ ID NO: 17617 - DNA, 27 bp, Artificial Sequence
  Description of Artificial Sequence: Synthetic oligonucleotide
cagcagtataatgactggccgtgcagt

SEQ ID NO: 17618 - protein, 9 aa, Artificial Sequence
  Description of Artificial Sequence: Synthetic peptide
QQYNDWPCS

SEQ ID NO: 17619 - DNA, 27 bp, Artificial Sequence
  Description of Artificial Sequence: Synthetic oligonucleotide
caacagtataatagtttccctctcact

SEQ ID NO: 17620 - protein, 9 aa, Artificial Sequence
  Description of Artificial Sequence: Synthetic peptide
QQYNSFPLT

SEQ ID NO: 17621 - DNA, 27 bp, Artificial Sequence
  Description of Artificial Sequence: Synthetic oligonucleotide
caacagactaacagtttccctctcact

SEQ ID NO: 17622 - protein, 9 aa, Artificial Sequence
  Description of Artificial Sequence: Synthetic peptide
QQTNSFPLT

SEQ ID NO: 17623 - DNA, 27 bp, Artificial Sequence
  Description of Artificial Sequence: Synthetic oligonucleotide
caacagattaatagtttccctctcact

SEQ ID NO: 17624 - protein, 9 aa, Artificial Sequence
  Description of Artificial Sequence: Synthetic peptide
QQINSFPLT

SEQ ID NO: 17625 - DNA, 27 bp, Artificial Sequence
  Description of Artificial Sequence: Synthetic oligonucleotide
caacagcataataattccccgctcact

SEQ ID NO: 17626 - protein, 9 aa, Artificial Sequence
  Description of Artificial Sequence: Synthetic peptide
QQHNNSPLT

SEQ ID NO: 17627 - DNA, 27 bp, Artificial Sequence
  Description of Artificial Sequence: Synthetic oligonucleotide
caacagacttacagtgtccctttcact

SEQ ID NO: 17628 - protein, 9 aa, Artificial Sequence
  Description of Artificial Sequence: Synthetic peptide
QQTYSVPFT

SEQ ID NO: 17629 - DNA, 27 bp, Artificial Sequence
  Description of Artificial Sequence: Synthetic oligonucleotide
ctacagtataatagttacccattcact

SEQ ID NO: 17630 - protein, 9 aa, Artificial Sequence
  Description of Artificial Sequence: Synthetic peptide
LQYNSYPFT

SEQ ID NO: 17631 - DNA, 30 bp, Artificial Sequence; identical to SEQ ID NO: 17517
  Description of Artificial Sequence: Synthetic oligonucleotide

SEQ ID NO: 17632 - protein, 10 aa, Artificial Sequence
  Description of Artificial Sequence: Synthetic peptide
LQYNSYPPWT

SEQ ID NO: 17633 - DNA, 27 bp, Artificial Sequence
  Description of Artificial Sequence: Synthetic oligonucleotide
atagtgcataatagttaccctcggacg

SEQ ID NO: 17634 - protein, 9 aa, Artificial Sequence
  Description of Artificial Sequence: Synthetic peptide
IVHNSYPRT

SEQ ID NO: 17635 - DNA, 27 bp, Artificial Sequence
  Description of Artificial Sequence: Synthetic oligonucleotide
caacaggctaacagtttcccattcact

SEQ ID NO: 17636 - protein, 9 aa, Artificial Sequence
  Description of Artificial Sequence: Synthetic peptide
QQANSFPFT

SEQ ID NO: 17637 - DNA, 27 bp, Artificial Sequence
  Description of Artificial Sequence: Synthetic oligonucleotide
cagcagtataatgactggccgtgtagt

SEQ ID NO: 17638 - protein, 9 aa, Artificial Sequence
  Description of Artificial Sequence: Synthetic peptide
QQYNDWPCS

SEQ ID NO: 17639 - DNA, 27 bp, Artificial Sequence
  Description of Artificial Sequence: Synthetic oligonucleotide
caacagattaacagtttccctctcact

SEQ ID NO: 17640 - protein, 9 aa, Artificial Sequence
  Description of Artificial Sequence: Synthetic peptide
QQINSFPLT

SEQ ID NO: 17641 - DNA, 27 bp, Artificial Sequence
  Description of Artificial Sequence: Synthetic oligonucleotide
ctacaccataatagttatccattcaaa

SEQ ID NO: 17642 - protein, 9 aa, Artificial Sequence
  Description of Artificial Sequence: Synthetic peptide
LHHNSYPFK

SEQ ID NO: 17643 - DNA, 27 bp, Artificial Sequence
  Description of Artificial Sequence: Synthetic oligonucleotide
caacagtatgatagttacccattcact

SEQ ID NO: 17644 - protein, 9 aa, Artificial Sequence
  Description of Artificial Sequence: Synthetic peptide
QQYDSYPFT

SEQ ID NO: 17645 - DNA, 27 bp, Artificial Sequence
  Description of Artificial Sequence: Synthetic oligonucleotide
ctacagtataatagttacccattcact

SEQ ID NO: 17646 - protein, 9 aa, Artificial Sequence
  Description of Artificial Sequence: Synthetic peptide
LQYNSYPFT

SEQ ID NO: 17647 - DNA, 27 bp, Artificial Sequence
  Description of Artificial Sequence: Synthetic oligonucleotide
ctacagcataatagttatccgttcact

SEQ ID NO: 17648 - protein, 9 aa, Artificial Sequence
  Description of Artificial Sequence: Synthetic peptide
LQHNSYPFT

SEQ ID NO: 17649 - DNA, 27 bp, Artificial Sequence
  Description of Artificial Sequence: Synthetic oligonucleotide
ctacagcatagtacttacccgctcact

SEQ ID NO: 17650 - protein, 9 aa, Artificial Sequence
  Description of Artificial Sequence: Synthetic peptide
LQHSTYPLT

SEQ ID NO: 17651 - DNA, 27 bp, Artificial Sequence
  Description of Artificial Sequence: Synthetic oligonucleotide
caacagagttacagtaccccattcact

SEQ ID NO: 17652 - protein, 9 aa, Artificial Sequence
  Description of Artificial Sequence: Synthetic peptide
QQSYSTPFT

SEQ ID NO: 17653 - DNA, 27 bp, Artificial Sequence
  Description of Artificial Sequence: Synthetic oligonucleotide
caacaggctaacagtttcccattcact

SEQ ID NO: 17654 - protein, 9 aa, Artificial Sequence
  Description of Artificial Sequence: Synthetic peptide
QQANSFPFT

SEQ ID NO: 17655 - DNA, 27 bp, Artificial Sequence
  Description of Artificial Sequence: Synthetic oligonucleotide
cagcagtataatgactggccgtgtagt

SEQ ID NO: 17656 - protein, 9 aa, Artificial Sequence
  Description of Artificial Sequence: Synthetic peptide
QQYNDWPCS

SEQ ID NO: 17657 - DNA, 27 bp, Artificial Sequence
  Description of Artificial Sequence: Synthetic oligonucleotide
caacagactaacagtttccctctcact

SEQ ID NO: 17658 - protein, 9 aa, Artificial Sequence
  Description of Artificial Sequence: Synthetic peptide
QQTNSFPLT

SEQ ID NO: 17659 - DNA, 27 bp, Artificial Sequence
  Description of Artificial Sequence: Synthetic oligonucleotide
caacagagttacagtatcccgctcact

SEQ ID NO: 17660 - protein, 9 aa, Artificial Sequence
  Description of Artificial Sequence: Synthetic peptide
QQSYSIPLT

SEQ ID NO: 17661 - DNA, 27 bp, Artificial Sequence
  Description of Artificial Sequence: Synthetic oligonucleotide
cagcaatattataatattcctccgacg

SEQ ID NO: 17662 - protein, 9 aa, Artificial Sequence
  Description of Artificial Sequence: Synthetic peptide
QQYYNIPPT

SEQ ID NO: 17663 - DNA, 27 bp, Artificial Sequence
  Description of Artificial Sequence: Synthetic oligonucleotide
ctacagcataatcgttacccgctcact

SEQ ID NO: 17664 - protein, 9 aa, Artificial Sequence
  Description of Artificial Sequence: Synthetic peptide
LQHNRYPLT

SEQ ID NO: 17665 - DNA, 27 bp, Artificial Sequence
  Description of Artificial Sequence: Synthetic oligonucleotide
caacagactaacagtttccctctcact

SEQ ID NO: 17666 - protein, 9 aa, Artificial Sequence
  Description of Artificial Sequence: Synthetic peptide
QQTNSFPLT

SEQ ID NO: 17667 - DNA, 27 bp, Artificial Sequence
  Description of Artificial Sequence: Synthetic oligonucleotide
caacagattaacagtttccctctcact

SEQ ID NO: 17668 - protein, 9 aa, Artificial Sequence
  Description of Artificial Sequence: Synthetic peptide
QQINSFPLT

SEQ ID NO: 17669 - DNA, 27 bp, Artificial Sequence
  Description of Artificial Sequence: Synthetic oligonucleotide
ctacagcataatagttacccgctcact

SEQ ID NO: 17670 - protein, 9 aa, Artificial Sequence
  Description of Artificial Sequence: Synthetic peptide
LQHNSYPLT

SEQ ID NO: 17671 - DNA, 27 bp, Artificial Sequence
  Description of Artificial Sequence: Synthetic oligonucleotide
atacaccataatagttacccgtggacg

SEQ ID NO: 17672 - protein, 9 aa, Artificial Sequence
  Description of Artificial Sequence: Synthetic peptide
IHHNSYPWT

SEQ ID NO: 17673 - DNA, 27 bp, Artificial Sequence
  Description of Artificial Sequence: Synthetic oligonucleotide
caacaatattatattactccgtgcagt

SEQ ID NO: 17674 - protein, 9 aa, Artificial Sequence
  Description of Artificial Sequence: Synthetic peptide
QQYYITPCS

SEQ ID NO: 17675 - DNA, 27 bp, Artificial Sequence
  Description of Artificial Sequence: Synthetic oligonucleotide
ctacagcataatagttacccattcact

SEQ ID NO: 17676 - protein, 9 aa, Artificial Sequence
  Description of Artificial Sequence: Synthetic peptide
LQHNSYPFT

SEQ ID NO: 17677 - DNA, 27 bp, Artificial Sequence
  Description of Artificial Sequence: Synthetic oligonucleotide
ctacagtataatagttacccattcact

SEQ ID NO: 17678 - protein, 9 aa, Artificial Sequence
  Description of Artificial Sequence: Synthetic peptide
LQYNSYPFT

SEQ ID NO: 17679 - DNA, 27 bp, Artificial Sequence
  Description of Artificial Sequence: Synthetic oligonucleotide
caacagactaatagtttccctctcact

SEQ ID NO: 17680 - protein, 9 aa, Artificial Sequence
  Description of Artificial Sequence: Synthetic peptide
QQTNSFPLT

SEQ ID NO: 17681 - DNA, 27 bp, Artificial Sequence
  Description of Artificial Sequence: Synthetic oligonucleotide
ctacagcataatacttacccattcact

SEQ ID NO: 17682 - protein, 9 aa, Artificial Sequence
  Description of Artificial Sequence: Synthetic peptide
LQHNTYPFT

SEQ ID NO: 17683 - DNA, 24 bp, Artificial Sequence
  Description of Artificial Sequence: Synthetic oligonucleotide
caacagacttacagtacccccacc

SEQ ID NO: 17684 - protein, 8 aa, Artificial Sequence
  Description of Artificial Sequence: Synthetic peptide
QQTYSTPT

SEQ ID NO: 17685 - DNA, 27 bp, Artificial Sequence
  Description of Artificial Sequence: Synthetic oligonucleotide
caacagaattacaatgccccgctcact

SEQ ID NO: 17686 - protein, 9 aa, Artificial Sequence
  Description of Artificial Sequence: Synthetic peptide
QQNYNAPLT

SEQ ID NO: 17687 - DNA, 27 bp, Artificial Sequence
  Description of Artificial Sequence: Synthetic oligonucleotide
caacaggttaacagtttccctctcact

SEQ ID NO: 17688 - protein, 9 aa, Artificial Sequence
  Description of Artificial Sequence: Synthetic peptide
QQVNSFPLT

SEQ ID NO: 17689 - DNA, 27 bp, Artificial Sequence
  Description of Artificial Sequence: Synthetic oligonucleotide
caacaggttaacagtttccctctcact

SEQ ID NO: 17690 - protein, 9 aa, Artificial Sequence
  Description of Artificial Sequence: Synthetic peptide
QQVNSFPLT

SEQ ID NO: 17691 - DNA, 27 bp, Artificial Sequence
  Description of Artificial Sequence: Synthetic oligonucleotide
ctacagcataatagttacccattcact

SEQ ID NO: 17692 - protein, 9 aa, Artificial Sequence
  Description of Artificial Sequence: Synthetic peptide
LQHNSYPFT

SEQ ID NO: 17693 - DNA, 30 bp, Artificial Sequence
  Description of Artificial Sequence: Synthetic oligonucleotide
atacagcataatagttaccctccgatcacc

SEQ ID NO: 17694 - protein, 10 aa, Artificial Sequence
  Description of Artificial Sequence: Synthetic peptide
IQHNSYPPIT

SEQ ID NO: 17695 - DNA, 27 bp, Artificial Sequence
  Description of Artificial Sequence: Synthetic oligonucleotide
ctacagcattatagttaccctcggacg

SEQ ID NO: 17696 - protein, 9 aa, Artificial Sequence
  Description of Artificial Sequence: Synthetic peptide
LQHYSYPRT

SEQ ID NO: 17697 - DNA, 27 bp, Artificial Sequence
  Description of Artificial Sequence: Synthetic oligonucleotide
cagcagtatgaacgctcaccgtggacg

SEQ ID NO: 17698 - protein, 9 aa, Artificial Sequence
  Description of Artificial Sequence: Synthetic peptide
QQYERSPWT

SEQ ID NO: 17699 - DNA, 27 bp, Artificial Sequence
  Description of Artificial Sequence: Synthetic oligonucleotide
cagcagtatgaaagttcaccgtggacg

SEQ ID NO: 17700 - protein, 9 aa, Artificial Sequence
  Description of Artificial Sequence: Synthetic peptide
QQYESSPWT

SEQ ID NO: 17701 - DNA, 27 bp, Artificial Sequence
  Description of Artificial Sequence: Synthetic oligonucleotide
cagcaatattatagtagtcctccgacg

SEQ ID NO: 17702 - protein, 9 aa, Artificial Sequence
  Description of Artificial Sequence: Synthetic peptide
QQYYSSPPT

SEQ ID NO: 17703 - DNA, 27 bp, Artificial Sequence
  Description of Artificial Sequence: Synthetic oligonucleotide
cagcaatattttagtactccgtggacg

SEQ ID NO: 17704 - protein, 9 aa, Artificial Sequence
  Description of Artificial Sequence: Synthetic peptide
QQYFSTPWT

SEQ ID NO: 17705 - DNA, 27 bp, Artificial Sequence
  Description of Artificial Sequence: Synthetic oligonucleotide
cagcagtatggttgctcaccgctcact

SEQ ID NO: 17706 - protein, 9 aa, Artificial Sequence
  Description of Artificial Sequence: Synthetic peptide
QQYGCSPLT

SEQ ID NO: 17707 - DNA, 27 bp, Artificial Sequence
  Description of Artificial Sequence: Synthetic oligonucleotide
cagcaatattatagtattcctccgacg

SEQ ID NO: 17708 - protein, 9 aa, Artificial Sequence
  Description of Artificial Sequence: Synthetic peptide
QQYYSIPPT

SEQ ID NO: 17709 - DNA, 27 bp, Artificial Sequence
  Description of Artificial Sequence: Synthetic oligonucleotide
cagcaatattatagtactccgtgcagt

SEQ ID NO: 17710 - protein, 9 aa, Artificial Sequence
  Description of Artificial Sequence: Synthetic peptide
QQYYSTPCS

SEQ ID NO: 17711 - DNA, 27 bp, Artificial Sequence
  Description of Artificial Sequence: Synthetic oligonucleotide
cagcaatataatgactggccgtgcagt

SEQ ID NO: 17712 - protein, 9 aa, Artificial Sequence
  Description of Artificial Sequence: Synthetic peptide
QQYNDWPCS

SEQ ID NO: 17713 - DNA, 27 bp, Artificial Sequence
  Description of Artificial Sequence: Synthetic oligonucleotide
cagcaatattatagttctcctccgacg

SEQ ID NO: 17714 - protein, 9 aa, Artificial Sequence
  Description of Artificial Sequence: Synthetic peptide
QQYYSSPPT

SEQ ID NO: 17715 - DNA, 27 bp, Artificial Sequence
  Description of Artificial Sequence: Synthetic oligonucleotide
ctacagcatagtaattacccgctcact

SEQ ID NO: 17716 - protein, 9 aa, Artificial Sequence
  Description of Artificial Sequence: Synthetic peptide
LQHSNYPLT

SEQ ID NO: 17717 - DNA, 27 bp, Artificial Sequence
  Description of Artificial Sequence: Synthetic oligonucleotide
cagcaatatcatagttctcctctgacg

SEQ ID NO: 17718 - protein, 9 aa, Artificial Sequence
  Description of Artificial Sequence: Synthetic peptide
QQYHSSPLT

SEQ ID NO: 17719 - DNA, 27 bp, Artificial Sequence
  Description of Artificial Sequence: Synthetic oligonucleotide
cagcagtatgaaagctcaccgtggacc

SEQ ID NO: 17720 - protein, 9 aa, Artificial Sequence
  Description of Artificial Sequence: Synthetic peptide
QQYESSPWT

SEQ ID NO: 17721 - DNA, 27 bp, Artificial Sequence
  Description of Artificial Sequence: Synthetic oligonucleotide
cagcactctgataactcaccgtggacg

SEQ ID NO: 17722 - protein, 9 aa, Artificial Sequence
  Description of Artificial Sequence: Synthetic peptide
QHSDNSPWT

SEQ ID NO: 17723 - DNA, 27 bp, Artificial Sequence
  Description of Artificial Sequence: Synthetic oligonucleotide
cagcactctgataactcaccgtggacg

SEQ ID NO: 17724 - protein, 9 aa, Artificial Sequence
  Description of Artificial Sequence: Synthetic peptide
QHSDNSPWT

SEQ ID NO: 17725 - DNA, 27 bp, Artificial Sequence
  Description of Artificial Sequence: Synthetic oligonucleotide
cttcagcatagtaattacccgctcact

SEQ ID NO: 17726 - protein, 9 aa, Artificial Sequence
  Description of Artificial Sequence: Synthetic peptide
LQHSNYPLT

SEQ ID NO: 17727 - DNA, 27 bp, Artificial Sequence
  Description of Artificial Sequence: Synthetic oligonucleotide
cagcagtatgaaagctcaccgtggacg

SEQ ID NO: 17728 - protein, 9 aa, Artificial Sequence
  Description of Artificial Sequence: Synthetic peptide
QQYESSPWT

SEQ ID NO: 17729 - DNA, 27 bp, Artificial Sequence
  Description of Artificial Sequence: Synthetic oligonucleotide
cagcaatattatagtagtcctccgacg

SEQ ID NO: 17730 - protein, 9 aa, Artificial Sequence
  Description of Artificial Sequence: Synthetic peptide
QQYYSSPPT

SEQ ID NO: 17731 - DNA, 27 bp, Artificial Sequence
  Description of Artificial Sequence: Synthetic oligonucleotide
cagcaatattatagcactcctcctact

SEQ ID NO: 17732 - protein, 9 aa, Artificial Sequence
  Description of Artificial Sequence: Synthetic peptide
QQYYSTPPT

SEQ ID NO: 17733 - DNA, 27 bp, Artificial Sequence
  Description of Artificial Sequence: Synthetic oligonucleotide
cagcagtatggtaactcaccgctcact

SEQ ID NO: 17734 - protein, 9 aa, Artificial Sequence
  Description of Artificial Sequence: Synthetic peptide
QQYGNSPLT

SEQ ID NO: 17735 - DNA, 27 bp, Artificial Sequence
  Description of Artificial Sequence: Synthetic oligonucleotide
cagcagtatggttgctcaccgctcact

SEQ ID NO: 17736 - protein, 9 aa, Artificial Sequence
  Description of Artificial Sequence: Synthetic peptide
QQYGCSPLT

SEQ ID NO: 17737 - DNA, 27 bp, Artificial Sequence
  Description of Artificial Sequence: Synthetic oligonucleotide
cagcagtatgaaagttcaccgtggacg

SEQ ID NO: 17738 - protein, 9 aa, Artificial Sequence
  Description of Artificial Sequence: Synthetic peptide
QQYESSPWT

SEQ ID NO: 17739 - DNA, 27 bp, Artificial Sequence
  Description of Artificial Sequence: Synthetic oligonucleotide
cagcagtatgaacgctcaccgtggacg

SEQ ID NO: 17740 - protein, 9 aa, Artificial Sequence
  Description of Artificial Sequence: Synthetic peptide
QQYERSPWT

SEQ ID NO: 17741 - DNA, 27 bp, Artificial Sequence
  Description of Artificial Sequence: Synthetic oligonucleotide
cagcattatgatagctcaccgtggacg

SEQ ID NO: 17742 - protein, 9 aa, Artificial Sequence
  Description of Artificial Sequence: Synthetic peptide
QHYDSSPWT

SEQ ID NO: 17743 - DNA, 27 bp, Artificial Sequence
  Description of Artificial Sequence: Synthetic oligonucleotide
cagcaatattttagtagtcctctgacg

SEQ ID NO: 17744 - protein, 9 aa, Artificial Sequence
  Description of Artificial Sequence: Synthetic peptide
QQYFSSPLT

SEQ ID NO: 17745 - DNA, 27 bp, Artificial Sequence
  Description of Artificial Sequence: Synthetic oligonucleotide
cagcagtatggttgctcaccgctcact

SEQ ID NO: 17746 - protein, 9 aa, Artificial Sequence
  Description of Artificial Sequence: Synthetic peptide
QQYGCSPLT

SEQ ID NO: 17747 - DNA, 24 bp, Artificial Sequence
  Description of Artificial Sequence: Synthetic oligonucleotide
cagcagtatggtaggtcacggacg

SEQ ID NO: 17748 - protein, 8 aa, Artificial Sequence
  Description of Artificial Sequence: Synthetic peptide
QQYGRSRT

SEQ ID NO: 17749 - DNA, 27 bp, Artificial Sequence
  Description of Artificial Sequence: Synthetic oligonucleotide
cagcagtatgaaagctcaccgtggacc

SEQ ID NO: 17750 - protein, 9 aa, Artificial Sequence
  Description of Artificial Sequence: Synthetic peptide
QQYESSPWT

SEQ ID NO: 17751 - DNA, 27 bp, Artificial Sequence
  Description of Artificial Sequence: Synthetic oligonucleotide
caacagtacagtaattacccgctcact

SEQ ID NO: 17752 - protein, 9 aa, Artificial Sequence
  Description of Artificial Sequence: Synthetic peptide
QQYSNYPLT

SEQ ID NO: 17753 - DNA, 27 bp, Artificial Sequence
  Description of Artificial Sequence: Synthetic oligonucleotide
cagcagtataatgactggccgtgcagt

SEQ ID NO: 17754 - protein, 9 aa, Artificial Sequence
  Description of Artificial Sequence: Synthetic peptide
QQYNDWPCS

SEQ ID NO: 17755 - DNA, 27 bp, Artificial Sequence
  Description of Artificial Sequence: Synthetic oligonucleotide
atgcaacctctacaaactccgttcact

SEQ ID NO: 17756 - protein, 9 aa, Artificial Sequence
  Description of Artificial Sequence: Synthetic peptide
MQPLQTPFT

SEQ ID NO: 17757 - DNA, 27 bp, Artificial Sequence
  Description of Artificial Sequence: Synthetic oligonucleotide
cagcagtatgaaagctcgccgtggacg

SEQ ID NO: 17758 - protein, 9 aa, Artificial Sequence
  Description of Artificial Sequence: Synthetic peptide
QQYESSPWT

SEQ ID NO: 17759 - DNA, 27 bp, Artificial Sequence
  Description of Artificial Sequence: Synthetic oligonucleotide
cagcaatattatagtactcctccgacg

SEQ ID NO: 17760 - protein, 9 aa, Artificial Sequence
  Description of Artificial Sequence: Synthetic peptide
QQYYSTPPT

SEQ ID NO: 17761 - DNA, 27 bp, Artificial Sequence
  Description of Artificial Sequence: Synthetic oligonucleotide
cagcaatattatattactcctccgacg

SEQ ID NO: 17762 - protein, 9 aa, Artificial Sequence
  Description of Artificial Sequence: Synthetic peptide
QQYYITPPT

SEQ ID NO: 17763 - DNA, 27 bp, Artificial Sequence
  Description of Artificial Sequence: Synthetic oligonucleotide
cagcactatgataactcaccgtggacg

SEQ ID NO: 17764 - protein, 9 aa, Artificial Sequence
  Description of Artificial Sequence: Synthetic peptide
QHYDNSPWT

SEQ ID NO: 17765 - DNA, 27 bp, Artificial Sequence
  Description of Artificial Sequence: Synthetic oligonucleotide
cagcactatgataactcaccgtggacg

SEQ ID NO: 17766 - protein, 9 aa, Artificial Sequence
  Description of Artificial Sequence: Synthetic peptide
QHYDNSPWT

SEQ ID NO: 17767 - DNA, 27 bp, Artificial Sequence
  Description of Artificial Sequence: Synthetic oligonucleotide
atgcaagctctacaccctcctctcact

SEQ ID NO: 17768 - protein, 9 aa, Artificial Sequence
  Description of Artificial Sequence: Synthetic peptide
MQALHPPLT

SEQ ID NO: 17769 - DNA, 27 bp, Artificial Sequence
  Description of Artificial Sequence: Synthetic oligonucleotide
cagcagtatgaagactcaccgtggacg

SEQ ID NO: 17770 - protein, 9 aa, Artificial Sequence
  Description of Artificial Sequence: Synthetic peptide
QQYEDSPWT

SEQ ID NO: 17771 - DNA, 27 bp, Artificial Sequence
  Description of Artificial Sequence: Synthetic oligonucleotide
cagcagtataatgactggccgtgcagt

SEQ ID NO: 17772 - protein, 9 aa, Artificial Sequence
  Description of Artificial Sequence: Synthetic peptide
QQYNDWPCS

SEQ ID NO: 17773 - DNA, 27 bp, Artificial Sequence
  Description of Artificial Sequence: Synthetic oligonucleotide
cagcagtatgaaagctcaccgtggacg

SEQ ID NO: 17774 - protein, 9 aa, Artificial Sequence
  Description of Artificial Sequence: Synthetic peptide
QQYESSPWT

SEQ ID NO: 17775 - DNA, 27 bp, Artificial Sequence
  Description of Artificial Sequence: Synthetic oligonucleotide
caacagtacagtaattacccgctcact

SEQ ID NO: 17776 - protein, 9 aa, Artificial Sequence
  Description of Artificial Sequence: Synthetic peptide
QQYSNYPLT

SEQ ID NO: 17777 - DNA, 27 bp, Artificial Sequence
  Description of Artificial Sequence: Synthetic oligonucleotide
cagcaatattttagtagtcctccgacg

SEQ ID NO: 17778 - protein, 9 aa, Artificial Sequence
  Description of Artificial Sequence: Synthetic peptide
QQYFSSPPT

SEQ ID NO: 17779 - DNA, 27 bp, Artificial Sequence
  Description of Artificial Sequence: Synthetic oligonucleotide
cagcactatgataactcaccgtggacg

SEQ ID NO: 17780 - protein, 9 aa, Artificial Sequence
  Description of Artificial Sequence: Synthetic peptide
QHYDNSPWT

SEQ ID NO: 17781 - DNA, 27 bp, Artificial Sequence
  Description of Artificial Sequence: Synthetic oligonucleotide
cagcactatgataactcaccgtggacg

SEQ ID NO: 17782 - protein, 9 aa, Artificial Sequence
  Description of Artificial Sequence: Synthetic peptide
QHYDNSPWT

SEQ ID NO: 17783 - DNA, 27 bp, Artificial Sequence
  Description of Artificial Sequence: Synthetic oligonucleotide
cagcagtatggtaactcaccgctcact

SEQ ID NO: 17784 - protein, 9 aa, Artificial Sequence
  Description of Artificial Sequence: Synthetic peptide
QQYGNSPLT

SEQ ID NO: 17785 - DNA, 27 bp, Artificial Sequence
  Description of Artificial Sequence: Synthetic oligonucleotide
cagcattatgatagctcaccgtggacg

SEQ ID NO: 17786 - protein, 9 aa, Artificial Sequence
  Description of Artificial Sequence: Synthetic peptide
QHYDSSPWT

SEQ ID NO: 17787 - DNA, 27 bp, Artificial Sequence
  Description of Artificial Sequence: Synthetic oligonucleotide
cagcagtatggttgctcaccgctcact

SEQ ID NO: 17788 - protein, 9 aa, Artificial Sequence
  Description of Artificial Sequence: Synthetic peptide
QQYGCSPLT

SEQ ID NO: 17789 - DNA, 27 bp, Artificial Sequence
  Description of Artificial Sequence: Synthetic oligonucleotide
cagcattatgatagctcaccgtggacg

SEQ ID NO: 17790 - protein, 9 aa, Artificial Sequence
  Description of Artificial Sequence: Synthetic peptide
QHYDSSPWT

SEQ ID NO: 17791 - DNA, 27 bp, Artificial Sequence
  Description of Artificial Sequence: Synthetic oligonucleotide
cagcactattataatactccgtggaag

SEQ ID NO: 17792 - protein, 9 aa, Artificial Sequence
  Description of Artificial Sequence: Synthetic peptide
QHYYNTPWK

SEQ ID NO: 17793 - DNA, 27 bp, Artificial Sequence
  Description of Artificial Sequence: Synthetic oligonucleotide
cagcagtatggttgctcaccgctcact

SEQ ID NO: 17794 - protein, 9 aa, Artificial Sequence
  Description of Artificial Sequence: Synthetic peptide
QQYGCSPLT

SEQ ID NO: 17795 - DNA, 27 bp, Artificial Sequence
  Description of Artificial Sequence: Synthetic oligonucleotide
cagcagtatgaaagctcaccgtggacg

SEQ ID NO: 17796 - protein, 9 aa, Artificial Sequence
  Description of Artificial Sequence: Synthetic peptide
QQYESSPWT

SEQ ID NO: 17797 - DNA, 27 bp, Artificial Sequence
  Description of Artificial Sequence: Synthetic oligonucleotide
cagcaatattatactactccgtgcagt

SEQ ID NO: 17798 - protein, 9 aa, Artificial Sequence
  Description of Artificial Sequence: Synthetic peptide
QQYYTTPCS

SEQ ID NO: 17799 - DNA, 27 bp, Artificial Sequence
  Description of Artificial Sequence: Synthetic oligonucleotide
caacagtacagtaattacccgctcact

SEQ ID NO: 17800 - protein, 9 aa, Artificial Sequence
  Description of Artificial Sequence: Synthetic peptide
QQYSNYPLT

SEQ ID NO: 17801 - DNA, 27 bp, Artificial Sequence
  Description of Artificial Sequence: Synthetic oligonucleotide
cagcaatattataggactccgtggacg

SEQ ID NO: 17802 - protein, 9 aa, Artificial Sequence
  Description of Artificial Sequence: Synthetic peptide
QQYYRTPWT

SEQ ID NO: 17803 - DNA, 27 bp, Artificial Sequence
  Description of Artificial Sequence: Synthetic oligonucleotide
cagcactattataatactccgtggaag

SEQ ID NO: 17804 - protein, 9 aa, Artificial Sequence
  Description of Artificial Sequence: Synthetic peptide
QHYYNTPWK

SEQ ID NO: 17805 - DNA, 30 bp, Artificial Sequence
  Description of Artificial Sequence: Synthetic oligonucleotide
cagcagtataataactggcctccgctcact

SEQ ID NO: 17806 - protein, 10 aa, Artificial Sequence
  Description of Artificial Sequence: Synthetic peptide
QQYNNWPPLT

SEQ ID NO: 17807 - DNA, 27 bp, Artificial Sequence
  Description of Artificial Sequence: Synthetic oligonucleotide
cagcagtataatgactggccgtgcagt

SEQ ID NO: 17808 - protein, 9 aa, Artificial Sequence
  Description of Artificial Sequence: Synthetic peptide
QQYNDWPCS

SEQ ID NO: 17809 - DNA, 24 bp, Artificial Sequence
  Description of Artificial Sequence: Synthetic oligonucleotide
caacagtatggtaactcaaggacg

SEQ ID NO: 17810 - protein, 8 aa, Artificial Sequence
  Description of Artificial Sequence: Synthetic peptide
QQYGNSRT

SEQ ID NO: 17811 - DNA, 27 bp, Artificial Sequence
  Description of Artificial Sequence: Synthetic oligonucleotide
cagcaatattatagtactccgtgcagt

SEQ ID NO: 17812 - protein, 9 aa, Artificial Sequence
  Description of Artificial Sequence: Synthetic peptide
QQYYSTPCS

SEQ ID NO: 17813 - DNA, 27 bp, Artificial Sequence
  Description of Artificial Sequence: Synthetic oligonucleotide
cagcagtatgaacgctcaccgtggacg

SEQ ID NO: 17814 - protein, 9 aa, Artificial Sequence
  Description of Artificial Sequence: Synthetic peptide
QQYERSPWT

SEQ ID NO: 17815 - DNA, 27 bp, Artificial Sequence
  Description of Artificial Sequence: Synthetic oligonucleotide
cagcaatattttagtagtcctccgacg

SEQ ID NO: 17816 - protein, 9 aa, Artificial Sequence
  Description of Artificial Sequence: Synthetic peptide
QQYFSSPPT

SEQ ID NO: 17817 - DNA, 27 bp, Artificial Sequence
  Description of Artificial Sequence: Synthetic oligonucleotide
cagcaatattatagtagtcctccgacg

SEQ ID NO: 17818 - protein, 9 aa, Artificial Sequence
  Description of Artificial Sequence: Synthetic peptide
QQYYSSPPT

SEQ ID NO: 17819 - DNA, 27 bp, Artificial Sequence
  Description of Artificial Sequence: Synthetic oligonucleotide
cagcaatattatagttctcctccgacg

SEQ ID NO: 17820 - protein, 9 aa, Artificial Sequence
  Description of Artificial Sequence: Synthetic peptide
QQYYSSPPT

SEQ ID NO: 17821 - DNA, 27 bp, Artificial Sequence
  Description of Artificial Sequence: Synthetic oligonucleotide
cagcaatattttagtagtcctccgacg

SEQ ID NO: 17822 - protein, 9 aa, Artificial Sequence
  Description of Artificial Sequence: Synthetic peptide
QQYFSSPPT

SEQ ID NO: 17823 - DNA, 27 bp, Artificial Sequence
  Description of Artificial Sequence: Synthetic oligonucleotide
cagcactatgataactcaccgtggacg

SEQ ID NO: 17824 - protein, 9 aa, Artificial Sequence
  Description of Artificial Sequence: Synthetic peptide
QHYDNSPWT

SEQ ID NO: 17825 - DNA, 27 bp, Artificial Sequence
  Description of Artificial Sequence: Synthetic oligonucleotide
cagcactatgataactcaccgtggacg

SEQ ID NO: 17826 - protein, 9 aa, Artificial Sequence
  Description of Artificial Sequence: Synthetic peptide
QHYDNSPWT

SEQ ID NO: 17827 - DNA, 27 bp, Artificial Sequence
  Description of Artificial Sequence: Synthetic oligonucleotide
cagcaatattatagtattcctccgacg

SEQ ID NO: 17828 - protein, 9 aa, Artificial Sequence
  Description of Artificial Sequence: Synthetic peptide
QQYYSIPPT

SEQ ID NO: 17829 - DNA, 27 bp, Artificial Sequence
  Description of Artificial Sequence: Synthetic oligonucleotide
caacagtacagtaattacccactcact

SEQ ID NO: 17830 - protein, 9 aa, Artificial Sequence
  Description of Artificial Sequence: Synthetic peptide
QQYSNYPLT

SEQ ID NO: 17831 - DNA, 24 bp, Artificial Sequence
  Description of Artificial Sequence: Synthetic oligonucleotide
cagcagtatggtagctcacggacg

SEQ ID NO: 17832 - protein, 8 aa, Artificial Sequence
  Description of Artificial Sequence: Synthetic peptide
QQYGSSRT

SEQ ID NO: 17833 - DNA, 27 bp, Artificial Sequence
  Description of Artificial Sequence: Synthetic oligonucleotide
cagcagtataatgactggccgtgcagt

SEQ ID NO: 17834 - protein, 9 aa, Artificial Sequence
  Description of Artificial Sequence: Synthetic peptide
QQYNDWPCS

SEQ ID NO: 17835 - DNA, 27 bp, Artificial Sequence
  Description of Artificial Sequence: Synthetic oligonucleotide
cagcaatattatagtattcctccgacg

SEQ ID NO: 17836 - protein, 9 aa, Artificial Sequence
  Description of Artificial Sequence: Synthetic peptide
QQYYSIPPT

SEQ ID NO: 17837 - DNA, 27 bp, Artificial Sequence
  Description of Artificial Sequence: Synthetic oligonucleotide
cagcaatattatagtactccgtgcagt

SEQ ID NO: 17838 - protein, 9 aa, Artificial Sequence
  Description of Artificial Sequence: Synthetic peptide
QQYYSTPCS

SEQ ID NO: 17839 - DNA, 27 bp, Artificial Sequence
  Description of Artificial Sequence: Synthetic oligonucleotide
cagcaatattatattactcctccgacg

SEQ ID NO: 17840 - protein, 9 aa, Artificial Sequence
  Description of Artificial Sequence: Synthetic peptide
QQYYITPPT

SEQ ID NO: 17841 - DNA, 27 bp, Artificial Sequence
  Description of Artificial Sequence: Synthetic oligonucleotide
cagcactatgataactcaccgtggacg

SEQ ID NO: 17842 - protein, 9 aa, Artificial Sequence
  Description of Artificial Sequence: Synthetic peptide
QHYDNSPWT

SEQ ID NO: 17843 - DNA, 27 bp, Artificial Sequence
  Description of Artificial Sequence: Synthetic oligonucleotide
cagcaatatcatagttctcctctgacg

SEQ ID NO: 17844 - protein, 9 aa, Artificial Sequence
  Description of Artificial Sequence: Synthetic peptide
QQYHSSPLT

SEQ ID NO: 17845 - DNA, 27 bp, Artificial Sequence
  Description of Artificial Sequence: Synthetic oligonucleotide
cagcagtatgaaagctcaccgtggacg

SEQ ID NO: 17846 - protein, 9 aa, Artificial Sequence
  Description of Artificial Sequence: Synthetic peptide
QQYESSPWT

SEQ ID NO: 17847 - DNA, 27 bp, Artificial Sequence
  Description of Artificial Sequence: Synthetic oligonucleotide
cagcactctgataactcaccgtggacg

SEQ ID NO: 17848 - protein, 9 aa, Artificial Sequence
  Description of Artificial Sequence: Synthetic peptide
QHSDNSPWT

SEQ ID NO: 17849 - DNA, 27 bp, Artificial Sequence
  Description of Artificial Sequence: Synthetic oligonucleotide
cagcaatattatagtactccgtggacg

SEQ ID NO: 17850 - protein, 9 aa, Artificial Sequence
  Description of Artificial Sequence: Synthetic peptide
QQYYSTPWT

SEQ ID NO: 17851 - DNA, 27 bp, Artificial Sequence
  Description of Artificial Sequence: Synthetic oligonucleotide
cagcactctgataactcaccgtggacg

SEQ ID NO: 17852 - protein, 9 aa, Artificial Sequence
  Description of Artificial Sequence: Synthetic peptide
QHSDNSPWT

SEQ ID NO: 17853 - DNA, 27 bp, Artificial Sequence
  Description of Artificial Sequence: Synthetic oligonucleotide
cagcactctgataactcaccgtggacg

SEQ ID NO: 17854 - protein, 9 aa, Artificial Sequence
  Description of Artificial Sequence: Synthetic peptide
QHSDNSPWT

SEQ ID NO: 17855 - DNA, 27 bp, Artificial Sequence
  Description of Artificial Sequence: Synthetic oligonucleotide
cagcactctgataactcaccgtggacg

SEQ ID NO: 17856 - protein, 9 aa, Artificial Sequence
  Description of Artificial Sequence: Synthetic peptide
QHSDNSPWT

SEQ ID NO: 17857 - DNA, 27 bp, Artificial Sequence
  Description of Artificial Sequence: Synthetic oligonucleotide
cagcagtatggttgctcaccgctcact

SEQ ID NO: 17858 - protein, 9 aa, Artificial Sequence
  Description of Artificial Sequence: Synthetic peptide
QQYGCSPLT

SEQ ID NO: 17859 - DNA, 27 bp, Artificial Sequence
  Description of Artificial Sequence: Synthetic oligonucleotide
cagcactacaatgaaactccagggaag

SEQ ID NO: 17860 - protein, 9 aa, Artificial Sequence
  Description of Artificial Sequence: Synthetic peptide
QHYNETPGK

SEQ ID NO: 17861 - DNA, 27 bp, Artificial Sequence
  Description of Artificial Sequence: Synthetic oligonucleotide
cagcattctgataactcaccgtggacg

SEQ ID NO: 17862 - protein, 9 aa, Artificial Sequence
  Description of Artificial Sequence: Synthetic peptide
QHSDNSPWT

SEQ ID NO: 17863 - DNA, 27 bp, Artificial Sequence
  Description of Artificial Sequence: Synthetic oligonucleotide
cagcaatattatagtactcctccgacg

SEQ ID NO: 17864 - protein, 9 aa, Artificial Sequence
  Description of Artificial Sequence: Synthetic peptide
QQYYSTPPT

SEQ ID NO: 17865 - DNA, 27 bp, Artificial Sequence
  Description of Artificial Sequence: Synthetic oligonucleotide
cagcagtatgaaagctcaccgtggacc

SEQ ID NO: 17866 - protein, 9 aa, Artificial Sequence
  Description of Artificial Sequence: Synthetic peptide
QQYESSPWT

SEQ ID NO: 17867 - DNA, 27 bp, Artificial Sequence
  Description of Artificial Sequence: Synthetic oligonucleotide
cagcagtatgaaagctcaccgtggacg

SEQ ID NO: 17868 - protein, 9 aa, Artificial Sequence
  Description of Artificial Sequence: Synthetic peptide
QQYESSPWT

SEQ ID NO: 17869 - DNA, 27 bp, Artificial Sequence
  Description of Artificial Sequence: Synthetic oligonucleotide
cagcagtatgagagctcaccgtggacg

SEQ ID NO: 17870 - protein, 9 aa, Artificial Sequence
  Description of Artificial Sequence: Synthetic peptide
QQYESSPWT

SEQ ID NO: 17871 - DNA, 27 bp, Artificial Sequence
  Description of Artificial Sequence: Synthetic oligonucleotide
cagcaatattatagttctcctcctact

SEQ ID NO: 17872 - protein, 9 aa, Artificial Sequence
  Description of Artificial Sequence: Synthetic peptide
QQYYSSPPT

SEQ ID NO: 17873 - DNA, 27 bp, Artificial Sequence
  Description of Artificial Sequence: Synthetic oligonucleotide
cagcaatattataatactccgtggacg

SEQ ID NO: 17874 - protein, 9 aa, Artificial Sequence
  Description of Artificial Sequence: Synthetic peptide
QQYYNTPWT

SEQ ID NO: 17875 - DNA, 27 bp, Artificial Sequence
  Description of Artificial Sequence: Synthetic oligonucleotide
cagcagtatgaaagctcaccgtggacg

SEQ ID NO: 17876 - protein, 9 aa, Artificial Sequence
  Description of Artificial Sequence: Synthetic peptide
QQYESSPWT

SEQ ID NO: 17877 - DNA, 27 bp, Artificial Sequence
  Description of Artificial Sequence: Synthetic oligonucleotide
caacagtacagtaattacccgctcact

SEQ ID NO: 17878 - protein, 9 aa, Artificial Sequence
  Description of Artificial Sequence: Synthetic peptide
QQYSNYPLT

SEQ ID NO: 17879 - DNA, 27 bp, Artificial Sequence
  Description of Artificial Sequence: Synthetic oligonucleotide
caacagtacagtaattacccgctcact

SEQ ID NO: 17880 - protein, 9 aa, Artificial Sequence
  Description of Artificial Sequence: Synthetic peptide
QQYSNYPLT

SEQ ID NO: 17881 - DNA, 27 bp, Artificial Sequence
  Description of Artificial Sequence: Synthetic oligonucleotide
cagcactctgataactcaccgtggacg

SEQ ID NO: 17882 - protein, 9 aa, Artificial Sequence
  Description of Artificial Sequence: Synthetic peptide
QHSDNSPWT

SEQ ID NO: 17883 - DNA, 27 bp, Artificial Sequence
  Description of Artificial Sequence: Synthetic oligonucleotide
cagcagtatggtaactcaccgctcact

SEQ ID NO: 17884 - protein, 9 aa, Artificial Sequence
  Description of Artificial Sequence: Synthetic peptide
QQYGNSPLT

SEQ ID NO: 17885 - DNA, 27 bp, Artificial Sequence
  Description of Artificial Sequence: Synthetic oligonucleotide
cagcactctgataactcaccgtggacg

SEQ ID NO: 17886 - protein, 9 aa, Artificial Sequence
  Description of Artificial Sequence: Synthetic peptide
QHSDNSPWT

SEQ ID NO: 17887 - DNA, 27 bp, Artificial Sequence
  Description of Artificial Sequence: Synthetic oligonucleotide
cagcattctgataactcaccgtggacg

SEQ ID NO: 17888 - protein, 9 aa, Artificial Sequence
  Description of Artificial Sequence: Synthetic peptide
QHSDNSPWT

SEQ ID NO: 17889 - DNA, 27 bp, Artificial Sequence
  Description of Artificial Sequence: Synthetic oligonucleotide
cagcaatattatagttctcctctgacg

SEQ ID NO: 17890 - protein, 9 aa, Artificial Sequence
  Description of Artificial Sequence: Synthetic peptide
QQYYSSPLT

SEQ ID NO: 17891 - DNA, 27 bp, Artificial Sequence
  Description of Artificial Sequence: Synthetic oligonucleotide
cagcactacaatgatactccagggaag

SEQ ID NO: 17892 - protein, 9 aa, Artificial Sequence
  Description of Artificial Sequence: Synthetic peptide
QHYNDTPGK

SEQ ID NO: 17893 - DNA, 27 bp, Artificial Sequence
  Description of Artificial Sequence: Synthetic oligonucleotide
cagcagtatgaaagctcaccgtggacg

SEQ ID NO: 17894 - protein, 9 aa, Artificial Sequence
  Description of Artificial Sequence: Synthetic peptide
QQYESSPWT

SEQ ID NO: 17895 - DNA, 27 bp, Artificial Sequence
  Description of Artificial Sequence: Synthetic oligonucleotide
cagcattctgataactcaccgtggacg

SEQ ID NO: 17896 - protein, 9 aa, Artificial Sequence
  Description of Artificial Sequence: Synthetic peptide
QHSDNSPWT

SEQ ID NO: 17897 - DNA, 27 bp, Artificial Sequence
  Description of Artificial Sequence: Synthetic oligonucleotide
cagcagtatggtaactcaccgctcact

SEQ ID NO: 17898 - protein, 9 aa, Artificial Sequence
  Description of Artificial Sequence: Synthetic peptide
QQYGNSPLT

SEQ ID NO: 17899 - DNA, 27 bp, Artificial Sequence
  Description of Artificial Sequence: Synthetic oligonucleotide
cagcagtatggttgctcaccgctcact

SEQ ID NO: 17900 - protein, 9 aa, Artificial Sequence
  Description of Artificial Sequence: Synthetic peptide
QQYGCSPLT

SEQ ID NO: 17901 - DNA, 27 bp, Artificial Sequence
  Description of Artificial Sequence: Synthetic oligonucleotide
cagcagtatggttgctcaccgctcact

SEQ ID NO: 17902 - protein, 9 aa, Artificial Sequence
  Description of Artificial Sequence: Synthetic peptide
QQYGCSPLT

SEQ ID NO: 17903 - DNA, 27 bp, Artificial Sequence
  Description of Artificial Sequence: Synthetic oligonucleotide
cagcactctgataactcaccgtggacg

SEQ ID NO: 17904 - protein, 9 aa, Artificial Sequence
  Description of Artificial Sequence: Synthetic peptide
QHSDNSPWT

SEQ ID NO: 17905 - DNA, 27 bp, Artificial Sequence
  Description of Artificial Sequence: Synthetic oligonucleotide
cagcagtatggtaactcaccgctcact

SEQ ID NO: 17906 - protein, 9 aa, Artificial Sequence
  Description of Artificial Sequence: Synthetic peptide
QQYGNSPLT

SEQ ID NO: 17907 - DNA, 27 bp, Artificial Sequence
  Description of Artificial Sequence: Synthetic oligonucleotide
ctacagcataatgattacccattcact

SEQ ID NO: 17908 - protein, 9 aa, Artificial Sequence
  Description of Artificial Sequence: Synthetic peptide
LQHNDYPFT

SEQ ID NO: 17909 - DNA, 27 bp, Artificial Sequence
  Description of Artificial Sequence: Synthetic oligonucleotide
cagcactctgataactcaccgtggacg

SEQ ID NO: 17910 - protein, 9 aa, Artificial Sequence
  Description of Artificial Sequence: Synthetic peptide
QHSDNSPWT

SEQ ID NO: 17911 - DNA, 27 bp, Artificial Sequence
  Description of Artificial Sequence: Synthetic oligonucleotide
cagcagtatggttgctcaccgctcact

SEQ ID NO: 17912 - protein, 9 aa, Artificial Sequence
  Description of Artificial Sequence: Synthetic peptide
QQYGCSPLT

SEQ ID NO: 17913 - DNA, 27 bp, Artificial Sequence
  Description of Artificial Sequence: Synthetic oligonucleotide
cagcactataatgatactccatggaag

SEQ ID NO: 17914 - protein, 9 aa, Artificial Sequence
  Description of Artificial Sequence: Synthetic peptide
QHYNDTPWK

SEQ ID NO: 17915 - DNA, 27 bp, Artificial Sequence
  Description of Artificial Sequence: Synthetic oligonucleotide
cagcactattataatactccgtggacg

SEQ ID NO: 17916 - protein, 9 aa, Artificial Sequence
  Description of Artificial Sequence: Synthetic peptide
QHYYNTPWT

SEQ ID NO: 17917 - DNA, 27 bp, Artificial Sequence
  Description of Artificial Sequence: Synthetic oligonucleotide
cagcagtatggttgctcaccgctcact

SEQ ID NO: 17918 - protein, 9 aa, Artificial Sequence
  Description of Artificial Sequence: Synthetic peptide
QQYGCSPLT

SEQ ID NO: 17919 - DNA, 27 bp, Artificial Sequence
  Description of Artificial Sequence: Synthetic oligonucleotide
cagcagtatgaaagctcaccgtggacg

SEQ ID NO: 17920 - protein, 9 aa, Artificial Sequence
  Description of Artificial Sequence: Synthetic peptide
QQYESSPWT

SEQ ID NO: 17921 - DNA, 27 bp, Artificial Sequence
  Description of Artificial Sequence: Synthetic oligonucleotide
cagcactctgataactcaccgtggacg

SEQ ID NO: 17922 - protein, 9 aa, Artificial Sequence
  Description of Artificial Sequence: Synthetic peptide
QHSDNSPWT

SEQ ID NO: 17923 - DNA, 27 bp, Artificial Sequence
  Description of Artificial Sequence: Synthetic oligonucleotide
cagcaatattttagtagtcctctgacg

SEQ ID NO: 17924 - protein, 9 aa, Artificial Sequence
  Description of Artificial Sequence: Synthetic peptide
QQYFSSPLT

SEQ ID NO: 17925 - DNA, 27 bp, Artificial Sequence
  Description of Artificial Sequence: Synthetic oligonucleotide
cagcagtatgaaagttcaccgtggacg

SEQ ID NO: 17926 - protein, 9 aa, Artificial Sequence
  Description of Artificial Sequence: Synthetic peptide
QQYESSPWT

SEQ ID NO: 17927 - DNA, 27 bp, Artificial Sequence
  Description of Artificial Sequence: Synthetic oligonucleotide
cagcaatattatagtactcctcctact

SEQ ID NO: 17928 - protein, 9 aa, Artificial Sequence
  Description of Artificial Sequence: Synthetic peptide
QQYYSTPPT

SEQ ID NO: 17929 - DNA, 27 bp, Artificial Sequence
  Description of Artificial Sequence: Synthetic oligonucleotide
cagcaatattttagtagtcctccgacg

SEQ ID NO: 17930 - protein, 9 aa, Artificial Sequence
  Description of Artificial Sequence: Synthetic peptide
QQYFSSPPT

SEQ ID NO: 17931 - DNA, 27 bp, Artificial Sequence
  Description of Artificial Sequence: Synthetic oligonucleotide
caacagtacagtaattacccgctcact

SEQ ID NO: 17932 - protein, 9 aa, Artificial Sequence
  Description of Artificial Sequence: Synthetic peptide
QQYSNYPLT

SEQ ID NO: 17933 - DNA, 27 bp, Artificial Sequence
  Description of Artificial Sequence: Synthetic oligonucleotide
cagcagtatgagagctcaccgtggacg

SEQ ID NO: 17934 - protein, 9 aa, Artificial Sequence
  Description of Artificial Sequence: Synthetic peptide
QQYESSPWT

SEQ ID NO: 17935 - DNA, 27 bp, Artificial Sequence
  Description of Artificial Sequence: Synthetic oligonucleotide
caggagtataatgactggccgtgcagt

SEQ ID NO: 17936 - protein, 9 aa, Artificial Sequence
  Description of Artificial Sequence: Synthetic peptide
QEYNDWPCS

SEQ ID NO: 17937 - DNA, 27 bp, Artificial Sequence
  Description of Artificial Sequence: Synthetic oligonucleotide
cagcaatattataggactccgtggacg

SEQ ID NO: 17938 - protein, 9 aa, Artificial Sequence
  Description of Artificial Sequence: Synthetic peptide
QQYYRTPWT

SEQ ID NO: 17939 - DNA, 27 bp, Artificial Sequence
  Description of Artificial Sequence: Synthetic oligonucleotide
cagcactatgataactcaccgtggacg

SEQ ID NO: 17940 - protein, 9 aa, Artificial Sequence
  Description of Artificial Sequence: Synthetic peptide
QHYDNSPWT

SEQ ID NO: 17941 - DNA, 27 bp, Artificial Sequence
  Description of Artificial Sequence: Synthetic oligonucleotide
cagcactatgataactcaccgtggacg

SEQ ID NO: 17942 - protein, 9 aa, Artificial Sequence
  Description of Artificial Sequence: Synthetic peptide
QHYDNSPWT

SEQ ID NO: 17943 - DNA, 27 bp, Artificial Sequence
  Description of Artificial Sequence: Synthetic oligonucleotide
cagcagtatggttgctcaccgctcact

SEQ ID NO: 17944 - protein, 9 aa, Artificial Sequence
  Description of Artificial Sequence: Synthetic peptide
QQYGCSPLT

SEQ ID NO: 17945 - DNA, 27 bp, Artificial Sequence
  Description of Artificial Sequence: Synthetic oligonucleotide
cagcattatgatagctcaccgtggacg

SEQ ID NO: 17946 - protein, 9 aa, Artificial Sequence
  Description of Artificial Sequence: Synthetic peptide
QHYDSSPWT

SEQ ID NO: 17947 - DNA, 27 bp, Artificial Sequence
  Description of Artificial Sequence: Synthetic oligonucleotide
cagcagtatgaaagttcaccgtggacg

SEQ ID NO: 17948 - protein, 9 aa, Artificial Sequence
  Description of Artificial Sequence: Synthetic peptide
QQYESSPWT

SEQ ID NO: 17949 - DNA, 27 bp, Artificial Sequence
  Description of Artificial Sequence: Synthetic oligonucleotide
cagcagtatgaaagctcaccgtggacc

SEQ ID NO: 17950 - protein, 9 aa, Artificial Sequence
  Description of Artificial Sequence: Synthetic peptide
QQYESSPWT

SEQ ID NO: 17951 - DNA, 27 bp, Artificial Sequence
  Description of Artificial Sequence: Synthetic oligonucleotide
cagcagtatgaaagctcgccgtggacg

SEQ ID NO: 17952 - protein, 9 aa, Artificial Sequence
  Description of Artificial Sequence: Synthetic peptide
QQYESSPWT

SEQ ID NO: 17953 - DNA, 27 bp, Artificial Sequence
  Description of Artificial Sequence: Synthetic oligonucleotide
cagcaatattatagtactcctccgacg

SEQ ID NO: 17954 - protein, 9 aa, Artificial Sequence
  Description of Artificial Sequence: Synthetic peptide
QQYYSTPPT

SEQ ID NO: 17955 - DNA, 27 bp, Artificial Sequence
  Description of Artificial Sequence: Synthetic oligonucleotide
cagcagtatgagagttcaccgtggacg

SEQ ID NO: 17956 - protein, 9 aa, Artificial Sequence
  Description of Artificial Sequence: Synthetic peptide
QQYESSPWT

SEQ ID NO: 17957 - DNA, 27 bp, Artificial Sequence
  Description of Artificial Sequence: Synthetic oligonucleotide
cagcaatattatagtactccgtgcagt

SEQ ID NO: 17958 - protein, 9 aa, Artificial Sequence
  Description of Artificial Sequence: Synthetic peptide
QQYYSTPCS

SEQ ID NO: 17959 - DNA, 27 bp, Artificial Sequence
  Description of Artificial Sequence: Synthetic oligonucleotide
cagcagtatggttgctcaccgctcact

SEQ ID NO: 17960 - protein, 9 aa, Artificial Sequence
  Description of Artificial Sequence: Synthetic peptide
QQYGCSPLT

SEQ ID NO: 17961 - DNA, 27 bp, Artificial Sequence
  Description of Artificial Sequence: Synthetic oligonucleotide
cagcactatgataactcaccgtggacg

SEQ ID NO: 17962 - protein, 9 aa, Artificial Sequence
  Description of Artificial Sequence: Synthetic peptide
QHYDNSPWT

SEQ ID NO: 17963 - DNA, 27 bp, Artificial Sequence
  Description of Artificial Sequence: Synthetic oligonucleotide
cagcactctgataactcaccgtggacg

SEQ ID NO: 17964 - protein, 9 aa, Artificial Sequence
  Description of Artificial Sequence: Synthetic peptide
QHSDNSPWT

SEQ ID NO: 17965 - DNA, 27 bp, Artificial Sequence
  Description of Artificial Sequence: Synthetic oligonucleotide
cagcaatatcatagtagtccactgacg

SEQ ID NO: 17966 - protein, 9 aa, Artificial Sequence
  Description of Artificial Sequence: Synthetic peptide
QQYHSSPLT

SEQ ID NO: 17967 - DNA, 27 bp, Artificial Sequence
  Description of Artificial Sequence: Synthetic oligonucleotide
cagcactctgataactcaccgtggacg

SEQ ID NO: 17968 - protein, 9 aa, Artificial Sequence
  Description of Artificial Sequence: Synthetic peptide
QHSDNSPWT

SEQ ID NO: 17969 - DNA, 27 bp, Artificial Sequence
  Description of Artificial Sequence: Synthetic oligonucleotide
cagcagtatgaaagctcaccgtggacg

SEQ ID NO: 17970 - protein, 9 aa, Artificial Sequence
  Description of Artificial Sequence: Synthetic peptide
QQYESSPWT

SEQ ID NO: 17971 - DNA, 27 bp, Artificial Sequence
  Description of Artificial Sequence: Synthetic oligonucleotide
cagcattctgataactcaccgtggacg

SEQ ID NO: 17972 - protein, 9 aa, Artificial Sequence
  Description of Artificial Sequence: Synthetic peptide
QHSDNSPWT

SEQ ID NO: 17973 - DNA, 27 bp, Artificial Sequence
  Description of Artificial Sequence: Synthetic oligonucleotide
ctactctatcttacttacccgctcacc

SEQ ID NO: 17974 - protein, 9 aa, Artificial Sequence
  Description of Artificial Sequence: Synthetic peptide
LLYLTYPLT

SEQ ID NO: 17975 - DNA, 27 bp, Artificial Sequence
  Description of Artificial Sequence: Synthetic oligonucleotide
cagcattctgataactcaccgtggacg

SEQ ID NO: 17976 - protein, 9 aa, Artificial Sequence
  Description of Artificial Sequence: Synthetic peptide
QHSDNSPWT

SEQ ID NO: 17977 - DNA, 27 bp, Artificial Sequence
  Description of Artificial Sequence: Synthetic oligonucleotide
cagcagtatggtaactcaccgctcact

SEQ ID NO: 17978 - protein, 9 aa, Artificial Sequence
  Description of Artificial Sequence: Synthetic peptide
QQYGNSPLT

SEQ ID NO: 17979 - DNA, 27 bp, Artificial Sequence
  Description of Artificial Sequence: Synthetic oligonucleotide
cagcaatattatagtagtccgtgcagt

SEQ ID NO: 17980 - protein, 9 aa, Artificial Sequence
  Description of Artificial Sequence: Synthetic peptide
QQYYSSPCS

SEQ ID NO: 17981 - DNA, 27 bp, Artificial Sequence
  Description of Artificial Sequence: Synthetic oligonucleotide
cagcactctgataactcaccgtggacg

SEQ ID NO: 17982 - protein, 9 aa, Artificial Sequence
  Description of Artificial Sequence: Synthetic peptide
QHSDNSPWT

SEQ ID NO: 17983 - DNA, 27 bp, Artificial Sequence
  Description of Artificial Sequence: Synthetic oligonucleotide
cagcaatattatagttctcctccgacg

SEQ ID NO: 17984 - protein, 9 aa, Artificial Sequence
  Description of Artificial Sequence: Synthetic peptide
QQYYSSPPT

SEQ ID NO: 17985 - DNA, 27 bp, Artificial Sequence
  Description of Artificial Sequence: Synthetic oligonucleotide
cagcattctgataactcaccgtggacg

SEQ ID NO: 17986 - protein, 9 aa, Artificial Sequence
  Description of Artificial Sequence: Synthetic peptide
QHSDNSPWT

SEQ ID NO: 17987 - DNA, 27 bp, Artificial Sequence
  Description of Artificial Sequence: Synthetic oligonucleotide
cagcaatattataatactccgtggacg

SEQ ID NO: 17988 - protein, 9 aa, Artificial Sequence
  Description of Artificial Sequence: Synthetic peptide
QQYYNTPWT

SEQ ID NO: 17989 - DNA, 27 bp, Artificial Sequence
  Description of Artificial Sequence: Synthetic oligonucleotide
cagcaatattatagtactcctccgacg

SEQ ID NO: 17990 - protein, 9 aa, Artificial Sequence
  Description of Artificial Sequence: Synthetic peptide
QQYYSTPPT

SEQ ID NO: 17991 - DNA, 27 bp, Artificial Sequence
  Description of Artificial Sequence: Synthetic oligonucleotide
ctacagcataatgattacccattcact

SEQ ID NO: 17992 - protein, 9 aa, Artificial Sequence
  Description of Artificial Sequence: Synthetic peptide
LQHNDYPFT

SEQ ID NO: 17993 - DNA, 27 bp, Artificial Sequence
  Description of Artificial Sequence: Synthetic oligonucleotide
cagcactctgataactcaccgtggacg

SEQ ID NO: 17994 - protein, 9 aa, Artificial Sequence
  Description of Artificial Sequence: Synthetic peptide
QHSDNSPWT

SEQ ID NO: 17995 - DNA, 27 bp, Artificial Sequence
  Description of Artificial Sequence: Synthetic oligonucleotide
cagcactctgataactcaccgtggacg

SEQ ID NO: 17996 - protein, 9 aa, Artificial Sequence
  Description of Artificial Sequence: Synthetic peptide
QHSDNSPWT

SEQ ID NO: 17997 - DNA, 27 bp, Artificial Sequence
  Description of Artificial Sequence: Synthetic oligonucleotide
cagcactctgataactcaccgtggacg

SEQ ID NO: 17998 - protein, 9 aa, Artificial Sequence
  Description of Artificial Sequence: Synthetic peptide
QHSDNSPWT

SEQ ID NO: 17999 - DNA, 27 bp, Artificial Sequence
  Description of Artificial Sequence: Synthetic oligonucleotide
cagcaatattatagagctcctccgacg

SEQ ID NO: 18000 - protein, 9 aa, Artificial Sequence
  Description of Artificial Sequence: Synthetic peptide
QQYYRAPPT

SEQ ID NO: 18001 - DNA, 27 bp, Artificial Sequence
  Description of Artificial Sequence: Synthetic oligonucleotide
cagcactctgataactcaccgtggacg

SEQ ID NO: 18002 - protein, 9 aa, Artificial Sequence
  Description of Artificial Sequence: Synthetic peptide
QHSDNSPWT

SEQ ID NO: 18003 - DNA, 27 bp, Artificial Sequence
  Description of Artificial Sequence: Synthetic oligonucleotide
atgcaagctctacatattcctctcact

SEQ ID NO: 18004 - protein, 9 aa, Artificial Sequence
  Description of Artificial Sequence: Synthetic peptide
MQALHIPLT

SEQ ID NO: 18005 - DNA, 27 bp, Artificial Sequence
  Description of Artificial Sequence: Synthetic oligonucleotide
cagcactatgataactcaccgtggacg

SEQ ID NO: 18006 - protein, 9 aa, Artificial Sequence
  Description of Artificial Sequence: Synthetic peptide
QHYDNSPWT

SEQ ID NO: 18007 - DNA, 27 bp, Artificial Sequence
  Description of Artificial Sequence: Synthetic oligonucleotide
cagcagtatgaaagctcagtgtggacg

SEQ ID NO: 18008 - protein, 9 aa, Artificial Sequence
  Description of Artificial Sequence: Synthetic peptide
QQYESSVWT

SEQ ID NO: 18009 - DNA, 27 bp, Artificial Sequence
  Description of Artificial Sequence: Synthetic oligonucleotide
cagcattctgataactctccgtggacg

SEQ ID NO: 18010 - protein, 9 aa, Artificial Sequence
  Description of Artificial Sequence: Synthetic peptide
QHSDNSPWT

SEQ ID NO: 18011 - DNA, 27 bp, Artificial Sequence
  Description of Artificial Sequence: Synthetic oligonucleotide
cagcagtatgaaatctcaccgtggacg

SEQ ID NO: 18012 - protein, 9 aa, Artificial Sequence
  Description of Artificial Sequence: Synthetic peptide
QQYEISPWT

SEQ ID NO: 18013 - DNA, 27 bp, Artificial Sequence
  Description of Artificial Sequence: Synthetic oligonucleotide
cagcactctgataactcaccgtggacg

SEQ ID NO: 18014 - protein, 9 aa, Artificial Sequence
  Description of Artificial Sequence: Synthetic peptide
QHSDNSPWT

SEQ ID NO: 18015 - DNA, 27 bp, Artificial Sequence
  Description of Artificial Sequence: Synthetic oligonucleotide
cagcactatgataactcaccgtggacg

SEQ ID NO: 18016 - protein, 9 aa, Artificial Sequence
  Description of Artificial Sequence: Synthetic peptide
QHYDNSPWT

SEQ ID NO: 18017 - DNA, 27 bp, Artificial Sequence
  Description of Artificial Sequence: Synthetic oligonucleotide
cagcactatgataactcaccgtggacg

SEQ ID NO: 18018 - protein, 9 aa, Artificial Sequence
  Description of Artificial Sequence: Synthetic peptide
QHYDNSPWT

SEQ ID NO: 18019 - DNA, 27 bp, Artificial Sequence
  Description of Artificial Sequence: Synthetic oligonucleotide
ctacagcataatagttacccgatcacc

SEQ ID NO: 18020 - protein, 9 aa, Artificial Sequence
  Description of Artificial Sequence: Synthetic peptide
LQHNSYPIT

SEQ ID NO: 18021 - DNA, 27 bp, Artificial Sequence
  Description of Artificial Sequence: Synthetic oligonucleotide
cagcaatatcttagtagtcctctgacg

SEQ ID NO: 18022 - protein, 9 aa, Artificial Sequence
  Description of Artificial Sequence: Synthetic peptide
QQYLSSPLT

SEQ ID NO: 18023 - DNA, 27 bp, Artificial Sequence
  Description of Artificial Sequence: Synthetic oligonucleotide
caacaatattatagtagtcctccgacg

SEQ ID NO: 18024 - protein, 9 aa, Artificial Sequence
  Description of Artificial Sequence: Synthetic peptide
QQYYSSPPT

SEQ ID NO: 18025 - DNA, 27 bp, Artificial Sequence
  Description of Artificial Sequence: Synthetic oligonucleotide
cagcactatgataactcaccgtggacg

SEQ ID NO: 18026 - protein, 9 aa, Artificial Sequence
  Description of Artificial Sequence: Synthetic peptide
QHYDNSPWT

SEQ ID NO: 18027 - DNA, 27 bp, Artificial Sequence
  Description of Artificial Sequence: Synthetic oligonucleotide
atgcaagctctacaccctcctctcact

SEQ ID NO: 18028 - protein, 9 aa, Artificial Sequence
  Description of Artificial Sequence: Synthetic peptide
MQALHPPLT

SEQ ID NO: 18029 - DNA, 27 bp, Artificial Sequence
  Description of Artificial Sequence: Synthetic oligonucleotide
cagcactattataatactccgtggaag

SEQ ID NO: 18030 - protein, 9 aa, Artificial Sequence
  Description of Artificial Sequence: Synthetic peptide
QHYYNTPWK

SEQ ID NO: 18031 - DNA, 27 bp, Artificial Sequence
  Description of Artificial Sequence: Synthetic oligonucleotide
cagcactatgataactcaccgtggacg

SEQ ID NO: 18032 - protein, 9 aa, Artificial Sequence
  Description of Artificial Sequence: Synthetic peptide
QHYDNSPWT

SEQ ID NO: 18033 - DNA, 27 bp, Artificial Sequence
  Description of Artificial Sequence: Synthetic oligonucleotide
cagcactatgataactcaccgtggacg

SEQ ID NO: 18034 - protein, 9 aa, Artificial Sequence
  Description of Artificial Sequence: Synthetic peptide
QHYDNSPWT

SEQ ID NO: 18035 - DNA, 27 bp, Artificial Sequence
  Description of Artificial Sequence: Synthetic oligonucleotide
cagcattctgataactcaccgtggacg

SEQ ID NO: 18036 - protein, 9 aa, Artificial Sequence
  Description of Artificial Sequence: Synthetic peptide
QHSDNSPWT

SEQ ID NO: 18037 - DNA, 27 bp, Artificial Sequence
  Description of Artificial Sequence: Synthetic oligonucleotide
cagcactatgataactcaccgtggacg

SEQ ID NO: 18038 - protein, 9 aa, Artificial Sequence
  Description of Artificial Sequence: Synthetic peptide
QHYDNSPWT

SEQ ID NO: 18039 - DNA, 27 bp, Artificial Sequence
  Description of Artificial Sequence: Synthetic oligonucleotide
cagcaatattatactactccgtggacg

SEQ ID NO: 18040 - protein, 9 aa, Artificial Sequence
  Description of Artificial Sequence: Synthetic peptide
QQYYTTPWT

SEQ ID NO: 18041 - DNA, 27 bp, Artificial Sequence
  Description of Artificial Sequence: Synthetic oligonucleotide
cagcactctgataactcaccgtggacg

SEQ ID NO: 18042 - protein, 9 aa, Artificial Sequence
  Description of Artificial Sequence: Synthetic peptide
QHSDNSPWT

SEQ ID NO: 18043 - DNA, 27 bp, Artificial Sequence
  Description of Artificial Sequence: Synthetic oligonucleotide
cagcagtatgaaagttcaccgtggacg

SEQ ID NO: 18044 - protein, 9 aa, Artificial Sequence
  Description of Artificial Sequence: Synthetic peptide
QQYESSPWT

SEQ ID NO: 18045 - DNA, 27 bp, Artificial Sequence
  Description of Artificial Sequence: Synthetic oligonucleotide
atgcaagctctacatattcctctcact

SEQ ID NO: 18046 - protein, 9 aa, Artificial Sequence
  Description of Artificial Sequence: Synthetic peptide
MQALHIPLT

SEQ ID NO: 18047 - DNA, 27 bp, Artificial Sequence
  Description of Artificial Sequence: Synthetic oligonucleotide
caggagtataatgactggccgtgcagt

SEQ ID NO: 18048 - protein, 9 aa, Artificial Sequence
  Description of Artificial Sequence: Synthetic peptide
QEYNDWPCS

SEQ ID NO: 18049 - DNA, 27 bp, Artificial Sequence
  Description of Artificial Sequence: Synthetic oligonucleotide
cagcattatgataactctccgtggacg

SEQ ID NO: 18050 - protein, 9 aa, Artificial Sequence
  Description of Artificial Sequence: Synthetic peptide
QHYDNSPWT

SEQ ID NO: 18051 - DNA, 27 bp, Artificial Sequence
  Description of Artificial Sequence: Synthetic oligonucleotide
cagcaatattttagtgttcctccgacg

SEQ ID NO: 18052 - protein, 9 aa, Artificial Sequence
  Description of Artificial Sequence: Synthetic peptide
QQYFSVPPT

SEQ ID NO: 18053 - DNA, 27 bp, Artificial Sequence
  Description of Artificial Sequence: Synthetic oligonucleotide
cagcactatgataactcaccgtggacg

SEQ ID NO: 18054 - protein, 9 aa, Artificial Sequence
  Description of Artificial Sequence: Synthetic peptide
QHYDNSPWT

SEQ ID NO: 18055 - DNA, 27 bp, Artificial Sequence
  Description of Artificial Sequence: Synthetic oligonucleotide
cagcaatattatagtactcctccgacg

SEQ ID NO: 18056 - protein, 9 aa, Artificial Sequence
  Description of Artificial Sequence: Synthetic peptide
QQYYSTPPT

SEQ ID NO: 18057 - DNA, 27 bp, Artificial Sequence
  Description of Artificial Sequence: Synthetic oligonucleotide
cagcactatgataactcaccgtggacg

SEQ ID NO: 18058 - protein, 9 aa, Artificial Sequence
  Description of Artificial Sequence: Synthetic peptide
QHYDNSPWT

SEQ ID NO: 18059 - DNA, 27 bp, Artificial Sequence
  Description of Artificial Sequence: Synthetic oligonucleotide
cagcactctgataactcaccgtggacg

SEQ ID NO: 18060 - protein, 9 aa, Artificial Sequence
  Description of Artificial Sequence: Synthetic peptide
QHSDNSPWT

SEQ ID NO: 18061 - DNA, 27 bp, Artificial Sequence
  Description of Artificial Sequence: Synthetic oligonucleotide
cagcagtatgaaagctcaccgtggacg

SEQ ID NO: 18062 - protein, 9 aa, Artificial Sequence
  Description of Artificial Sequence: Synthetic peptide
QQYESSPWT

SEQ ID NO: 18063 - DNA, 27 bp, Artificial Sequence
  Description of Artificial Sequence: Synthetic oligonucleotide
cagcattatgatagctcaccgtggacg

SEQ ID NO: 18064 - protein, 9 aa, Artificial Sequence
  Description of Artificial Sequence: Synthetic peptide
QHYDSSPWT

SEQ ID NO: 18065 - DNA, 27 bp, Artificial Sequence
  Description of Artificial Sequence: Synthetic oligonucleotide
ctccagcattatagttaccctcggacg

SEQ ID NO: 18066 - protein, 9 aa, Artificial Sequence
  Description of Artificial Sequence: Synthetic peptide
LQHYSYPRT

SEQ ID NO: 18067 - DNA, 27 bp, Artificial Sequence
  Description of Artificial Sequence: Synthetic oligonucleotide
cagcaatattttagtagtcctccgacg

SEQ ID NO: 18068 - protein, 9 aa, Artificial Sequence
  Description of Artificial Sequence: Synthetic peptide
QQYFSSPPT

SEQ ID NO: 18069 - DNA, 27 bp, Artificial Sequence
  Description of Artificial Sequence: Synthetic oligonucleotide
cagcaatattatagttctcctccgacg

SEQ ID NO: 18070 - protein, 9 aa, Artificial Sequence
  Description of Artificial Sequence: Synthetic peptide
QQYYSSPPT

SEQ ID NO: 18071 - DNA, 27 bp, Artificial Sequence
  Description of Artificial Sequence: Synthetic oligonucleotide
cagcaatatcatagttctcctctgacg

SEQ ID NO: 18072 - protein, 9 aa, Artificial Sequence
  Description of Artificial Sequence: Synthetic peptide
QQYHSSPLT

SEQ ID NO: 18073 - DNA, 27 bp, Artificial Sequence
  Description of Artificial Sequence: Synthetic oligonucleotide
cagcaatattatagtactcctccgacg

SEQ ID NO: 18074 - protein, 9 aa, Artificial Sequence
  Description of Artificial Sequence: Synthetic peptide
QQYYSTPPT

SEQ ID NO: 18075 - DNA, 27 bp, Artificial Sequence
  Description of Artificial Sequence: Synthetic oligonucleotide
cagcattatgataactcaccgtggacg

SEQ ID NO: 18076 - protein, 9 aa, Artificial Sequence
  Description of Artificial Sequence: Synthetic peptide
QHYDNSPWT

SEQ ID NO: 18077 - DNA, 27 bp, Artificial Sequence
  Description of Artificial Sequence: Synthetic oligonucleotide
cagcactatgataactcaccgtggacg

SEQ ID NO: 18078 - protein, 9 aa, Artificial Sequence
  Description of Artificial Sequence: Synthetic peptide
QHYDNSPWT

SEQ ID NO: 18079 - DNA, 27 bp, Artificial Sequence
  Description of Artificial Sequence: Synthetic oligonucleotide
cagcagtataatgactggccgtgcagt

SEQ ID NO: 18080 - protein, 9 aa, Artificial Sequence
  Description of Artificial Sequence: Synthetic peptide
QQYNDWPCS

SEQ ID NO: 18081 - DNA, 27 bp, Artificial Sequence
  Description of Artificial Sequence: Synthetic oligonucleotide
cagcaatatcatagttctcctctgacg

SEQ ID NO: 18082 - protein, 9 aa, Artificial Sequence
  Description of Artificial Sequence: Synthetic peptide
QQYHSSPLT

SEQ ID NO: 18083 - DNA, 27 bp, Artificial Sequence
  Description of Artificial Sequence: Synthetic oligonucleotide
cagcactatgataactcaccgtggacg

SEQ ID NO: 18084 - protein, 9 aa, Artificial Sequence
  Description of Artificial Sequence: Synthetic peptide
QHYDNSPWT

SEQ ID NO: 18085 - DNA, 27 bp, Artificial Sequence
  Description of Artificial Sequence: Synthetic oligonucleotide
cagcactatgataactcaccgtggacg

SEQ ID NO: 18086 - protein, 9 aa, Artificial Sequence
  Description of Artificial Sequence: Synthetic peptide
QHYDNSPWT

SEQ ID NO: 18087 - DNA, 27 bp, Artificial Sequence
  Description of Artificial Sequence: Synthetic oligonucleotide
cagcactatgataactctccgtggacg

SEQ ID NO: 18088 - protein, 9 aa, Artificial Sequence
  Description of Artificial Sequence: Synthetic peptide
QHYDNSPWT

SEQ ID NO: 18089 - DNA, 27 bp, Artificial Sequence
  Description of Artificial Sequence: Synthetic oligonucleotide
cagcaatattatagtactccgtgcagt

SEQ ID NO: 18090 - protein, 9 aa, Artificial Sequence
  Description of Artificial Sequence: Synthetic peptide
QQYYSTPCS

SEQ ID NO: 18091 - DNA, 27 bp, Artificial Sequence
  Description of Artificial Sequence: Synthetic oligonucleotide
cagcagtatggtaactcaccgctcact

SEQ ID NO: 18092 - protein, 9 aa, Artificial Sequence
  Description of Artificial Sequence: Synthetic peptide
QQYGNSPLT

SEQ ID NO: 18093 - DNA, 27 bp, Artificial Sequence
  Description of Artificial Sequence: Synthetic oligonucleotide
cagcaatattataggactccgtggacg

SEQ ID NO: 18094 - protein, 9 aa, Artificial Sequence
  Description of Artificial Sequence: Synthetic peptide
QQYYRTPWT

SEQ ID NO: 18095 - DNA, 27 bp, Artificial Sequence
  Description of Artificial Sequence: Synthetic oligonucleotide
ctacagcatagtaattacccgctcact

SEQ ID NO: 18096 - protein, 9 aa, Artificial Sequence
  Description of Artificial Sequence: Synthetic peptide
LQHSNYPLT

SEQ ID NO: 18097 - DNA, 27 bp, Artificial Sequence
  Description of Artificial Sequence: Synthetic oligonucleotide
ctacagcataatgattacccattcact

SEQ ID NO: 18098 - protein, 9 aa, Artificial Sequence
  Description of Artificial Sequence: Synthetic peptide
LQHNDYPFT

SEQ ID NO: 18099 - DNA, 27 bp, Artificial Sequence
  Description of Artificial Sequence: Synthetic oligonucleotide
cagcaatattatagtagtccaccgacg

SEQ ID NO: 18100 - protein, 9 aa, Artificial Sequence
  Description of Artificial Sequence: Synthetic peptide
QQYYSSPPT

SEQ ID NO: 18101 - DNA, 27 bp, Artificial Sequence
  Description of Artificial Sequence: Synthetic oligonucleotide
cagcaatattatagtactccgtgcagt

SEQ ID NO: 18102 - protein, 9 aa, Artificial Sequence
  Description of Artificial Sequence: Synthetic peptide
QQYYSTPCS

SEQ ID NO: 18103 - DNA, 27 bp, Artificial Sequence
  Description of Artificial Sequence: Synthetic oligonucleotide
caccagtataatgattacccattcact

SEQ ID NO: 18104 - protein, 9 aa, Artificial Sequence
  Description of Artificial Sequence: Synthetic peptide
HQYNDYPFT

SEQ ID NO: 18105 - DNA, 27 bp, Artificial Sequence
  Description of Artificial Sequence: Synthetic oligonucleotide
cagcaatattttagtgttcctccgacg

SEQ ID NO: 18106 - protein, 9 aa, Artificial Sequence
  Description of Artificial Sequence: Synthetic peptide
QQYFSVPPT

SEQ ID NO: 18107 - DNA, 27 bp, Artificial Sequence
  Description of Artificial Sequence: Synthetic oligonucleotide
cagcattctgataactcaccgtggacg

SEQ ID NO: 18108 - protein, 9 aa, Artificial Sequence
  Description of Artificial Sequence: Synthetic peptide
QHSDNSPWT

SEQ ID NO: 18109 - DNA, 27 bp, Artificial Sequence
  Description of Artificial Sequence: Synthetic oligonucleotide
cagcactacaatgatactccatggaag

SEQ ID NO: 18110 - protein, 9 aa, Artificial Sequence
  Description of Artificial Sequence: Synthetic peptide
QHYNDTPWK

SEQ ID NO: 18111 - DNA, 27 bp, Artificial Sequence
  Description of Artificial Sequence: Synthetic oligonucleotide
cagcactctgataactcaccgtggacg

SEQ ID NO: 18112 - protein, 9 aa, Artificial Sequence
  Description of Artificial Sequence: Synthetic peptide
QHSDNSPWT

SEQ ID NO: 18113 - DNA, 27 bp, Artificial Sequence
  Description of Artificial Sequence: Synthetic oligonucleotide
caacaggctaacagtttcccattcact

SEQ ID NO: 18114 - protein, 9 aa, Artificial Sequence
  Description of Artificial Sequence: Synthetic peptide
QQANSFPFT

SEQ ID NO: 18115 - DNA, 27 bp, Artificial Sequence
  Description of Artificial Sequence: Synthetic oligonucleotide
cttcagcatagtacttacccgctcact

SEQ ID NO: 18116 - protein, 9 aa, Artificial Sequence
  Description of Artificial Sequence: Synthetic peptide
LQHSTYPLT

SEQ ID NO: 18117 - DNA, 24 bp, Artificial Sequence
  Description of Artificial Sequence: Synthetic oligonucleotide
caacagagttacagtacccccact

SEQ ID NO: 18118 - protein, 8 aa, Artificial Sequence
  Description of Artificial Sequence: Synthetic peptide
QQSYSTPT

SEQ ID NO: 18119 - DNA, 27 bp, Artificial Sequence
  Description of Artificial Sequence: Synthetic oligonucleotide
atgcaaagtatacagcttccgtggacg

SEQ ID NO: 18120 - protein, 9 aa, Artificial Sequence
  Description of Artificial Sequence: Synthetic peptide
MQSIQLPWT

SEQ ID NO: 18121 - DNA, 27 bp, Artificial Sequence
  Description of Artificial Sequence: Synthetic oligonucleotide
cagcaatattatagtactccgtgcagt

SEQ ID NO: 18122 - protein, 9 aa, Artificial Sequence
  Description of Artificial Sequence: Synthetic peptide
QQYYSTPCS

SEQ ID NO: 18123 - DNA, 27 bp, Artificial Sequence
  Description of Artificial Sequence: Synthetic oligonucleotide
caacaatatggtaggtcaccattcaat

SEQ ID NO: 18124 - protein, 9 aa, Artificial Sequence
  Description of Artificial Sequence: Synthetic peptide
QQYGRSPFN

SEQ ID NO: 18125 - DNA, 27 bp, Artificial Sequence
  Description of Artificial Sequence: Synthetic oligonucleotide
caacagactgacagtttcccattcact

SEQ ID NO: 18126 - protein, 9 aa, Artificial Sequence
  Description of Artificial Sequence: Synthetic peptide
QQTDSFPFT

SEQ ID NO: 18127 - DNA, 27 bp, Artificial Sequence
  Description of Artificial Sequence: Synthetic oligonucleotide
cagcaatattatagtactccgtgcagt

SEQ ID NO: 18128 - protein, 9 aa, Artificial Sequence
  Description of Artificial Sequence: Synthetic peptide
QQYYSTPCS

SEQ ID NO: 18129 - DNA, 24 bp, Artificial Sequence
  Description of Artificial Sequence: Synthetic oligonucleotide
caacagagttacagtacccccact

SEQ ID NO: 18130 - protein, 8 aa, Artificial Sequence
  Description of Artificial Sequence: Synthetic peptide
QQSYSTPT

SEQ ID NO: 18131 - DNA, 27 bp, Artificial Sequence
  Description of Artificial Sequence: Synthetic oligonucleotide
cagcaatattatactactccgtgcagt

SEQ ID NO: 18132 - protein, 9 aa, Artificial Sequence
  Description of Artificial Sequence: Synthetic peptide
QQYYTTPCS

SEQ ID NO: 18133 - DNA, 27 bp, Artificial Sequence
  Description of Artificial Sequence: Synthetic oligonucleotide
ctacagcataatagttacccgctcact

SEQ ID NO: 18134 - protein, 9 aa, Artificial Sequence
  Description of Artificial Sequence: Synthetic peptide
LQHNSYPLT

SEQ ID NO: 18135 - DNA, 27 bp, Artificial Sequence
  Description of Artificial Sequence: Synthetic oligonucleotide
ctccaacatgatagttacccgctcact

SEQ ID NO: 18136 - protein, 9 aa, Artificial Sequence
  Description of Artificial Sequence: Synthetic peptide
LQHDSYPLT

SEQ ID NO: 18137 - DNA, 27 bp, Artificial Sequence
  Description of Artificial Sequence: Synthetic oligonucleotide
atgcaaagtacacagtttcctcccact

SEQ ID NO: 18138 - protein, 9 aa, Artificial Sequence
  Description of Artificial Sequence: Synthetic peptide
MQSTQFPPT

SEQ ID NO: 18139 - DNA, 24 bp, Artificial Sequence
  Description of Artificial Sequence: Synthetic oligonucleotide
cagcagtatggtagcttattcact

SEQ ID NO: 18140 - protein, 8 aa, Artificial Sequence
  Description of Artificial Sequence: Synthetic peptide
QQYGSLFT

SEQ ID NO: 18141 - DNA, 27 bp, Artificial Sequence
  Description of Artificial Sequence: Synthetic oligonucleotide
caacaatatggtaggtcaccattcaat

SEQ ID NO: 18142 - protein, 9 aa, Artificial Sequence
  Description of Artificial Sequence: Synthetic peptide
QQYGRSPFN

SEQ ID NO: 18143 - DNA, 27 bp, Artificial Sequence
  Description of Artificial Sequence: Synthetic oligonucleotide
cagcaatattatagtactccatccact

SEQ ID NO: 18144 - protein, 9 aa, Artificial Sequence
  Description of Artificial Sequence: Synthetic peptide
QQYYSTPST

SEQ ID NO: 18145 - DNA, 27 bp, Artificial Sequence
  Description of Artificial Sequence: Synthetic oligonucleotide
caccaatattatagtactccgtgcagt

SEQ ID NO: 18146 - protein, 9 aa, Artificial Sequence
  Description of Artificial Sequence: Synthetic peptide
HQYYSTPCS

SEQ ID NO: 18147 - DNA, 27 bp, Artificial Sequence
  Description of Artificial Sequence: Synthetic oligonucleotide
ctacagcattatagttatcctcggacg

SEQ ID NO: 18148 - protein, 9 aa, Artificial Sequence
  Description of Artificial Sequence: Synthetic peptide
LQHYSYPRT

SEQ ID NO: 18149 - DNA, 27 bp, Artificial Sequence
  Description of Artificial Sequence: Synthetic oligonucleotide
cagcaatattatactactcctcccact

SEQ ID NO: 18150 - protein, 9 aa, Artificial Sequence
  Description of Artificial Sequence: Synthetic peptide
QQYYTTPPT

SEQ ID NO: 18151 - DNA, 24 bp, Artificial Sequence
  Description of Artificial Sequence: Synthetic oligonucleotide
atgcaaagtatacagctaatcacc

SEQ ID NO: 18152 - protein, 8 aa, Artificial Sequence
  Description of Artificial Sequence: Synthetic peptide
MQSIQLIT

SEQ ID NO: 18153 - DNA, 27 bp, Artificial Sequence
  Description of Artificial Sequence: Synthetic oligonucleotide
cagcagtatgatagctcaccgtggacg

SEQ ID NO: 18154 - protein, 9 aa, Artificial Sequence
  Description of Artificial Sequence: Synthetic peptide
QQYDSSPWT

SEQ ID NO: 18155 - DNA, 27 bp, Artificial Sequence
  Description of Artificial Sequence: Synthetic oligonucleotide
caacagtataatagttaccctctcact

SEQ ID NO: 18156 - protein, 9 aa, Artificial Sequence
  Description of Artificial Sequence: Synthetic peptide
QQYNSYPLT

SEQ ID NO: 18157 - DNA, 27 bp, Artificial Sequence
  Description of Artificial Sequence: Synthetic oligonucleotide
caacagactgacagtttcccattcact

SEQ ID NO: 18158 - protein, 9 aa, Artificial Sequence
  Description of Artificial Sequence: Synthetic peptide
QQTDSFPFT

SEQ ID NO: 18159 - DNA, 27 bp, Artificial Sequence
  Description of Artificial Sequence: Synthetic oligonucleotide
caacagactgacagtttcccattcact

SEQ ID NO: 18160 - protein, 9 aa, Artificial Sequence
  Description of Artificial Sequence: Synthetic peptide
QQTDSFPFT

SEQ ID NO: 18161 - DNA, 27 bp, Artificial Sequence
  Description of Artificial Sequence: Synthetic oligonucleotide
atgcaaagtatacagattccgtggacg

SEQ ID NO: 18162 - protein, 9 aa, Artificial Sequence
  Description of Artificial Sequence: Synthetic peptide
MQSIQIPWT

SEQ ID NO: 18163 - DNA, 27 bp, Artificial Sequence
  Description of Artificial Sequence: Synthetic oligonucleotide
caacagactgacagtttcccattcact

SEQ ID NO: 18164 - protein, 9 aa, Artificial Sequence
  Description of Artificial Sequence: Synthetic peptide
QQTDSFPFT

SEQ ID NO: 18165 - DNA, 27 bp, Artificial Sequence
  Description of Artificial Sequence: Synthetic oligonucleotide
cagcaatattatagtactccattcact

SEQ ID NO: 18166 - protein, 9 aa, Artificial Sequence
  Description of Artificial Sequence: Synthetic peptide
QQYYSTPFT

SEQ ID NO: 18167 - DNA, 24 bp, Artificial Sequence
  Description of Artificial Sequence: Synthetic oligonucleotide
caacagagttacagtacccccact

SEQ ID NO: 18168 - protein, 8 aa, Artificial Sequence
  Description of Artificial Sequence: Synthetic peptide
QQSYSTPT

SEQ ID NO: 18169 - DNA, 27 bp, Artificial Sequence
  Description of Artificial Sequence: Synthetic oligonucleotide
atgcaaagtatacagcttccgctcact

SEQ ID NO: 18170 - protein, 9 aa, Artificial Sequence
  Description of Artificial Sequence: Synthetic peptide
MQSIQLPLT

SEQ ID NO: 18171 - DNA, 27 bp, Artificial Sequence
  Description of Artificial Sequence: Synthetic oligonucleotide
caacagtataatagtttcccattcact

SEQ ID NO: 18172 - protein, 9 aa, Artificial Sequence
  Description of Artificial Sequence: Synthetic peptide
QQYNSFPFT

SEQ ID NO: 18173 - DNA, 27 bp, Artificial Sequence
  Description of Artificial Sequence: Synthetic oligonucleotide
cagcaatattatagtattcctccgacg

SEQ ID NO: 18174 - protein, 9 aa, Artificial Sequence
  Description of Artificial Sequence: Synthetic peptide
QQYYSIPPT

SEQ ID NO: 18175 - DNA, 24 bp, Artificial Sequence
  Description of Artificial Sequence: Synthetic oligonucleotide
caacagagttacagtacccccact

SEQ ID NO: 18176 - protein, 8 aa, Artificial Sequence
  Description of Artificial Sequence: Synthetic peptide
QQSYSTPT

SEQ ID NO: 18177 - DNA, 27 bp, Artificial Sequence
  Description of Artificial Sequence: Synthetic oligonucleotide
atgcaaagtatacagcttccgtggacg

SEQ ID NO: 18178 - protein, 9 aa, Artificial Sequence
  Description of Artificial Sequence: Synthetic peptide
MQSIQLPWT

SEQ ID NO: 18179 - DNA, 27 bp, Artificial Sequence
  Description of Artificial Sequence: Synthetic oligonucleotide
atgcagagtatacagcttccgctcact

SEQ ID NO: 18180 - protein, 9 aa, Artificial Sequence
  Description of Artificial Sequence: Synthetic peptide
MQSIQLPLT

SEQ ID NO: 18181 - DNA, 27 bp, Artificial Sequence
  Description of Artificial Sequence: Synthetic oligonucleotide
ctacagcatcgtaattacccgctcact

SEQ ID NO: 18182 - protein, 9 aa, Artificial Sequence
  Description of Artificial Sequence: Synthetic peptide
LQHRNYPLT

SEQ ID NO: 18183 - DNA, 27 bp, Artificial Sequence
  Description of Artificial Sequence: Synthetic oligonucleotide
ctacagcataatagttaccctctcatt

SEQ ID NO: 18184 - protein, 9 aa, Artificial Sequence
  Description of Artificial Sequence: Synthetic peptide
LQHNSYPLI

SEQ ID NO: 18185 - DNA, 27 bp, Artificial Sequence
  Description of Artificial Sequence: Synthetic oligonucleotide
atgcaaagtatacagattccgtggacg

SEQ ID NO: 18186 - protein, 9 aa, Artificial Sequence
  Description of Artificial Sequence: Synthetic peptide
MQSIQIPWT

SEQ ID NO: 18187 - DNA, 27 bp, Artificial Sequence
  Description of Artificial Sequence: Synthetic oligonucleotide
ctacagcataatagttacccgctcact

SEQ ID NO: 18188 - protein, 9 aa, Artificial Sequence
  Description of Artificial Sequence: Synthetic peptide
LQHNSYPLT

SEQ ID NO: 18189 - DNA, 27 bp, Artificial Sequence
  Description of Artificial Sequence: Synthetic oligonucleotide
cagcaatattatagtactccgtgcagt

SEQ ID NO: 18190 - protein, 9 aa, Artificial Sequence
  Description of Artificial Sequence: Synthetic peptide
QQYYSTPCS

SEQ ID NO: 18191 - DNA, 24 bp, Artificial Sequence
  Description of Artificial Sequence: Synthetic oligonucleotide
caacagagttacagtatccccact

SEQ ID NO: 18192 - protein, 8 aa, Artificial Sequence
  Description of Artificial Sequence: Synthetic peptide
QQSYSIPT

SEQ ID NO: 18193 - DNA, 27 bp, Artificial Sequence
  Description of Artificial Sequence: Synthetic oligonucleotide
cagcaatattatagtactcctccgacg

SEQ ID NO: 18194 - protein, 9 aa, Artificial Sequence
  Description of Artificial Sequence: Synthetic peptide
QQYYSTPPT

SEQ ID NO: 18195 - DNA, 27 bp, Artificial Sequence
  Description of Artificial Sequence: Synthetic oligonucleotide
caccaatattatagttatcctccgacg

SEQ ID NO: 18196 - protein, 9 aa, Artificial Sequence
  Description of Artificial Sequence: Synthetic peptide
HQYYSYPPT

SEQ ID NO: 18197 - DNA, 27 bp, Artificial Sequence
  Description of Artificial Sequence: Synthetic oligonucleotide
ctacagcataatagttaccctctcact

SEQ ID NO: 18198 - protein, 9 aa, Artificial Sequence
  Description of Artificial Sequence: Synthetic peptide
LQHNSYPLT

SEQ ID NO: 18199 - DNA, 27 bp, Artificial Sequence
  Description of Artificial Sequence: Synthetic oligonucleotide
caacagggtaacagtttcccattcact

SEQ ID NO: 18200 - protein, 9 aa, Artificial Sequence
  Description of Artificial Sequence: Synthetic peptide
QQGNSFPFT

SEQ ID NO: 18201 - DNA, 27 bp, Artificial Sequence
  Description of Artificial Sequence: Synthetic oligonucleotide
caacagactgacagtttcccattcact

SEQ ID NO: 18202 - protein, 9 aa, Artificial Sequence
  Description of Artificial Sequence: Synthetic peptide
QQTDSFPFT

SEQ ID NO: 18203 - DNA, 27 bp, Artificial Sequence
  Description of Artificial Sequence: Synthetic oligonucleotide
caacaatatggtcggtcaccattcaat

SEQ ID NO: 18204 - protein, 9 aa, Artificial Sequence
  Description of Artificial Sequence: Synthetic peptide
QQYGRSPFN

SEQ ID NO: 18205 - DNA, 27 bp, Artificial Sequence
  Description of Artificial Sequence: Synthetic oligonucleotide
caacagactgacagtttcccattcact

SEQ ID NO: 18206 - protein, 9 aa, Artificial Sequence
  Description of Artificial Sequence: Synthetic peptide
QQTDSFPFT

SEQ ID NO: 18207 - DNA, 27 bp, Artificial Sequence
  Description of Artificial Sequence: Synthetic oligonucleotide
ctacagcattatagttatcctcggacg

SEQ ID NO: 18208 - protein, 9 aa, Artificial Sequence
  Description of Artificial Sequence: Synthetic peptide
LQHYSYPRT

SEQ ID NO: 18209 - DNA, 27 bp, Artificial Sequence
  Description of Artificial Sequence: Synthetic oligonucleotide
caacagactgacagtttcccattcact

SEQ ID NO: 18210 - protein, 9 aa, Artificial Sequence
  Description of Artificial Sequence: Synthetic peptide
QQTDSFPFT

SEQ ID NO: 18211 - DNA, 27 bp, Artificial Sequence
  Description of Artificial Sequence: Synthetic oligonucleotide
ctacagcataatagttacccgctcact

SEQ ID NO: 18212 - protein, 9 aa, Artificial Sequence
  Description of Artificial Sequence: Synthetic peptide
LQHNSYPLT

SEQ ID NO: 18213 - DNA, 27 bp, Artificial Sequence
  Description of Artificial Sequence: Synthetic oligonucleotide
cagcaatattttagtactccgtacaat

SEQ ID NO: 18214 - protein, 9 aa, Artificial Sequence
  Description of Artificial Sequence: Synthetic peptide
QQYFSTPYN

SEQ ID NO: 18215 - DNA, 27 bp, Artificial Sequence
  Description of Artificial Sequence: Synthetic oligonucleotide
ctacaacattatagtttcccgtacagt

SEQ ID NO: 18216 - protein, 9 aa, Artificial Sequence
  Description of Artificial Sequence: Synthetic peptide
LQHYSFPYS

SEQ ID NO: 18217 - DNA, 27 bp, Artificial Sequence
  Description of Artificial Sequence: Synthetic oligonucleotide
caacagactgacagtttcccattcact

SEQ ID NO: 18218 - protein, 9 aa, Artificial Sequence
  Description of Artificial Sequence: Synthetic peptide
QQTDSFPFT

SEQ ID NO: 18219 - DNA, 27 bp, Artificial Sequence
  Description of Artificial Sequence: Synthetic oligonucleotide
cagcaatattatagtactccattcact

SEQ ID NO: 18220 - protein, 9 aa, Artificial Sequence
  Description of Artificial Sequence: Synthetic peptide
QQYYSTPFT

SEQ ID NO: 18221 - DNA, 27 bp, Artificial Sequence
  Description of Artificial Sequence: Synthetic oligonucleotide
ctacagcataatagttacccgctcact

SEQ ID NO: 18222 - protein, 9 aa, Artificial Sequence
  Description of Artificial Sequence: Synthetic peptide
LQHNSYPLT

SEQ ID NO: 18223 - DNA, 27 bp, Artificial Sequence
  Description of Artificial Sequence: Synthetic oligonucleotide
caacagtataataattacccgctcact

SEQ ID NO: 18224 - protein, 9 aa, Artificial Sequence
  Description of Artificial Sequence: Synthetic peptide
QQYNNYPLT

SEQ ID NO: 18225 - DNA, 27 bp, Artificial Sequence
  Description of Artificial Sequence: Synthetic oligonucleotide
atgcaaagtatacagcttccgtggacg

SEQ ID NO: 18226 - protein, 9 aa, Artificial Sequence
  Description of Artificial Sequence: Synthetic peptide
MQSIQLPWT

SEQ ID NO: 18227 - DNA, 24 bp, Artificial Sequence
  Description of Artificial Sequence: Synthetic oligonucleotide
caacagagttacagtatttacact

SEQ ID NO: 18228 - protein, 8 aa, Artificial Sequence
  Description of Artificial Sequence: Synthetic peptide
QQSYSIYT

SEQ ID NO: 18229 - DNA, 27 bp, Artificial Sequence
  Description of Artificial Sequence: Synthetic oligonucleotide
atgcaaggtatacagcttccgctcact

SEQ ID NO: 18230 - protein, 9 aa, Artificial Sequence
  Description of Artificial Sequence: Synthetic peptide
MQGIQLPLT

SEQ ID NO: 18231 - DNA, 24 bp, Artificial Sequence
  Description of Artificial Sequence: Synthetic oligonucleotide
caacagagtttcagtacccccact

SEQ ID NO: 18232 - protein, 8 aa, Artificial Sequence
  Description of Artificial Sequence: Synthetic peptide
QQSFSTPT

SEQ ID NO: 18233 - DNA, 30 bp, Artificial Sequence
  Description of Artificial Sequence: Synthetic oligonucleotide
cagcagtataatgactggcctccgtggacg

SEQ ID NO: 18234 - protein, 10 aa, Artificial Sequence
  Description of Artificial Sequence: Synthetic peptide
QQYNDWPPWT

SEQ ID NO: 18235 - DNA, 27 bp, Artificial Sequence
  Description of Artificial Sequence: Synthetic oligonucleotide
atgcaaagtatacaggttccgtggacg

SEQ ID NO: 18236 - protein, 9 aa, Artificial Sequence
  Description of Artificial Sequence: Synthetic peptide
MQSIQVPWT

SEQ ID NO: 18237 - DNA, 24 bp, Artificial Sequence
  Description of Artificial Sequence: Synthetic oligonucleotide
caacagagttacagtacccccact

SEQ ID NO: 18238 - protein, 8 aa, Artificial Sequence
  Description of Artificial Sequence: Synthetic peptide
QQSYSTPT

SEQ ID NO: 18239 - DNA, 27 bp, Artificial Sequence
  Description of Artificial Sequence: Synthetic oligonucleotide
catcagtataaacattacccgatcacc

SEQ ID NO: 18240 - protein, 9 aa, Artificial Sequence
  Description of Artificial Sequence: Synthetic peptide
HQYKHYPIT

SEQ ID NO: 18241 - DNA, 27 bp, Artificial Sequence
  Description of Artificial Sequence: Synthetic oligonucleotide
atgcaaagtatacagattccgtggacg

SEQ ID NO: 18242 - protein, 9 aa, Artificial Sequence
  Description of Artificial Sequence: Synthetic peptide
MQSIQIPWT

SEQ ID NO: 18243 - DNA, 24 bp, Artificial Sequence
  Description of Artificial Sequence: Synthetic oligonucleotide
caacagagttacagtacccccact

SEQ ID NO: 18244 - protein, 8 aa, Artificial Sequence
  Description of Artificial Sequence: Synthetic peptide
QQSYSTPT

SEQ ID NO: 18245 - DNA, 27 bp, Artificial Sequence
  Description of Artificial Sequence: Synthetic oligonucleotide
cagcaatattacagtactccattcact

SEQ ID NO: 18246 - protein, 9 aa, Artificial Sequence
  Description of Artificial Sequence: Synthetic peptide
QQYYSTPFT

SEQ ID NO: 18247 - DNA, 27 bp, Artificial Sequence
  Description of Artificial Sequence: Synthetic oligonucleotide
cagcaatattatagtactccgtgcagt

SEQ ID NO: 18248 - protein, 9 aa, Artificial Sequence
  Description of Artificial Sequence: Synthetic peptide
QQYYSTPCS

SEQ ID NO: 18249 - DNA, 27 bp, Artificial Sequence
  Description of Artificial Sequence: Synthetic oligonucleotide
cagcaatattttaatactcctcccact

SEQ ID NO: 18250 - protein, 9 aa, Artificial Sequence
  Description of Artificial Sequence: Synthetic peptide
QQYFNTPPT

SEQ ID NO: 18251 - DNA, 24 bp, Artificial Sequence
  Description of Artificial Sequence: Synthetic oligonucleotide
caacagagttacagtacccccact

SEQ ID NO: 18252 - protein, 8 aa, Artificial Sequence
  Description of Artificial Sequence: Synthetic peptide
QQSYSTPT

SEQ ID NO: 18253 - DNA, 27 bp, Artificial Sequence
  Description of Artificial Sequence: Synthetic oligonucleotide
atgcaaagtatacaggttccgtggacg

SEQ ID NO: 18254 - protein, 9 aa, Artificial Sequence
  Description of Artificial Sequence: Synthetic peptide
MQSIQVPWT

SEQ ID NO: 18255 - DNA, 27 bp, Artificial Sequence
  Description of Artificial Sequence: Synthetic oligonucleotide
caacaatatggtaggtcaccattcaat

SEQ ID NO: 18256 - protein, 9 aa, Artificial Sequence
  Description of Artificial Sequence: Synthetic peptide
QQYGRSPFN

SEQ ID NO: 18257 - DNA, 27 bp, Artificial Sequence
  Description of Artificial Sequence: Synthetic oligonucleotide
ctacagcattataatttcccgtacagt

SEQ ID NO: 18258 - protein, 9 aa, Artificial Sequence
  Description of Artificial Sequence: Synthetic peptide
LQHYNFPYS

SEQ ID NO: 18259 - DNA, 27 bp, Artificial Sequence
  Description of Artificial Sequence: Synthetic oligonucleotide
caacagactgacagtttcccattcact

SEQ ID NO: 18260 - protein, 9 aa, Artificial Sequence
  Description of Artificial Sequence: Synthetic peptide
QQTDSFPFT

SEQ ID NO: 18261 - DNA, 27 bp, Artificial Sequence
  Description of Artificial Sequence: Synthetic oligonucleotide
ctacagcatagtaattacccgctcact

SEQ ID NO: 18262 - protein, 9 aa, Artificial Sequence
  Description of Artificial Sequence: Synthetic peptide
LQHSNYPLT

SEQ ID NO: 18263 - DNA, 24 bp, Artificial Sequence
  Description of Artificial Sequence: Synthetic oligonucleotide
cagcaatattatcgtagtcctagt

SEQ ID NO: 18264 - protein, 8 aa, Artificial Sequence
  Description of Artificial Sequence: Synthetic peptide
QQYYRSPS

SEQ ID NO: 18265 - DNA, 27 bp, Artificial Sequence
  Description of Artificial Sequence: Synthetic oligonucleotide
caacagactgacagtttcccattcact

SEQ ID NO: 18266 - protein, 9 aa, Artificial Sequence
  Description of Artificial Sequence: Synthetic peptide
QQTDSFPFT

SEQ ID NO: 18267 - DNA, 24 bp, Artificial Sequence
  Description of Artificial Sequence: Synthetic oligonucleotide
caacagagttacagtacccccact

SEQ ID NO: 18268 - protein, 8 aa, Artificial Sequence
  Description of Artificial Sequence: Synthetic peptide
QQSYSTPT

SEQ ID NO: 18269 - DNA, 27 bp, Artificial Sequence
  Description of Artificial Sequence: Synthetic oligonucleotide
atgcaaagtatacagattccgtggacg

SEQ ID NO: 18270 - protein, 9 aa, Artificial Sequence
  Description of Artificial Sequence: Synthetic peptide
MQSIQIPWT

SEQ ID NO: 18271 - DNA, 27 bp, Artificial Sequence
  Description of Artificial Sequence: Synthetic oligonucleotide
caacaatattatagtggtccgtgcagt

SEQ ID NO: 18272 - protein, 9 aa, Artificial Sequence
  Description of Artificial Sequence: Synthetic peptide
QQYYSGPCS

SEQ ID NO: 18273 - DNA, 27 bp, Artificial Sequence
  Description of Artificial Sequence: Synthetic oligonucleotide
caacagtatcatagttacccattcact

SEQ ID NO: 18274 - protein, 9 aa, Artificial Sequence
  Description of Artificial Sequence: Synthetic peptide
QQYHSYPFT

SEQ ID NO: 18275 - DNA, 27 bp, Artificial Sequence
  Description of Artificial Sequence: Synthetic oligonucleotide
atgcaaagtatacaggttccgtggacg

SEQ ID NO: 18276 - protein, 9 aa, Artificial Sequence
  Description of Artificial Sequence: Synthetic peptide
MQSIQVPWT

SEQ ID NO: 18277 - DNA, 27 bp, Artificial Sequence
  Description of Artificial Sequence: Synthetic oligonucleotide
caacaatatggtaggtcaccattcaat

SEQ ID NO: 18278 - protein, 9 aa, Artificial Sequence
  Description of Artificial Sequence: Synthetic peptide
QQYGRSPFN

SEQ ID NO: 18279 - DNA, 24 bp, Artificial Sequence
  Description of Artificial Sequence: Synthetic oligonucleotide
cagcaatataatcgtagtcttagt

SEQ ID NO: 18280 - protein, 8 aa, Artificial Sequence
  Description of Artificial Sequence: Synthetic peptide
QQYNRSLS

SEQ ID NO: 18281 - DNA, 27 bp, Artificial Sequence
  Description of Artificial Sequence: Synthetic oligonucleotide
atgcaaaatataaagtatccgctcact

SEQ ID NO: 18282 - protein, 9 aa, Artificial Sequence
  Description of Artificial Sequence: Synthetic peptide
MQNIKYPLT

SEQ ID NO: 18283 - DNA, 27 bp, Artificial Sequence
  Description of Artificial Sequence: Synthetic oligonucleotide
cagcaatattatagtactccgtgcagt

SEQ ID NO: 18284 - protein, 9 aa, Artificial Sequence
  Description of Artificial Sequence: Synthetic peptide
QQYYSTPCS

SEQ ID NO: 18285 - DNA, 27 bp, Artificial Sequence
  Description of Artificial Sequence: Synthetic oligonucleotide
cagcattattatagtactccgtgcagt

SEQ ID NO: 18286 - protein, 9 aa, Artificial Sequence
  Description of Artificial Sequence: Synthetic peptide
QHYYSTPCS

SEQ ID NO: 18287 - DNA, 27 bp, Artificial Sequence
  Description of Artificial Sequence: Synthetic oligonucleotide
caacagggtaacagtttcccgctcact

SEQ ID NO: 18288 - protein, 9 aa, Artificial Sequence
  Description of Artificial Sequence: Synthetic peptide
QQGNSFPLT

SEQ ID NO: 18289 - DNA, 27 bp, Artificial Sequence
  Description of Artificial Sequence: Synthetic oligonucleotide
cagcaatattttagttctcctcggacg

SEQ ID NO: 18290 - protein, 9 aa, Artificial Sequence
  Description of Artificial Sequence: Synthetic peptide
QQYFSSPRT

SEQ ID NO: 18291 - DNA, 27 bp, Artificial Sequence
  Description of Artificial Sequence: Synthetic oligonucleotide
caccagactgacagtttcccattcact

SEQ ID NO: 18292 - protein, 9 aa, Artificial Sequence
  Description of Artificial Sequence: Synthetic peptide
HQTDSFPFT

SEQ ID NO: 18293 - DNA, 27 bp, Artificial Sequence
  Description of Artificial Sequence: Synthetic oligonucleotide
caccagactgacagtttcccattcact

SEQ ID NO: 18294 - protein, 9 aa, Artificial Sequence
  Description of Artificial Sequence: Synthetic peptide
HQTDSFPFT

SEQ ID NO: 18295 - DNA, 24 bp, Artificial Sequence
  Description of Artificial Sequence: Synthetic oligonucleotide
caacagagttacagtacccccact

SEQ ID NO: 18296 - protein, 8 aa, Artificial Sequence
  Description of Artificial Sequence: Synthetic peptide
QQSYSTPT

SEQ ID NO: 18297 - DNA, 27 bp, Artificial Sequence
  Description of Artificial Sequence: Synthetic oligonucleotide
atgcaaagtatacaggttccgtggacg

SEQ ID NO: 18298 - protein, 9 aa, Artificial Sequence
  Description of Artificial Sequence: Synthetic peptide
MQSIQVPWT

SEQ ID NO: 18299 - DNA, 27 bp, Artificial Sequence
  Description of Artificial Sequence: Synthetic oligonucleotide
cagcaatattatagtactccgtgcagt

SEQ ID NO: 18300 - protein, 9 aa, Artificial Sequence
  Description of Artificial Sequence: Synthetic peptide
QQYYSTPCS

SEQ ID NO: 18301 - DNA, 27 bp, Artificial Sequence
  Description of Artificial Sequence: Synthetic oligonucleotide
caacaatattatagtactccgtgcagt

SEQ ID NO: 18302 - protein, 9 aa, Artificial Sequence
  Description of Artificial Sequence: Synthetic peptide
QQYYSTPCS

SEQ ID NO: 18303 - DNA, 30 bp, Artificial Sequence
  Description of Artificial Sequence: Synthetic oligonucleotide
cagcagtatgatgactggcctccgtggacg

SEQ ID NO: 18304 - protein, 10 aa, Artificial Sequence
  Description of Artificial Sequence: Synthetic peptide
QQYDDWPPWT

SEQ ID NO: 18305 - DNA, 27 bp, Artificial Sequence
  Description of Artificial Sequence: Synthetic oligonucleotide
ctacagcatagtaattacccgctcact

SEQ ID NO: 18306 - protein, 9 aa, Artificial Sequence
  Description of Artificial Sequence: Synthetic peptide
LQHSNYPLT

SEQ ID NO: 18307 - DNA, 27 bp, Artificial Sequence
  Description of Artificial Sequence: Synthetic oligonucleotide
caccaatattatagtactccgtgcagt

SEQ ID NO: 18308 - protein, 9 aa, Artificial Sequence
  Description of Artificial Sequence: Synthetic peptide
HQYYSTPCS

SEQ ID NO: 18309 - DNA, 24 bp, Artificial Sequence
  Description of Artificial Sequence: Synthetic oligonucleotide
caacagagttacagtgcccccact

SEQ ID NO: 18310 - protein, 8 aa, Artificial Sequence
  Description of Artificial Sequence: Synthetic peptide
QQSYSAPT

SEQ ID NO: 18311 - DNA, 27 bp, Artificial Sequence
  Description of Artificial Sequence: Synthetic oligonucleotide
caacagtataatagttttccattcact

SEQ ID NO: 18312 - protein, 9 aa, Artificial Sequence
  Description of Artificial Sequence: Synthetic peptide
QQYNSFPFT

SEQ ID NO: 18313 - DNA, 27 bp, Artificial Sequence
  Description of Artificial Sequence: Synthetic oligonucleotide
caacaatatcatagttacccattcact

SEQ ID NO: 18314 - protein, 9 aa, Artificial Sequence
  Description of Artificial Sequence: Synthetic peptide
QQYHSYPFT

SEQ ID NO: 18315 - DNA, 27 bp, Artificial Sequence
  Description of Artificial Sequence: Synthetic oligonucleotide
ctacagcataatagttacccattcact

SEQ ID NO: 18316 - protein, 9 aa, Artificial Sequence
  Description of Artificial Sequence: Synthetic peptide
LQHNSYPFT

SEQ ID NO: 18317 - DNA, 30 bp, Artificial Sequence; identical to SEQ ID NO: 16393
  Description of Artificial Sequence: Synthetic oligonucleotide

SEQ ID NO: 18318 - protein, 10 aa, Artificial Sequence
  Description of Artificial Sequence: Synthetic peptide
QQSYNTPTWT

SEQ ID NO: 18319 - DNA, 27 bp, Artificial Sequence
  Description of Artificial Sequence: Synthetic oligonucleotide
caacagtatcatagttatccattcact

SEQ ID NO: 18320 - protein, 9 aa, Artificial Sequence
  Description of Artificial Sequence: Synthetic peptide
QQYHSYPFT

SEQ ID NO: 18321 - DNA, 27 bp, Artificial Sequence
  Description of Artificial Sequence: Synthetic oligonucleotide
ctacaggataatagttacccattcact

SEQ ID NO: 18322 - protein, 9 aa, Artificial Sequence
  Description of Artificial Sequence: Synthetic peptide
LQDNSYPFT

SEQ ID NO: 18323 - DNA, 27 bp, Artificial Sequence
  Description of Artificial Sequence: Synthetic oligonucleotide
caacagtataatagttatccattcact

SEQ ID NO: 18324 - protein, 9 aa, Artificial Sequence
  Description of Artificial Sequence: Synthetic peptide
QQYNSYPFT

SEQ ID NO: 18325 - DNA, 27 bp, Artificial Sequence
  Description of Artificial Sequence: Synthetic oligonucleotide
caagagagttatagtatccgcttcgcc

SEQ ID NO: 18326 - protein, 9 aa, Artificial Sequence
  Description of Artificial Sequence: Synthetic peptide
QESYSIRFA

SEQ ID NO: 18327 - DNA, 27 bp, Artificial Sequence
  Description of Artificial Sequence: Synthetic oligonucleotide
atacaggataatagtcacccattcact

SEQ ID NO: 18328 - protein, 9 aa, Artificial Sequence
  Description of Artificial Sequence: Synthetic peptide
IQDNSHPFT

SEQ ID NO: 18329 - DNA, 27 bp, Artificial Sequence
  Description of Artificial Sequence: Synthetic oligonucleotide
caacagtatcatagttacccgatcacc

SEQ ID NO: 18330 - protein, 9 aa, Artificial Sequence
  Description of Artificial Sequence: Synthetic peptide
QQYHSYPIT

SEQ ID NO: 18331 - DNA, 27 bp, Artificial Sequence
  Description of Artificial Sequence: Synthetic oligonucleotide
atgcaaagtatacaggttccgtggacg

SEQ ID NO: 18332 - protein, 9 aa, Artificial Sequence
  Description of Artificial Sequence: Synthetic peptide
MQSIQVPWT

SEQ ID NO: 18333 - DNA, 27 bp, Artificial Sequence
  Description of Artificial Sequence: Synthetic oligonucleotide
ctacagcataatagttacccattcact

SEQ ID NO: 18334 - protein, 9 aa, Artificial Sequence
  Description of Artificial Sequence: Synthetic peptide
LQHNSYPFT

SEQ ID NO: 18335 - DNA, 27 bp, Artificial Sequence
  Description of Artificial Sequence: Synthetic oligonucleotide
caacagtatcatagttacccattcact

SEQ ID NO: 18336 - protein, 9 aa, Artificial Sequence
  Description of Artificial Sequence: Synthetic peptide
QQYHSYPFT

SEQ ID NO: 18337 - DNA, 27 bp, Artificial Sequence
  Description of Artificial Sequence: Synthetic oligonucleotide
ctacagcattatagttacccattcact

SEQ ID NO: 18338 - protein, 9 aa, Artificial Sequence
  Description of Artificial Sequence: Synthetic peptide
LQHYSYPFT

SEQ ID NO: 18339 - DNA, 27 bp, Artificial Sequence
  Description of Artificial Sequence: Synthetic oligonucleotide
ctacagcataatagttacccgtggacg

SEQ ID NO: 18340 - protein, 9 aa, Artificial Sequence
  Description of Artificial Sequence: Synthetic peptide
LQHNSYPWT

SEQ ID NO: 18341 - DNA, 27 bp, Artificial Sequence
  Description of Artificial Sequence: Synthetic oligonucleotide
ctacagcattatagttaccctcggacg

SEQ ID NO: 18342 - protein, 9 aa, Artificial Sequence
  Description of Artificial Sequence: Synthetic peptide
LQHYSYPRT

SEQ ID NO: 18343 - DNA, 27 bp, Artificial Sequence
  Description of Artificial Sequence: Synthetic oligonucleotide
caacagagttacaatatttcattcact

SEQ ID NO: 18344 - protein, 9 aa, Artificial Sequence
  Description of Artificial Sequence: Synthetic peptide
QQSYNISFT

SEQ ID NO: 18345 - DNA, 27 bp, Artificial Sequence
  Description of Artificial Sequence: Synthetic oligonucleotide
ctacaggataatagtcacccattcact

SEQ ID NO: 18346 - protein, 9 aa, Artificial Sequence
  Description of Artificial Sequence: Synthetic peptide
LQDNSHPFT

SEQ ID NO: 18347 - DNA, 27 bp, Artificial Sequence
  Description of Artificial Sequence: Synthetic oligonucleotide
gtacagcataatagttaccctctcact

SEQ ID NO: 18348 - protein, 9 aa, Artificial Sequence
  Description of Artificial Sequence: Synthetic peptide
VQHNSYPLT

SEQ ID NO: 18349 - DNA, 27 bp, Artificial Sequence
  Description of Artificial Sequence: Synthetic oligonucleotide
ctacagcataatagttacccattcact

SEQ ID NO: 18350 - protein, 9 aa, Artificial Sequence
  Description of Artificial Sequence: Synthetic peptide
LQHNSYPFT

SEQ ID NO: 18351 - DNA, 27 bp, Artificial Sequence
  Description of Artificial Sequence: Synthetic oligonucleotide
ctacagcataatagttacccattcact

SEQ ID NO: 18352 - protein, 9 aa, Artificial Sequence
  Description of Artificial Sequence: Synthetic peptide
LQHNSYPFT

SEQ ID NO: 18353 - DNA, 27 bp, Artificial Sequence
  Description of Artificial Sequence: Synthetic oligonucleotide
cagcaatattatagtactcctccgacg

SEQ ID NO: 18354 - protein, 9 aa, Artificial Sequence
  Description of Artificial Sequence: Synthetic peptide
QQYYSTPPT

SEQ ID NO: 18355 - DNA, 27 bp, Artificial Sequence
  Description of Artificial Sequence: Synthetic oligonucleotide
caacagtatcatagttacccattcact

SEQ ID NO: 18356 - protein, 9 aa, Artificial Sequence
  Description of Artificial Sequence: Synthetic peptide
QQYHSYPFT

SEQ ID NO: 18357 - DNA, 27 bp, Artificial Sequence
  Description of Artificial Sequence: Synthetic oligonucleotide
ctacagcatcatagtttcccgatcacc

SEQ ID NO: 18358 - protein, 9 aa, Artificial Sequence
  Description of Artificial Sequence: Synthetic peptide
LQHHSFPIT

SEQ ID NO: 18359 - DNA, 27 bp, Artificial Sequence
  Description of Artificial Sequence: Synthetic oligonucleotide
caacagagttacagtctcccggtcact

SEQ ID NO: 18360 - protein, 9 aa, Artificial Sequence
  Description of Artificial Sequence: Synthetic peptide
QQSYSLPVT

SEQ ID NO: 18361 - DNA, 27 bp, Artificial Sequence
  Description of Artificial Sequence: Synthetic oligonucleotide
caacaatatgataatctcccgatcacc

SEQ ID NO: 18362 - protein, 9 aa, Artificial Sequence
  Description of Artificial Sequence: Synthetic peptide
QQYDNLPIT

SEQ ID NO: 18363 - DNA, 27 bp, Artificial Sequence
  Description of Artificial Sequence: Synthetic oligonucleotide
ctacagcataatagttatccattcact

SEQ ID NO: 18364 - protein, 9 aa, Artificial Sequence
  Description of Artificial Sequence: Synthetic peptide
LQHNSYPFT

SEQ ID NO: 18365 - DNA, 27 bp, Artificial Sequence
  Description of Artificial Sequence: Synthetic oligonucleotide
ctacagcatcatagttatcctcggacg

SEQ ID NO: 18366 - protein, 9 aa, Artificial Sequence
  Description of Artificial Sequence: Synthetic peptide
LQHHSYPRT

SEQ ID NO: 18367 - DNA, 27 bp, Artificial Sequence
  Description of Artificial Sequence: Synthetic oligonucleotide
ctacagcattatagttaccctcggacg

SEQ ID NO: 18368 - protein, 9 aa, Artificial Sequence
  Description of Artificial Sequence: Synthetic peptide
LQHYSYPRT

SEQ ID NO: 18369 - DNA, 27 bp, Artificial Sequence
  Description of Artificial Sequence: Synthetic oligonucleotide
caacagtataatagttacccattcact

SEQ ID NO: 18370 - protein, 9 aa, Artificial Sequence
  Description of Artificial Sequence: Synthetic peptide
QQYNSYPFT

SEQ ID NO: 18371 - DNA, 27 bp, Artificial Sequence
  Description of Artificial Sequence: Synthetic oligonucleotide
atgcaaagtatacagattccgtggacg

SEQ ID NO: 18372 - protein, 9 aa, Artificial Sequence
  Description of Artificial Sequence: Synthetic peptide
MQSIQIPWT

SEQ ID NO: 18373 - DNA, 27 bp, Artificial Sequence
  Description of Artificial Sequence: Synthetic oligonucleotide
caacaatatcatagttacccattcact

SEQ ID NO: 18374 - protein, 9 aa, Artificial Sequence
  Description of Artificial Sequence: Synthetic peptide
QQYHSYPFT

SEQ ID NO: 18375 - DNA, 27 bp, Artificial Sequence
  Description of Artificial Sequence: Synthetic oligonucleotide
ctacagcataatagtttcccgtggacg

SEQ ID NO: 18376 - protein, 9 aa, Artificial Sequence
  Description of Artificial Sequence: Synthetic peptide
LQHNSFPWT

SEQ ID NO: 18377 - DNA, 27 bp, Artificial Sequence
  Description of Artificial Sequence: Synthetic oligonucleotide
ctacagcataatagttacccgtggacg

SEQ ID NO: 18378 - protein, 9 aa, Artificial Sequence
  Description of Artificial Sequence: Synthetic peptide
LQHNSYPWT

SEQ ID NO: 18379 - DNA, 27 bp, Artificial Sequence
  Description of Artificial Sequence: Synthetic oligonucleotide
caacaatatcatagttacccattcact

SEQ ID NO: 18380 - protein, 9 aa, Artificial Sequence
  Description of Artificial Sequence: Synthetic peptide
QQYHSYPFT

SEQ ID NO: 18381 - DNA, 27 bp, Artificial Sequence
  Description of Artificial Sequence: Synthetic oligonucleotide
ctacagcatagtaattacccgctcact

SEQ ID NO: 18382 - protein, 9 aa, Artificial Sequence
  Description of Artificial Sequence: Synthetic peptide
LQHSNYPLT

SEQ ID NO: 18383 - DNA, 27 bp, Artificial Sequence
  Description of Artificial Sequence: Synthetic oligonucleotide
cagcaatattataatagtccgtgcagt

SEQ ID NO: 18384 - protein, 9 aa, Artificial Sequence
  Description of Artificial Sequence: Synthetic peptide
QQYYNSPCS

SEQ ID NO: 18385 - DNA, 27 bp, Artificial Sequence
  Description of Artificial Sequence: Synthetic oligonucleotide
ctacagcattatagttatcctcggacg

SEQ ID NO: 18386 - protein, 9 aa, Artificial Sequence
  Description of Artificial Sequence: Synthetic peptide
LQHYSYPRT

SEQ ID NO: 18387 - DNA, 27 bp, Artificial Sequence
  Description of Artificial Sequence: Synthetic oligonucleotide
atacaggataatagtcacccattcact

SEQ ID NO: 18388 - protein, 9 aa, Artificial Sequence
  Description of Artificial Sequence: Synthetic peptide
IQDNSHPFT

SEQ ID NO: 18389 - DNA, 27 bp, Artificial Sequence
  Description of Artificial Sequence: Synthetic oligonucleotide
caacagtataatagttaccctctcact

SEQ ID NO: 18390 - protein, 9 aa, Artificial Sequence
  Description of Artificial Sequence: Synthetic peptide
QQYNSYPLT

SEQ ID NO: 18391 - DNA, 27 bp, Artificial Sequence
  Description of Artificial Sequence: Synthetic oligonucleotide
ctacagcatagtagttacccgctcact

SEQ ID NO: 18392 - protein, 9 aa, Artificial Sequence
  Description of Artificial Sequence: Synthetic peptide
LQHSSYPLT

SEQ ID NO: 18393 - DNA, 27 bp, Artificial Sequence
  Description of Artificial Sequence: Synthetic oligonucleotide
atgcaaagtatacagcttccgtggacg

SEQ ID NO: 18394 - protein, 9 aa, Artificial Sequence
  Description of Artificial Sequence: Synthetic peptide
MQSIQLPWT

SEQ ID NO: 18395 - DNA, 24 bp, Artificial Sequence
  Description of Artificial Sequence: Synthetic oligonucleotide
cagcagtataataactggtggacg

SEQ ID NO: 18396 - protein, 8 aa, Artificial Sequence
  Description of Artificial Sequence: Synthetic peptide
QQYNNWWT

SEQ ID NO: 18397 - DNA, 27 bp, Artificial Sequence
  Description of Artificial Sequence: Synthetic oligonucleotide
caacagtatgatattctcccgatcacc

SEQ ID NO: 18398 - protein, 9 aa, Artificial Sequence
  Description of Artificial Sequence: Synthetic peptide
QQYDILPIT

SEQ ID NO: 18399 - DNA, 27 bp, Artificial Sequence
  Description of Artificial Sequence: Synthetic oligonucleotide
ctactatatattcgttacccattcact

SEQ ID NO: 18400 - protein, 9 aa, Artificial Sequence
  Description of Artificial Sequence: Synthetic peptide
LLYIRYPFT

SEQ ID NO: 18401 - DNA, 27 bp, Artificial Sequence
  Description of Artificial Sequence: Synthetic oligonucleotide
caacagtatgaaaatctcccgctcacc

SEQ ID NO: 18402 - protein, 9 aa, Artificial Sequence
  Description of Artificial Sequence: Synthetic peptide
QQYENLPLT

SEQ ID NO: 18403 - DNA, 27 bp, Artificial Sequence
  Description of Artificial Sequence: Synthetic oligonucleotide
ctacaatataatcgttacccattcact

SEQ ID NO: 18404 - protein, 9 aa, Artificial Sequence
  Description of Artificial Sequence: Synthetic peptide
LQYNRYPFT

SEQ ID NO: 18405 - DNA, 27 bp, Artificial Sequence
  Description of Artificial Sequence: Synthetic oligonucleotide
ctacagcatcatagttatcctcggacg

SEQ ID NO: 18406 - protein, 9 aa, Artificial Sequence
  Description of Artificial Sequence: Synthetic peptide
LQHHSYPRT

SEQ ID NO: 18407 - DNA, 27 bp, Artificial Sequence
  Description of Artificial Sequence: Synthetic oligonucleotide
atacaggataatagtcacccattcact

SEQ ID NO: 18408 - protein, 9 aa, Artificial Sequence
  Description of Artificial Sequence: Synthetic peptide
IQDNSHPFT

SEQ ID NO: 18409 - DNA, 27 bp, Artificial Sequence
  Description of Artificial Sequence: Synthetic oligonucleotide
ctacaggataatagtcacccattcact

SEQ ID NO: 18410 - protein, 9 aa, Artificial Sequence
  Description of Artificial Sequence: Synthetic peptide
LQDNSHPFT

SEQ ID NO: 18411 - DNA, 27 bp, Artificial Sequence
  Description of Artificial Sequence: Synthetic oligonucleotide
cagcaatattatagtactcctcccact

SEQ ID NO: 18412 - protein, 9 aa, Artificial Sequence
  Description of Artificial Sequence: Synthetic peptide
QQYYSTPPT

SEQ ID NO: 18413 - DNA, 27 bp, Artificial Sequence
  Description of Artificial Sequence: Synthetic oligonucleotide
cagcaatattatagtactcctccgacg

SEQ ID NO: 18414 - protein, 9 aa, Artificial Sequence
  Description of Artificial Sequence: Synthetic peptide
QQYYSTPPT

SEQ ID NO: 18415 - DNA, 27 bp, Artificial Sequence
  Description of Artificial Sequence: Synthetic oligonucleotide
aagcaaagtatacagcttccgtggacg

SEQ ID NO: 18416 - protein, 9 aa, Artificial Sequence
  Description of Artificial Sequence: Synthetic peptide
KQSIQLPWT

SEQ ID NO: 18417 - DNA, 27 bp, Artificial Sequence
  Description of Artificial Sequence: Synthetic oligonucleotide
caacagtataatagttacccattcact

SEQ ID NO: 18418 - protein, 9 aa, Artificial Sequence
  Description of Artificial Sequence: Synthetic peptide
QQYNSYPFT

SEQ ID NO: 18419 - DNA, 27 bp, Artificial Sequence
  Description of Artificial Sequence: Synthetic oligonucleotide
ctacagcataatagtcacccattcact

SEQ ID NO: 18420 - protein, 9 aa, Artificial Sequence
  Description of Artificial Sequence: Synthetic peptide
LQHNSHPFT

SEQ ID NO: 18421 - DNA, 27 bp, Artificial Sequence
  Description of Artificial Sequence: Synthetic oligonucleotide
caacagtatcatagttacccgctcact

SEQ ID NO: 18422 - protein, 9 aa, Artificial Sequence
  Description of Artificial Sequence: Synthetic peptide
QQYHSYPLT

SEQ ID NO: 18423 - DNA, 27 bp, Artificial Sequence
  Description of Artificial Sequence: Synthetic oligonucleotide
ctacaggataatagttacccattcact

SEQ ID NO: 18424 - protein, 9 aa, Artificial Sequence
  Description of Artificial Sequence: Synthetic peptide
LQDNSYPFT

SEQ ID NO: 18425 - DNA, 27 bp, Artificial Sequence
  Description of Artificial Sequence: Synthetic oligonucleotide
ctacaggattatagttacccattcact

SEQ ID NO: 18426 - protein, 9 aa, Artificial Sequence
  Description of Artificial Sequence: Synthetic peptide
LQDYSYPFT

SEQ ID NO: 18427 - DNA, 27 bp, Artificial Sequence
  Description of Artificial Sequence: Synthetic oligonucleotide
cagcaatcttatagtattcctcccact

SEQ ID NO: 18428 - protein, 9 aa, Artificial Sequence
  Description of Artificial Sequence: Synthetic peptide
QQSYSIPPT

SEQ ID NO: 18429 - DNA, 27 bp, Artificial Sequence
  Description of Artificial Sequence: Synthetic oligonucleotide
caacagtataatagtttcccgctcact

SEQ ID NO: 18430 - protein, 9 aa, Artificial Sequence
  Description of Artificial Sequence: Synthetic peptide
QQYNSFPLT

SEQ ID NO: 18431 - DNA, 27 bp, Artificial Sequence
  Description of Artificial Sequence: Synthetic oligonucleotide
atgcaaagcatacagcttccgtggacg

SEQ ID NO: 18432 - protein, 9 aa, Artificial Sequence
  Description of Artificial Sequence: Synthetic peptide
MQSIQLPWT

SEQ ID NO: 18433 - DNA, 27 bp, Artificial Sequence
  Description of Artificial Sequence: Synthetic oligonucleotide
atgcaaagcatacagcttccgtggacg

SEQ ID NO: 18434 - protein, 9 aa, Artificial Sequence
  Description of Artificial Sequence: Synthetic peptide
MQSIQLPWT

SEQ ID NO: 18435 - DNA, 27 bp, Artificial Sequence
  Description of Artificial Sequence: Synthetic oligonucleotide
caacagtataatagttatccattcact

SEQ ID NO: 18436 - protein, 9 aa, Artificial Sequence
  Description of Artificial Sequence: Synthetic peptide
QQYNSYPFT

SEQ ID NO: 18437 - DNA, 27 bp, Artificial Sequence
  Description of Artificial Sequence: Synthetic oligonucleotide
ctacagcattatagttacccgctcact

SEQ ID NO: 18438 - protein, 9 aa, Artificial Sequence
  Description of Artificial Sequence: Synthetic peptide
LQHYSYPLT

SEQ ID NO: 18439 - DNA, 24 bp, Artificial Sequence
  Description of Artificial Sequence: Synthetic oligonucleotide
cagcaatattatcgtgctcccacc

SEQ ID NO: 18440 - protein, 8 aa, Artificial Sequence
  Description of Artificial Sequence: Synthetic peptide
QQYYRAPT

SEQ ID NO: 18441 - DNA, 27 bp, Artificial Sequence
  Description of Artificial Sequence: Synthetic oligonucleotide
atgcaagttctacaaactccgtggacg

SEQ ID NO: 18442 - protein, 9 aa, Artificial Sequence
  Description of Artificial Sequence: Synthetic peptide
MQVLQTPWT

SEQ ID NO: 18443 - DNA, 27 bp, Artificial Sequence
  Description of Artificial Sequence: Synthetic oligonucleotide
ctacagcattatagttacccgctcact

SEQ ID NO: 18444 - protein, 9 aa, Artificial Sequence
  Description of Artificial Sequence: Synthetic peptide
LQHYSYPLT

SEQ ID NO: 18445 - DNA, 24 bp, Artificial Sequence
  Description of Artificial Sequence: Synthetic oligonucleotide
cagcaatattatcgtgctcccacc

SEQ ID NO: 18446 - protein, 8 aa, Artificial Sequence
  Description of Artificial Sequence: Synthetic peptide
QQYYRAPT

SEQ ID NO: 18447 - DNA, 27 bp, Artificial Sequence
  Description of Artificial Sequence: Synthetic oligonucleotide
atgcaagttctacaaactccgtggacg

SEQ ID NO: 18448 - protein, 9 aa, Artificial Sequence
  Description of Artificial Sequence: Synthetic peptide
MQVLQTPWT

SEQ ID NO: 18449 - DNA, 27 bp, Artificial Sequence
  Description of Artificial Sequence: Synthetic oligonucleotide
ctacagcatcatagttgcccgtggacg

SEQ ID NO: 18450 - protein, 9 aa, Artificial Sequence
  Description of Artificial Sequence: Synthetic peptide
LQHHSCPWT

SEQ ID NO: 18451 - DNA, 27 bp, Artificial Sequence
  Description of Artificial Sequence: Synthetic oligonucleotide
caacaatctgatagttaccctctcact

SEQ ID NO: 18452 - protein, 9 aa, Artificial Sequence
  Description of Artificial Sequence: Synthetic peptide
QQSDSYPLT

SEQ ID NO: 18453 - DNA, 27 bp, Artificial Sequence
  Description of Artificial Sequence: Synthetic oligonucleotide
caacagtatcatagttacccattcact

SEQ ID NO: 18454 - protein, 9 aa, Artificial Sequence
  Description of Artificial Sequence: Synthetic peptide
QQYHSYPFT

SEQ ID NO: 18455 - DNA, 27 bp, Artificial Sequence
  Description of Artificial Sequence: Synthetic oligonucleotide
cttcagcattatagttaccctcggacg

SEQ ID NO: 18456 - protein, 9 aa, Artificial Sequence
  Description of Artificial Sequence: Synthetic peptide
LQHYSYPRT

SEQ ID NO: 18457 - DNA, 27 bp, Artificial Sequence
  Description of Artificial Sequence: Synthetic oligonucleotide
atgcaaagtattcagcttccgtggacg

SEQ ID NO: 18458 - protein, 9 aa, Artificial Sequence
  Description of Artificial Sequence: Synthetic peptide
MQSIQLPWT

SEQ ID NO: 18459 - DNA, 27 bp, Artificial Sequence
  Description of Artificial Sequence: Synthetic oligonucleotide
caacagtatcatagttacccattcact

SEQ ID NO: 18460 - protein, 9 aa, Artificial Sequence
  Description of Artificial Sequence: Synthetic peptide
QQYHSYPFT

SEQ ID NO: 18461 - DNA, 27 bp, Artificial Sequence
  Description of Artificial Sequence: Synthetic oligonucleotide
ctacagcatagtagtaacccgtggacg

SEQ ID NO: 18462 - protein, 9 aa, Artificial Sequence
  Description of Artificial Sequence: Synthetic peptide
LQHSSNPWT

SEQ ID NO: 18463 - DNA, 27 bp, Artificial Sequence
  Description of Artificial Sequence: Synthetic oligonucleotide
ctacagcattatagttaccctcggacg

SEQ ID NO: 18464 - protein, 9 aa, Artificial Sequence
  Description of Artificial Sequence: Synthetic peptide
LQHYSYPRT

SEQ ID NO: 18465 - DNA, 27 bp, Artificial Sequence
  Description of Artificial Sequence: Synthetic oligonucleotide
ctacagcattatagttacccgctcact

SEQ ID NO: 18466 - protein, 9 aa, Artificial Sequence
  Description of Artificial Sequence: Synthetic peptide
LQHYSYPLT

SEQ ID NO: 18467 - DNA, 27 bp, Artificial Sequence
  Description of Artificial Sequence: Synthetic oligonucleotide
ctacagcattatagtttcccgctcact

SEQ ID NO: 18468 - protein, 9 aa, Artificial Sequence
  Description of Artificial Sequence: Synthetic peptide
LQHYSFPLT

SEQ ID NO: 18469 - DNA, 27 bp, Artificial Sequence
  Description of Artificial Sequence: Synthetic oligonucleotide
ctacagcattatagttacccgctcact

SEQ ID NO: 18470 - protein, 9 aa, Artificial Sequence
  Description of Artificial Sequence: Synthetic peptide
LQHYSYPLT

SEQ ID NO: 18471 - DNA, 27 bp, Artificial Sequence
  Description of Artificial Sequence: Synthetic oligonucleotide
caacaatctgatagttaccctctcact

SEQ ID NO: 18472 - protein, 9 aa, Artificial Sequence
  Description of Artificial Sequence: Synthetic peptide
QQSDSYPLT

SEQ ID NO: 18473 - DNA, 27 bp, Artificial Sequence
  Description of Artificial Sequence: Synthetic oligonucleotide
cagcaatattatagtactccgtggacg

SEQ ID NO: 18474 - protein, 9 aa, Artificial Sequence
  Description of Artificial Sequence: Synthetic peptide
QQYYSTPWT

SEQ ID NO: 18475 - DNA, 27 bp, Artificial Sequence
  Description of Artificial Sequence: Synthetic oligonucleotide
ctacagcattatagtttcccgctcact

SEQ ID NO: 18476 - protein, 9 aa, Artificial Sequence
  Description of Artificial Sequence: Synthetic peptide
LQHYSFPLT

SEQ ID NO: 18477 - DNA, 27 bp, Artificial Sequence
  Description of Artificial Sequence: Synthetic oligonucleotide
ctacagcattatagttacccgctcact

SEQ ID NO: 18478 - protein, 9 aa, Artificial Sequence
  Description of Artificial Sequence: Synthetic peptide
LQHYSYPLT

SEQ ID NO: 18479 - DNA, 27 bp, Artificial Sequence
  Description of Artificial Sequence: Synthetic oligonucleotide
ctacagcattatagttacccgctcact

SEQ ID NO: 18480 - protein, 9 aa, Artificial Sequence
  Description of Artificial Sequence: Synthetic peptide
LQHYSYPLT

SEQ ID NO: 18481 - DNA, 27 bp, Artificial Sequence
  Description of Artificial Sequence: Synthetic oligonucleotide
caacaggctaacagtttcccgtggacg

SEQ ID NO: 18482 - protein, 9 aa, Artificial Sequence
  Description of Artificial Sequence: Synthetic peptide
QQANSFPWT

SEQ ID NO: 18483 - DNA, 27 bp, Artificial Sequence
  Description of Artificial Sequence: Synthetic oligonucleotide
atgcaaactctacaaactccgctcact

SEQ ID NO: 18484 - protein, 9 aa, Artificial Sequence
  Description of Artificial Sequence: Synthetic peptide
MQTLQTPLT

SEQ ID NO: 18485 - DNA, 27 bp, Artificial Sequence
  Description of Artificial Sequence: Synthetic oligonucleotide
caacagactaacagtttcccgtggacg

SEQ ID NO: 18486 - protein, 9 aa, Artificial Sequence
  Description of Artificial Sequence: Synthetic peptide
QQTNSFPWT

SEQ ID NO: 18487 - DNA, 27 bp, Artificial Sequence
  Description of Artificial Sequence: Synthetic oligonucleotide
ctacagactaacagtttcccgtggacg

SEQ ID NO: 18488 - protein, 9 aa, Artificial Sequence
  Description of Artificial Sequence: Synthetic peptide
LQTNSFPWT

SEQ ID NO: 18489 - DNA, 27 bp, Artificial Sequence
  Description of Artificial Sequence: Synthetic oligonucleotide
ctacaggatcatagttacccattcact

SEQ ID NO: 18490 - protein, 9 aa, Artificial Sequence
  Description of Artificial Sequence: Synthetic peptide
LQDHSYPFT

SEQ ID NO: 18491 - DNA, 27 bp, Artificial Sequence
  Description of Artificial Sequence: Synthetic oligonucleotide
ctacagcattatagttacccgctcact

SEQ ID NO: 18492 - protein, 9 aa, Artificial Sequence
  Description of Artificial Sequence: Synthetic peptide
LQHYSYPLT

SEQ ID NO: 18493 - DNA, 27 bp, Artificial Sequence
  Description of Artificial Sequence: Synthetic oligonucleotide
atgcaaagtatacagtttccgtggacg

SEQ ID NO: 18494 - protein, 9 aa, Artificial Sequence
  Description of Artificial Sequence: Synthetic peptide
MQSIQFPWT

SEQ ID NO: 18495 - DNA, 27 bp, Artificial Sequence
  Description of Artificial Sequence: Synthetic oligonucleotide
ctacaccattatagtttcccgctcact

SEQ ID NO: 18496 - protein, 9 aa, Artificial Sequence
  Description of Artificial Sequence: Synthetic peptide
LHHYSFPLT

SEQ ID NO: 18497 - DNA, 27 bp, Artificial Sequence
  Description of Artificial Sequence: Synthetic oligonucleotide
cagcaatattttactactccgtgcagt

SEQ ID NO: 18498 - protein, 9 aa, Artificial Sequence
  Description of Artificial Sequence: Synthetic peptide
QQYFTTPCS

SEQ ID NO: 18499 - DNA, 30 bp, Artificial Sequence
  Description of Artificial Sequence: Synthetic oligonucleotide
caacagagttacagaacccctcagtggacg

SEQ ID NO: 18500 - protein, 10 aa, Artificial Sequence
  Description of Artificial Sequence: Synthetic peptide
QQSYRTPQWT

SEQ ID NO: 18501 - DNA, 27 bp, Artificial Sequence
  Description of Artificial Sequence: Synthetic oligonucleotide
atgcaaagtatacaggttccgtggacg

SEQ ID NO: 18502 - protein, 9 aa, Artificial Sequence
  Description of Artificial Sequence: Synthetic peptide
MQSIQVPWT

SEQ ID NO: 18503 - DNA, 24 bp, Artificial Sequence
  Description of Artificial Sequence: Synthetic oligonucleotide
atgcaaagtatacagcttctcact

SEQ ID NO: 18504 - protein, 8 aa, Artificial Sequence
  Description of Artificial Sequence: Synthetic peptide
MQSIQLLT

SEQ ID NO: 18505 - DNA, 27 bp, Artificial Sequence
  Description of Artificial Sequence: Synthetic oligonucleotide
ctacagcattatagtttcccgaacact

SEQ ID NO: 18506 - protein, 9 aa, Artificial Sequence
  Description of Artificial Sequence: Synthetic peptide
LQHYSFPNT

SEQ ID NO: 18507 - DNA, 27 bp, Artificial Sequence
  Description of Artificial Sequence: Synthetic oligonucleotide
cagcaatattatcgtactccgtggacg

SEQ ID NO: 18508 - protein, 9 aa, Artificial Sequence
  Description of Artificial Sequence: Synthetic peptide
QQYYRTPWT

SEQ ID NO: 18509 - DNA, 27 bp, Artificial Sequence
  Description of Artificial Sequence: Synthetic oligonucleotide
caacagactaacagtttcccgtggacg

SEQ ID NO: 18510 - protein, 9 aa, Artificial Sequence
  Description of Artificial Sequence: Synthetic peptide
QQTNSFPWT

SEQ ID NO: 18511 - DNA, 27 bp, Artificial Sequence
  Description of Artificial Sequence: Synthetic oligonucleotide
cttcagcatcatagttaccctcggacg

SEQ ID NO: 18512 - protein, 9 aa, Artificial Sequence
  Description of Artificial Sequence: Synthetic peptide
LQHHSYPRT

SEQ ID NO: 18513 - DNA, 27 bp, Artificial Sequence
  Description of Artificial Sequence: Synthetic oligonucleotide
ctacagcattatagttacccgctcact

SEQ ID NO: 18514 - protein, 9 aa, Artificial Sequence
  Description of Artificial Sequence: Synthetic peptide
LQHYSYPLT

SEQ ID NO: 18515 - DNA, 27 bp, Artificial Sequence
  Description of Artificial Sequence: Synthetic oligonucleotide
caacaatctgatagttaccctctcact

SEQ ID NO: 18516 - protein, 9 aa, Artificial Sequence
  Description of Artificial Sequence: Synthetic peptide
QQSDSYPLT

SEQ ID NO: 18517 - DNA, 27 bp, Artificial Sequence
  Description of Artificial Sequence: Synthetic oligonucleotide
caacagtattatagttacccattcact

SEQ ID NO: 18518 - protein, 9 aa, Artificial Sequence
  Description of Artificial Sequence: Synthetic peptide
QQYYSYPFT

SEQ ID NO: 18519 - DNA, 27 bp, Artificial Sequence
  Description of Artificial Sequence: Synthetic oligonucleotide
caacagactaacagtttcccgtggacg

SEQ ID NO: 18520 - protein, 9 aa, Artificial Sequence
  Description of Artificial Sequence: Synthetic peptide
QQTNSFPWT

SEQ ID NO: 18521 - DNA, 27 bp, Artificial Sequence
  Description of Artificial Sequence: Synthetic oligonucleotide
cagcaatattatagtactcctccgacg

SEQ ID NO: 18522 - protein, 9 aa, Artificial Sequence
  Description of Artificial Sequence: Synthetic peptide
QQYYSTPPT

SEQ ID NO: 18523 - DNA, 30 bp, Artificial Sequence; identical to SEQ ID NO: 18499
  Description of Artificial Sequence: Synthetic oligonucleotide

SEQ ID NO: 18524 - protein, 10 aa, Artificial Sequence
  Description of Artificial Sequence: Synthetic peptide
QQSYRTPQWT

SEQ ID NO: 18525 - DNA, 27 bp, Artificial Sequence
  Description of Artificial Sequence: Synthetic oligonucleotide
atgcaaagtatacagattccgtggacg

SEQ ID NO: 18526 - protein, 9 aa, Artificial Sequence
  Description of Artificial Sequence: Synthetic peptide
MQSIQIPWT

SEQ ID NO: 18527 - DNA, 27 bp, Artificial Sequence
  Description of Artificial Sequence: Synthetic oligonucleotide
atgcaagttctacaaactccgtggacg

SEQ ID NO: 18528 - protein, 9 aa, Artificial Sequence
  Description of Artificial Sequence: Synthetic peptide
MQVLQTPWT

SEQ ID NO: 18529 - DNA, 27 bp, Artificial Sequence
  Description of Artificial Sequence: Synthetic oligonucleotide
ctacagcattatagttacccgctcact

SEQ ID NO: 18530 - protein, 9 aa, Artificial Sequence
  Description of Artificial Sequence: Synthetic peptide
LQHYSYPLT

SEQ ID NO: 18531 - DNA, 27 bp, Artificial Sequence
  Description of Artificial Sequence: Synthetic oligonucleotide
ctacagcataatagttaccctcgcagt

SEQ ID NO: 18532 - protein, 9 aa, Artificial Sequence
  Description of Artificial Sequence: Synthetic peptide
LQHNSYPRS

SEQ ID NO: 18533 - DNA, 27 bp, Artificial Sequence
  Description of Artificial Sequence: Synthetic oligonucleotide
caacagtataatagttacccattcact

SEQ ID NO: 18534 - protein, 9 aa, Artificial Sequence
  Description of Artificial Sequence: Synthetic peptide
QQYNSYPFT

SEQ ID NO: 18535 - DNA, 27 bp, Artificial Sequence
  Description of Artificial Sequence: Synthetic oligonucleotide
ctacagcattatagtttccctcgcagt

SEQ ID NO: 18536 - protein, 9 aa, Artificial Sequence
  Description of Artificial Sequence: Synthetic peptide
LQHYSFPRS

SEQ ID NO: 18537 - DNA, 27 bp, Artificial Sequence
  Description of Artificial Sequence: Synthetic oligonucleotide
ctacagcttaatagttacccattcact

SEQ ID NO: 18538 - protein, 9 aa, Artificial Sequence
  Description of Artificial Sequence: Synthetic peptide
LQLNSYPFT

SEQ ID NO: 18539 - DNA, 27 bp, Artificial Sequence
  Description of Artificial Sequence: Synthetic oligonucleotide
atgcaaagtatacagattccgtggacg

SEQ ID NO: 18540 - protein, 9 aa, Artificial Sequence
  Description of Artificial Sequence: Synthetic peptide
MQSIQIPWT

SEQ ID NO: 18541 - DNA, 27 bp, Artificial Sequence
  Description of Artificial Sequence: Synthetic oligonucleotide
cagcaatattatagtagtcctccgacg

SEQ ID NO: 18542 - protein, 9 aa, Artificial Sequence
  Description of Artificial Sequence: Synthetic peptide
QQYYSSPPT

SEQ ID NO: 18543 - DNA, 27 bp, Artificial Sequence
  Description of Artificial Sequence: Synthetic oligonucleotide
caacaggctaacagtttaccgtggacg

SEQ ID NO: 18544 - protein, 9 aa, Artificial Sequence
  Description of Artificial Sequence: Synthetic peptide
QQANSLPWT

SEQ ID NO: 18545 - DNA, 27 bp, Artificial Sequence
  Description of Artificial Sequence: Synthetic oligonucleotide
caacaggctaacagtttaccgtggacg

SEQ ID NO: 18546 - protein, 9 aa, Artificial Sequence
  Description of Artificial Sequence: Synthetic peptide
QQANSLPWT

SEQ ID NO: 18547 - DNA, 27 bp, Artificial Sequence
  Description of Artificial Sequence: Synthetic oligonucleotide
ctacaccattatagtttcccgctcact

SEQ ID NO: 18548 - protein, 9 aa, Artificial Sequence
  Description of Artificial Sequence: Synthetic peptide
LHHYSFPLT

SEQ ID NO: 18549 - DNA, 27 bp, Artificial Sequence
  Description of Artificial Sequence: Synthetic oligonucleotide
atgcaaagtatacaggttccgtggacg

SEQ ID NO: 18550 - protein, 9 aa, Artificial Sequence
  Description of Artificial Sequence: Synthetic peptide
MQSIQVPWT

SEQ ID NO: 18551 - DNA, 27 bp, Artificial Sequence
  Description of Artificial Sequence: Synthetic oligonucleotide
caacaggctaacagtttaccgtggacg

SEQ ID NO: 18552 - protein, 9 aa, Artificial Sequence
  Description of Artificial Sequence: Synthetic peptide
QQANSLPWT

SEQ ID NO: 18553 - DNA, 24 bp, Artificial Sequence
  Description of Artificial Sequence: Synthetic oligonucleotide
atgcaaagtatacaggttctcact

SEQ ID NO: 18554 - protein, 8 aa, Artificial Sequence
  Description of Artificial Sequence: Synthetic peptide
MQSIQVLT

SEQ ID NO: 18555 - DNA, 27 bp, Artificial Sequence
  Description of Artificial Sequence: Synthetic oligonucleotide
caacaggctaacagtatcccattcact

SEQ ID NO: 18556 - protein, 9 aa, Artificial Sequence
  Description of Artificial Sequence: Synthetic peptide
QQANSIPFT

SEQ ID NO: 18557 - DNA, 27 bp, Artificial Sequence
  Description of Artificial Sequence: Synthetic oligonucleotide
atgcaaagtatacaggttccgtggacg

SEQ ID NO: 18558 - protein, 9 aa, Artificial Sequence
  Description of Artificial Sequence: Synthetic peptide
MQSIQVPWT

SEQ ID NO: 18559 - DNA, 27 bp, Artificial Sequence
  Description of Artificial Sequence: Synthetic oligonucleotide
ctacagcataatagttacccattcact

SEQ ID NO: 18560 - protein, 9 aa, Artificial Sequence
  Description of Artificial Sequence: Synthetic peptide
LQHNSYPFT

SEQ ID NO: 18561 - DNA, 27 bp, Artificial Sequence
  Description of Artificial Sequence: Synthetic oligonucleotide
cagcagagttacagtaccccattcact

SEQ ID NO: 18562 - protein, 9 aa, Artificial Sequence
  Description of Artificial Sequence: Synthetic peptide
QQSYSTPFT

SEQ ID NO: 18563 - DNA, 27 bp, Artificial Sequence
  Description of Artificial Sequence: Synthetic oligonucleotide
atgcaaagtatacaggttccctggacg

SEQ ID NO: 18564 - protein, 9 aa, Artificial Sequence
  Description of Artificial Sequence: Synthetic peptide
MQSIQVPWT

SEQ ID NO: 18565 - DNA, 27 bp, Artificial Sequence
  Description of Artificial Sequence: Synthetic oligonucleotide
caacagtataatggttacccattcact

SEQ ID NO: 18566 - protein, 9 aa, Artificial Sequence
  Description of Artificial Sequence: Synthetic peptide
QQYNGYPFT

SEQ ID NO: 18567 - DNA, 30 bp, Artificial Sequence
  Description of Artificial Sequence: Synthetic oligonucleotide
caacagagttacagttctcctccgtggacg

SEQ ID NO: 18568 - protein, 10 aa, Artificial Sequence
  Description of Artificial Sequence: Synthetic peptide
QQSYSSPPWT

SEQ ID NO: 18569 - DNA, 27 bp, Artificial Sequence
  Description of Artificial Sequence: Synthetic oligonucleotide
catcagtattttattactccgtggacg

SEQ ID NO: 18570 - protein, 9 aa, Artificial Sequence
  Description of Artificial Sequence: Synthetic peptide
HQYFITPWT

SEQ ID NO: 18571 - DNA, 27 bp, Artificial Sequence
  Description of Artificial Sequence: Synthetic oligonucleotide
ctacagcataatagttacccattcact

SEQ ID NO: 18572 - protein, 9 aa, Artificial Sequence
  Description of Artificial Sequence: Synthetic peptide
LQHNSYPFT

SEQ ID NO: 18573 - DNA, 27 bp, Artificial Sequence
  Description of Artificial Sequence: Synthetic oligonucleotide
atgcaaagtatacagattccctggacg

SEQ ID NO: 18574 - protein, 9 aa, Artificial Sequence
  Description of Artificial Sequence: Synthetic peptide
MQSIQIPWT

SEQ ID NO: 18575 - DNA, 27 bp, Artificial Sequence
  Description of Artificial Sequence: Synthetic oligonucleotide
caacaggttaacagtttcccattcact

SEQ ID NO: 18576 - protein, 9 aa, Artificial Sequence
  Description of Artificial Sequence: Synthetic peptide
QQVNSFPFT

SEQ ID NO: 18577 - DNA, 27 bp, Artificial Sequence
  Description of Artificial Sequence: Synthetic oligonucleotide
caacagtatgataatctccctctcact

SEQ ID NO: 18578 - protein, 9 aa, Artificial Sequence
  Description of Artificial Sequence: Synthetic peptide
QQYDNLPLT

SEQ ID NO: 18579 - DNA, 30 bp, Artificial Sequence
  Description of Artificial Sequence: Synthetic oligonucleotide
caacagagttacagttcccctccgtggacg

SEQ ID NO: 18580 - protein, 10 aa, Artificial Sequence
  Description of Artificial Sequence: Synthetic peptide
QQSYSSPPWT

SEQ ID NO: 18581 - DNA, 30 bp, Artificial Sequence
  Description of Artificial Sequence: Synthetic oligonucleotide
cagcagtatggtagctcacctccgtggacg

SEQ ID NO: 18582 - protein, 10 aa, Artificial Sequence
  Description of Artificial Sequence: Synthetic peptide
QQYGSSPPWT

SEQ ID NO: 18583 - DNA, 27 bp, Artificial Sequence
  Description of Artificial Sequence: Synthetic oligonucleotide
cagcagagtagtagtttaccgtggacg

SEQ ID NO: 18584 - protein, 9 aa, Artificial Sequence
  Description of Artificial Sequence: Synthetic peptide
QQSSSLPWT

SEQ ID NO: 18585 - DNA, 27 bp, Artificial Sequence
  Description of Artificial Sequence: Synthetic oligonucleotide
caacagtatatgacttacccgctcact

SEQ ID NO: 18586 - protein, 9 aa, Artificial Sequence
  Description of Artificial Sequence: Synthetic peptide
QQYMTYPLT

SEQ ID NO: 18587 - DNA, 27 bp, Artificial Sequence
  Description of Artificial Sequence: Synthetic oligonucleotide
cagcagtataataactggccgctcact

SEQ ID NO: 18588 - protein, 9 aa, Artificial Sequence
  Description of Artificial Sequence: Synthetic peptide
QQYNNWPLT

SEQ ID NO: 18589 - DNA, 27 bp, Artificial Sequence
  Description of Artificial Sequence: Synthetic oligonucleotide
catcagagtagtagtttccctcggacg

SEQ ID NO: 18590 - protein, 9 aa, Artificial Sequence
  Description of Artificial Sequence: Synthetic peptide
HQSSSFPRT

SEQ ID NO: 18591 - DNA, 27 bp, Artificial Sequence
  Description of Artificial Sequence: Synthetic oligonucleotide
caacagtatatgacttacccgctcact

SEQ ID NO: 18592 - protein, 9 aa, Artificial Sequence
  Description of Artificial Sequence: Synthetic peptide
QQYMTYPLT

SEQ ID NO: 18593 - DNA, 27 bp, Artificial Sequence
  Description of Artificial Sequence: Synthetic oligonucleotide
atgcaaagtatacagtttccctggacg

SEQ ID NO: 18594 - protein, 9 aa, Artificial Sequence
  Description of Artificial Sequence: Synthetic peptide
MQSIQFPWT

SEQ ID NO: 18595 - DNA, 27 bp, Artificial Sequence
  Description of Artificial Sequence: Synthetic oligonucleotide
catcagactagaagtttacctctcact

SEQ ID NO: 18596 - protein, 9 aa, Artificial Sequence
  Description of Artificial Sequence: Synthetic peptide
HQTRSLPLT

SEQ ID NO: 18597 - DNA, 27 bp, Artificial Sequence
  Description of Artificial Sequence: Synthetic oligonucleotide
ctacagcataatagttacccgtggacg

SEQ ID NO: 18598 - protein, 9 aa, Artificial Sequence
  Description of Artificial Sequence: Synthetic peptide
LQHNSYPWT

SEQ ID NO: 18599 - DNA, 27 bp, Artificial Sequence
  Description of Artificial Sequence: Synthetic oligonucleotide
caaaagtataacagtgccccattcact

SEQ ID NO: 18600 - protein, 9 aa, Artificial Sequence
  Description of Artificial Sequence: Synthetic peptide
QKYNSAPFT

SEQ ID NO: 18601 - DNA, 27 bp, Artificial Sequence
  Description of Artificial Sequence: Synthetic oligonucleotide
caacgatatgatacttacccattcact

SEQ ID NO: 18602 - protein, 9 aa, Artificial Sequence
  Description of Artificial Sequence: Synthetic peptide
QRYDTYPFT

SEQ ID NO: 18603 - DNA, 27 bp, Artificial Sequence
  Description of Artificial Sequence: Synthetic oligonucleotide
caacagtatatgacttacccgctcact

SEQ ID NO: 18604 - protein, 9 aa, Artificial Sequence
  Description of Artificial Sequence: Synthetic peptide
QQYMTYPLT

SEQ ID NO: 18605 - DNA, 27 bp, Artificial Sequence
  Description of Artificial Sequence: Synthetic oligonucleotide
atgcaaagtttccagcttccctggacg

SEQ ID NO: 18606 - protein, 9 aa, Artificial Sequence
  Description of Artificial Sequence: Synthetic peptide
MQSFQLPWT

SEQ ID NO: 18607 - DNA, 27 bp, Artificial Sequence
  Description of Artificial Sequence: Synthetic oligonucleotide
caacaatattatagtactcctccgacg

SEQ ID NO: 18608 - protein, 9 aa, Artificial Sequence
  Description of Artificial Sequence: Synthetic peptide
QQYYSTPPT

SEQ ID NO: 18609 - DNA, 27 bp, Artificial Sequence
  Description of Artificial Sequence: Synthetic oligonucleotide
cagcagtatggtaggtcaccgtggacg

SEQ ID NO: 18610 - protein, 9 aa, Artificial Sequence
  Description of Artificial Sequence: Synthetic peptide
QQYGRSPWT

SEQ ID NO: 18611 - DNA, 27 bp, Artificial Sequence
  Description of Artificial Sequence: Synthetic oligonucleotide
caacattatcttacttaccctctcact

SEQ ID NO: 18612 - protein, 9 aa, Artificial Sequence
  Description of Artificial Sequence: Synthetic peptide
QHYLTYPLT

SEQ ID NO: 18613 - DNA, 27 bp, Artificial Sequence
  Description of Artificial Sequence: Synthetic oligonucleotide
cagcaatatggtaactcaccgtgggcg

SEQ ID NO: 18614 - protein, 9 aa, Artificial Sequence
  Description of Artificial Sequence: Synthetic peptide
QQYGNSPWA

SEQ ID NO: 18615 - DNA, 27 bp, Artificial Sequence
  Description of Artificial Sequence: Synthetic oligonucleotide
cagcagtatggtaactcaccgtgggcg

SEQ ID NO: 18616 - protein, 9 aa, Artificial Sequence
  Description of Artificial Sequence: Synthetic peptide
QQYGNSPWA

SEQ ID NO: 18617 - DNA, 27 bp, Artificial Sequence
  Description of Artificial Sequence: Synthetic oligonucleotide
cagcagtatggtagctcaccgtggacg

SEQ ID NO: 18618 - protein, 9 aa, Artificial Sequence
  Description of Artificial Sequence: Synthetic peptide
QQYGSSPWT

SEQ ID NO: 18619 - DNA, 27 bp, Artificial Sequence
  Description of Artificial Sequence: Synthetic oligonucleotide
atgcaaagtatacaacttccctggacg

SEQ ID NO: 18620 - protein, 9 aa, Artificial Sequence
  Description of Artificial Sequence: Synthetic peptide
MQSIQLPWT

SEQ ID NO: 18621 - DNA, 27 bp, Artificial Sequence
  Description of Artificial Sequence: Synthetic oligonucleotide
cagcaatattatagtagtcctcccact

SEQ ID NO: 18622 - protein, 9 aa, Artificial Sequence
  Description of Artificial Sequence: Synthetic peptide
QQYYSSPPT

SEQ ID NO: 18623 - DNA, 27 bp, Artificial Sequence
  Description of Artificial Sequence: Synthetic oligonucleotide
ctacagcataatagttacccgtggacg

SEQ ID NO: 18624 - protein, 9 aa, Artificial Sequence
  Description of Artificial Sequence: Synthetic peptide
LQHNSYPWT

SEQ ID NO: 18625 - DNA, 27 bp, Artificial Sequence
  Description of Artificial Sequence: Synthetic oligonucleotide
caacagtatatgacttacccgctcact

SEQ ID NO: 18626 - protein, 9 aa, Artificial Sequence
  Description of Artificial Sequence: Synthetic peptide
QQYMTYPLT

SEQ ID NO: 18627 - DNA, 27 bp, Artificial Sequence
  Description of Artificial Sequence: Synthetic oligonucleotide
caacagtatagtaattacccagtcact

SEQ ID NO: 18628 - protein, 9 aa, Artificial Sequence
  Description of Artificial Sequence: Synthetic peptide
QQYSNYPVT

SEQ ID NO: 18629 - DNA, 27 bp, Artificial Sequence
  Description of Artificial Sequence: Synthetic oligonucleotide
catcagactggtaggttacctctcact

SEQ ID NO: 18630 - protein, 9 aa, Artificial Sequence
  Description of Artificial Sequence: Synthetic peptide
HQTGRLPLT

SEQ ID NO: 18631 - DNA, 30 bp, Artificial Sequence
  Description of Artificial Sequence: Synthetic oligonucleotide
cagcagtatggtggttcacctccgtggacg

SEQ ID NO: 18632 - protein, 10 aa, Artificial Sequence
  Description of Artificial Sequence: Synthetic peptide
QQYGGSPPWT

SEQ ID NO: 18633 - DNA, 27 bp, Artificial Sequence
  Description of Artificial Sequence: Synthetic oligonucleotide
catcagagtagtagtttccctcggacg

SEQ ID NO: 18634 - protein, 9 aa, Artificial Sequence
  Description of Artificial Sequence: Synthetic peptide
HQSSSFPRT

SEQ ID NO: 18635 - DNA, 27 bp, Artificial Sequence
  Description of Artificial Sequence: Synthetic oligonucleotide
caacagtatcttaattacccagtcact

SEQ ID NO: 18636 - protein, 9 aa, Artificial Sequence
  Description of Artificial Sequence: Synthetic peptide
QQYLNYPVT

SEQ ID NO: 18637 - DNA, 27 bp, Artificial Sequence
  Description of Artificial Sequence: Synthetic oligonucleotide
atgcaaagtatacattttccctggacg

SEQ ID NO: 18638 - protein, 9 aa, Artificial Sequence
  Description of Artificial Sequence: Synthetic peptide
MQSIHFPWT

SEQ ID NO: 18639 - DNA, 27 bp, Artificial Sequence
  Description of Artificial Sequence: Synthetic oligonucleotide
caacaatatagtacttacccgctcact

SEQ ID NO: 18640 - protein, 9 aa, Artificial Sequence
  Description of Artificial Sequence: Synthetic peptide
QQYSTYPLT

SEQ ID NO: 18641 - DNA, 27 bp, Artificial Sequence
  Description of Artificial Sequence: Synthetic oligonucleotide
caacaggctaacagtttcccgtggacg

SEQ ID NO: 18642 - protein, 9 aa, Artificial Sequence
  Description of Artificial Sequence: Synthetic peptide
QQANSFPWT

SEQ ID NO: 18643 - DNA, 27 bp, Artificial Sequence
  Description of Artificial Sequence: Synthetic oligonucleotide
caacagtataatggttacccattcact

SEQ ID NO: 18644 - protein, 9 aa, Artificial Sequence
  Description of Artificial Sequence: Synthetic peptide
QQYNGYPFT

SEQ ID NO: 18645 - DNA, 27 bp, Artificial Sequence
  Description of Artificial Sequence: Synthetic oligonucleotide
ctacagcataatagttacccattcact

SEQ ID NO: 18646 - protein, 9 aa, Artificial Sequence
  Description of Artificial Sequence: Synthetic peptide
LQHNSYPFT

SEQ ID NO: 18647 - DNA, 27 bp, Artificial Sequence
  Description of Artificial Sequence: Synthetic oligonucleotide
ctacagcataatagttacccattcact

SEQ ID NO: 18648 - protein, 9 aa, Artificial Sequence
  Description of Artificial Sequence: Synthetic peptide
LQHNSYPFT

SEQ ID NO: 18649 - DNA, 27 bp, Artificial Sequence
  Description of Artificial Sequence: Synthetic oligonucleotide
cgacaatatcatagttacccattcact

SEQ ID NO: 18650 - protein, 9 aa, Artificial Sequence
  Description of Artificial Sequence: Synthetic peptide
RQYHSYPFT

SEQ ID NO: 18651 - DNA, 27 bp, Artificial Sequence
  Description of Artificial Sequence: Synthetic oligonucleotide
caacagtataatggttacccattcact

SEQ ID NO: 18652 - protein, 9 aa, Artificial Sequence
  Description of Artificial Sequence: Synthetic peptide
QQYNGYPFT

SEQ ID NO: 18653 - DNA, 27 bp, Artificial Sequence
  Description of Artificial Sequence: Synthetic oligonucleotide
atgcaaagtatacaggttccctggacg

SEQ ID NO: 18654 - protein, 9 aa, Artificial Sequence
  Description of Artificial Sequence: Synthetic peptide
MQSIQVPWT

SEQ ID NO: 18655 - DNA, 27 bp, Artificial Sequence
  Description of Artificial Sequence: Synthetic oligonucleotide
caacaggttaacagtttcccattcact

SEQ ID NO: 18656 - protein, 9 aa, Artificial Sequence
  Description of Artificial Sequence: Synthetic peptide
QQVNSFPFT

SEQ ID NO: 18657 - DNA, 27 bp, Artificial Sequence
  Description of Artificial Sequence: Synthetic oligonucleotide
caacagtataatagttatccattcact

SEQ ID NO: 18658 - protein, 9 aa, Artificial Sequence
  Description of Artificial Sequence: Synthetic peptide
QQYNSYPFT

SEQ ID NO: 18659 - DNA, 27 bp, Artificial Sequence
  Description of Artificial Sequence: Synthetic oligonucleotide
cagcaggctaacagtttcccgtggacg

SEQ ID NO: 18660 - protein, 9 aa, Artificial Sequence
  Description of Artificial Sequence: Synthetic peptide
QQANSFPWT

SEQ ID NO: 18661 - DNA, 27 bp, Artificial Sequence
  Description of Artificial Sequence: Synthetic oligonucleotide
caacagtataatagttacccattcact

SEQ ID NO: 18662 - protein, 9 aa, Artificial Sequence
  Description of Artificial Sequence: Synthetic peptide
QQYNSYPFT

SEQ ID NO: 18663 - DNA, 27 bp, Artificial Sequence
  Description of Artificial Sequence: Synthetic oligonucleotide
atgcaaagtatacagattccttggacg

SEQ ID NO: 18664 - protein, 9 aa, Artificial Sequence
  Description of Artificial Sequence: Synthetic peptide
MQSIQIPWT

SEQ ID NO: 18665 - DNA, 27 bp, Artificial Sequence
  Description of Artificial Sequence: Synthetic oligonucleotide
atgcaaagtatacagattccgtggacg

SEQ ID NO: 18666 - protein, 9 aa, Artificial Sequence
  Description of Artificial Sequence: Synthetic peptide
MQSIQIPWT

SEQ ID NO: 18667 - DNA, 27 bp, Artificial Sequence
  Description of Artificial Sequence: Synthetic oligonucleotide
cagcaatattgtagtcttccattcact

SEQ ID NO: 18668 - protein, 9 aa, Artificial Sequence
  Description of Artificial Sequence: Synthetic peptide
QQYCSLPFT

SEQ ID NO: 18669 - DNA, 27 bp, Artificial Sequence
  Description of Artificial Sequence: Synthetic oligonucleotide
cagcagtatggtaactcaccgtggacg

SEQ ID NO: 18670 - protein, 9 aa, Artificial Sequence
  Description of Artificial Sequence: Synthetic peptide
QQYGNSPWT

SEQ ID NO: 18671 - DNA, 27 bp, Artificial Sequence
  Description of Artificial Sequence: Synthetic oligonucleotide
ctacagcataatagttacccgtggacg

SEQ ID NO: 18672 - protein, 9 aa, Artificial Sequence
  Description of Artificial Sequence: Synthetic peptide
LQHNSYPWT

SEQ ID NO: 18673 - DNA, 27 bp, Artificial Sequence
  Description of Artificial Sequence: Synthetic oligonucleotide
caacaggctaacagtctcccgtggacg

SEQ ID NO: 18674 - protein, 9 aa, Artificial Sequence
  Description of Artificial Sequence: Synthetic peptide
QQANSLPWT

SEQ ID NO: 18675 - DNA, 27 bp, Artificial Sequence
  Description of Artificial Sequence: Synthetic oligonucleotide
cagcagtatggtaactcaccgtgggcg

SEQ ID NO: 18676 - protein, 9 aa, Artificial Sequence
  Description of Artificial Sequence: Synthetic peptide
QQYGNSPWA

SEQ ID NO: 18677 - DNA, 27 bp, Artificial Sequence
  Description of Artificial Sequence: Synthetic oligonucleotide
cagcagtatggtaactcaccgtggacg

SEQ ID NO: 18678 - protein, 9 aa, Artificial Sequence
  Description of Artificial Sequence: Synthetic peptide
QQYGNSPWT

SEQ ID NO: 18679 - DNA, 27 bp, Artificial Sequence
  Description of Artificial Sequence: Synthetic oligonucleotide
cagcaatattatagtattcctcccact

SEQ ID NO: 18680 - protein, 9 aa, Artificial Sequence
  Description of Artificial Sequence: Synthetic peptide
QQYYSIPPT

SEQ ID NO: 18681 - DNA, 27 bp, Artificial Sequence
  Description of Artificial Sequence: Synthetic oligonucleotide
cagcagagtagtagtttaccgtggacg

SEQ ID NO: 18682 - protein, 9 aa, Artificial Sequence
  Description of Artificial Sequence: Synthetic peptide
QQSSSLPWT

SEQ ID NO: 18683 - DNA, 27 bp, Artificial Sequence
  Description of Artificial Sequence: Synthetic oligonucleotide
ctacagcataataattacccgtggacg

SEQ ID NO: 18684 - protein, 9 aa, Artificial Sequence
  Description of Artificial Sequence: Synthetic peptide
LQHNNYPWT

SEQ ID NO: 18685 - DNA, 27 bp, Artificial Sequence
  Description of Artificial Sequence: Synthetic oligonucleotide
ctacagcattatagtttcccattcact

SEQ ID NO: 18686 - protein, 9 aa, Artificial Sequence
  Description of Artificial Sequence: Synthetic peptide
LQHYSFPFT

SEQ ID NO: 18687 - DNA, 27 bp, Artificial Sequence
  Description of Artificial Sequence: Synthetic oligonucleotide
cagcaatattgtagtcttccattcact

SEQ ID NO: 18688 - protein, 9 aa, Artificial Sequence
  Description of Artificial Sequence: Synthetic peptide
QQYCSLPFT

SEQ ID NO: 18689 - DNA, 27 bp, Artificial Sequence
  Description of Artificial Sequence: Synthetic oligonucleotide
caacaatattatcgtactccgtggacg

SEQ ID NO: 18690 - protein, 9 aa, Artificial Sequence
  Description of Artificial Sequence: Synthetic peptide
QQYYRTPWT

SEQ ID NO: 18691 - DNA, 27 bp, Artificial Sequence
  Description of Artificial Sequence: Synthetic oligonucleotide
atgcaaagtatacagcttccctggacg

SEQ ID NO: 18692 - protein, 9 aa, Artificial Sequence
  Description of Artificial Sequence: Synthetic peptide
MQSIQLPWT

SEQ ID NO: 18693 - DNA, 27 bp, Artificial Sequence
  Description of Artificial Sequence: Synthetic oligonucleotide
catcagagtagtagtttccctcggacg

SEQ ID NO: 18694 - protein, 9 aa, Artificial Sequence
  Description of Artificial Sequence: Synthetic peptide
HQSSSFPRT

SEQ ID NO: 18695 - DNA, 27 bp, Artificial Sequence
  Description of Artificial Sequence: Synthetic oligonucleotide
caacagtatatgacttacccactcact

SEQ ID NO: 18696 - protein, 9 aa, Artificial Sequence
  Description of Artificial Sequence: Synthetic peptide
QQYMTYPLT

SEQ ID NO: 18697 - DNA, 27 bp, Artificial Sequence
  Description of Artificial Sequence: Synthetic oligonucleotide
catcagagtagtagtttccctcggacg

SEQ ID NO: 18698 - protein, 9 aa, Artificial Sequence
  Description of Artificial Sequence: Synthetic peptide
HQSSSFPRT

SEQ ID NO: 18699 - DNA, 27 bp, Artificial Sequence
  Description of Artificial Sequence: Synthetic oligonucleotide
caacgatatgatacttacccattcact

SEQ ID NO: 18700 - protein, 9 aa, Artificial Sequence
  Description of Artificial Sequence: Synthetic peptide
QRYDTYPFT

SEQ ID NO: 18701 - DNA, 27 bp, Artificial Sequence
  Description of Artificial Sequence: Synthetic oligonucleotide
cagcagtatggtagctcaccgtggacg

SEQ ID NO: 18702 - protein, 9 aa, Artificial Sequence
  Description of Artificial Sequence: Synthetic peptide
QQYGSSPWT

SEQ ID NO: 18703 - DNA, 27 bp, Artificial Sequence
  Description of Artificial Sequence: Synthetic oligonucleotide
cagcagtataataactggccgctcact

SEQ ID NO: 18704 - protein, 9 aa, Artificial Sequence
  Description of Artificial Sequence: Synthetic peptide
QQYNNWPLT

SEQ ID NO: 18705 - DNA, 27 bp, Artificial Sequence
  Description of Artificial Sequence: Synthetic oligonucleotide
catcagactagaagtttacctctcact

SEQ ID NO: 18706 - protein, 9 aa, Artificial Sequence
  Description of Artificial Sequence: Synthetic peptide
HQTRSLPLT

SEQ ID NO: 18707 - DNA, 27 bp, Artificial Sequence
  Description of Artificial Sequence: Synthetic oligonucleotide
caacagtatagtacttacccgctcact

SEQ ID NO: 18708 - protein, 9 aa, Artificial Sequence
  Description of Artificial Sequence: Synthetic peptide
QQYSTYPLT

SEQ ID NO: 18709 - DNA, 27 bp, Artificial Sequence
  Description of Artificial Sequence: Synthetic oligonucleotide
caacagtatagtacttacccgctcact

SEQ ID NO: 18710 - protein, 9 aa, Artificial Sequence
  Description of Artificial Sequence: Synthetic peptide
QQYSTYPLT

SEQ ID NO: 18711 - DNA, 27 bp, Artificial Sequence
  Description of Artificial Sequence: Synthetic oligonucleotide
cagcaatattctagtcttccattcact

SEQ ID NO: 18712 - protein, 9 aa, Artificial Sequence
  Description of Artificial Sequence: Synthetic peptide
QQYSSLPFT

SEQ ID NO: 18713 - DNA, 27 bp, Artificial Sequence
  Description of Artificial Sequence: Synthetic oligonucleotide
caacagtatatcacttacccgctcact

SEQ ID NO: 18714 - protein, 9 aa, Artificial Sequence
  Description of Artificial Sequence: Synthetic peptide
QQYITYPLT

SEQ ID NO: 18715 - DNA, 27 bp, Artificial Sequence
  Description of Artificial Sequence: Synthetic oligonucleotide
caacagtataatagttacccattcact

SEQ ID NO: 18716 - protein, 9 aa, Artificial Sequence
  Description of Artificial Sequence: Synthetic peptide
QQYNSYPFT

SEQ ID NO: 18717 - DNA, 27 bp, Artificial Sequence
  Description of Artificial Sequence: Synthetic oligonucleotide
caacattatgttacttacccgaacact

SEQ ID NO: 18718 - protein, 9 aa, Artificial Sequence
  Description of Artificial Sequence: Synthetic peptide
QHYVTYPNT

SEQ ID NO: 18719 - DNA, 27 bp, Artificial Sequence
  Description of Artificial Sequence: Synthetic oligonucleotide
caacagtctaacagtttcccattcact

SEQ ID NO: 18720 - protein, 9 aa, Artificial Sequence
  Description of Artificial Sequence: Synthetic peptide
QQSNSFPFT

SEQ ID NO: 18721 - DNA, 27 bp, Artificial Sequence
  Description of Artificial Sequence: Synthetic oligonucleotide
cagcagtatggtaactcaccgtgggcg

SEQ ID NO: 18722 - protein, 9 aa, Artificial Sequence
  Description of Artificial Sequence: Synthetic peptide
QQYGNSPWA

SEQ ID NO: 18723 - DNA, 27 bp, Artificial Sequence
  Description of Artificial Sequence: Synthetic oligonucleotide
ctacattatcttacttaccctctcact

SEQ ID NO: 18724 - protein, 9 aa, Artificial Sequence
  Description of Artificial Sequence: Synthetic peptide
LHYLTYPLT

SEQ ID NO: 18725 - DNA, 27 bp, Artificial Sequence
  Description of Artificial Sequence: Synthetic oligonucleotide
cagcaatatggtatctcaccgtggacg

SEQ ID NO: 18726 - protein, 9 aa, Artificial Sequence
  Description of Artificial Sequence: Synthetic peptide
QQYGISPWT

SEQ ID NO: 18727 - DNA, 27 bp, Artificial Sequence
  Description of Artificial Sequence: Synthetic oligonucleotide
caacggtatgatacttacccattcact

SEQ ID NO: 18728 - protein, 9 aa, Artificial Sequence
  Description of Artificial Sequence: Synthetic peptide
QRYDTYPFT

SEQ ID NO: 18729 - DNA, 27 bp, Artificial Sequence
  Description of Artificial Sequence: Synthetic oligonucleotide
ctacattatctcaattacccgctcact

SEQ ID NO: 18730 - protein, 9 aa, Artificial Sequence
  Description of Artificial Sequence: Synthetic peptide
LHYLNYPLT

SEQ ID NO: 18731 - DNA, 27 bp, Artificial Sequence
  Description of Artificial Sequence: Synthetic oligonucleotide
catcagagtagtcgtttaccgctcact

SEQ ID NO: 18732 - protein, 9 aa, Artificial Sequence
  Description of Artificial Sequence: Synthetic peptide
HQSSRLPLT

SEQ ID NO: 18733 - DNA, 27 bp, Artificial Sequence
  Description of Artificial Sequence: Synthetic oligonucleotide
ctacagcattatagtttcccattcact

SEQ ID NO: 18734 - protein, 9 aa, Artificial Sequence
  Description of Artificial Sequence: Synthetic peptide
LQHYSFPFT

SEQ ID NO: 18735 - DNA, 27 bp, Artificial Sequence
  Description of Artificial Sequence: Synthetic oligonucleotide
caacagtatatgacttacccgctcact

SEQ ID NO: 18736 - protein, 9 aa, Artificial Sequence
  Description of Artificial Sequence: Synthetic peptide
QQYMTYPLT

SEQ ID NO: 18737 - DNA, 27 bp, Artificial Sequence
  Description of Artificial Sequence: Synthetic oligonucleotide
ctacagcatactagttacccgtggacg

SEQ ID NO: 18738 - protein, 9 aa, Artificial Sequence
  Description of Artificial Sequence: Synthetic peptide
LQHTSYPWT

SEQ ID NO: 18739 - DNA, 27 bp, Artificial Sequence
  Description of Artificial Sequence: Synthetic oligonucleotide
caacattatcttacttaccctctcact

SEQ ID NO: 18740 - protein, 9 aa, Artificial Sequence
  Description of Artificial Sequence: Synthetic peptide
QHYLTYPLT

SEQ ID NO: 18741 - DNA, 27 bp, Artificial Sequence
  Description of Artificial Sequence: Synthetic oligonucleotide
cagcagtatgagagttcaccgtggacg

SEQ ID NO: 18742 - protein, 9 aa, Artificial Sequence
  Description of Artificial Sequence: Synthetic peptide
QQYESSPWT

SEQ ID NO: 18743 - DNA, 27 bp, Artificial Sequence
  Description of Artificial Sequence: Synthetic oligonucleotide
caacagtatatcacttacccgctcact

SEQ ID NO: 18744 - protein, 9 aa, Artificial Sequence
  Description of Artificial Sequence: Synthetic peptide
QQYITYPLT

SEQ ID NO: 18745 - DNA, 27 bp, Artificial Sequence
  Description of Artificial Sequence: Synthetic oligonucleotide
atgcaaagtatacagcttccctggacg

SEQ ID NO: 18746 - protein, 9 aa, Artificial Sequence
  Description of Artificial Sequence: Synthetic peptide
MQSIQLPWT

SEQ ID NO: 18747 - DNA, 27 bp, Artificial Sequence
  Description of Artificial Sequence: Synthetic oligonucleotide
caacgatatgatacttacccattcact

SEQ ID NO: 18748 - protein, 9 aa, Artificial Sequence
  Description of Artificial Sequence: Synthetic peptide
QRYDTYPFT

SEQ ID NO: 18749 - DNA, 30 bp, Artificial Sequence; identical to SEQ ID NO: 18579
  Description of Artificial Sequence: Synthetic oligonucleotide

SEQ ID NO: 18750 - protein, 10 aa, Artificial Sequence
  Description of Artificial Sequence: Synthetic peptide
QQSYSSPPWT

SEQ ID NO: 18751 - DNA, 27 bp, Artificial Sequence
  Description of Artificial Sequence: Synthetic oligonucleotide
caacagtatagtacttacccgctcact

SEQ ID NO: 18752 - protein, 9 aa, Artificial Sequence
  Description of Artificial Sequence: Synthetic peptide
QQYSTYPLT

SEQ ID NO: 18753 - DNA, 27 bp, Artificial Sequence
  Description of Artificial Sequence: Synthetic oligonucleotide
cagcagtatggtaactcaccgtggacg

SEQ ID NO: 18754 - protein, 9 aa, Artificial Sequence
  Description of Artificial Sequence: Synthetic peptide
QQYGNSPWT

SEQ ID NO: 18755 - DNA, 27 bp, Artificial Sequence
  Description of Artificial Sequence: Synthetic oligonucleotide
cagcagtatggtaactcaccgtggacg

SEQ ID NO: 18756 - protein, 9 aa, Artificial Sequence
  Description of Artificial Sequence: Synthetic peptide
QQYGNSPWT

SEQ ID NO: 18757 - DNA, 27 bp, Artificial Sequence
  Description of Artificial Sequence: Synthetic oligonucleotide
cagcagtatggtaactcaccgtggacg

SEQ ID NO: 18758 - protein, 9 aa, Artificial Sequence
  Description of Artificial Sequence: Synthetic peptide
QQYGNSPWT

SEQ ID NO: 18759 - DNA, 27 bp, Artificial Sequence
  Description of Artificial Sequence: Synthetic oligonucleotide
caacaggctaacagtttcccgtggacg

SEQ ID NO: 18760 - protein, 9 aa, Artificial Sequence
  Description of Artificial Sequence: Synthetic peptide
QQANSFPWT

SEQ ID NO: 18761 - DNA, 27 bp, Artificial Sequence
  Description of Artificial Sequence: Synthetic oligonucleotide
cagcagtatggtaactcaccgtgggcg

SEQ ID NO: 18762 - protein, 9 aa, Artificial Sequence
  Description of Artificial Sequence: Synthetic peptide
QQYGNSPWA

SEQ ID NO: 18763 - DNA, 27 bp, Artificial Sequence
  Description of Artificial Sequence: Synthetic oligonucleotide
cagcagtatggaagctcaccgtggacg

SEQ ID NO: 18764 - protein, 9 aa, Artificial Sequence
  Description of Artificial Sequence: Synthetic peptide
QQYGSSPWT

SEQ ID NO: 18765 - DNA, 27 bp, Artificial Sequence
  Description of Artificial Sequence: Synthetic oligonucleotide
caaaagtataacagtgccccattcact

SEQ ID NO: 18766 - protein, 9 aa, Artificial Sequence
  Description of Artificial Sequence: Synthetic peptide
QKYNSAPFT

SEQ ID NO: 18767 - DNA, 27 bp, Artificial Sequence
  Description of Artificial Sequence: Synthetic oligonucleotide
cagcaatattatattactccgtggacg

SEQ ID NO: 18768 - protein, 9 aa, Artificial Sequence
  Description of Artificial Sequence: Synthetic peptide
QQYYITPWT

SEQ ID NO: 18769 - DNA, 27 bp, Artificial Sequence
  Description of Artificial Sequence: Synthetic oligonucleotide
ctacagcataatgatttcccgttcact

SEQ ID NO: 18770 - protein, 9 aa, Artificial Sequence
  Description of Artificial Sequence: Synthetic peptide
LQHNDFPFT

SEQ ID NO: 18771 - DNA, 27 bp, Artificial Sequence
  Description of Artificial Sequence: Synthetic oligonucleotide
catcagagtagtcgtttaccattcact

SEQ ID NO: 18772 - protein, 9 aa, Artificial Sequence
  Description of Artificial Sequence: Synthetic peptide
HQSSRLPFT

SEQ ID NO: 18773 - DNA, 27 bp, Artificial Sequence
  Description of Artificial Sequence: Synthetic oligonucleotide
cagcagtatgagagttcaccgtggacg

SEQ ID NO: 18774 - protein, 9 aa, Artificial Sequence
  Description of Artificial Sequence: Synthetic peptide
QQYESSPWT

SEQ ID NO: 18775 - DNA, 27 bp, Artificial Sequence
  Description of Artificial Sequence: Synthetic oligonucleotide
cagcagtatggtagctcaccgtggacg

SEQ ID NO: 18776 - protein, 9 aa, Artificial Sequence
  Description of Artificial Sequence: Synthetic peptide
QQYGSSPWT

SEQ ID NO: 18777 - DNA, 27 bp, Artificial Sequence
  Description of Artificial Sequence: Synthetic oligonucleotide
caacagtatagtacttacccgctcact

SEQ ID NO: 18778 - protein, 9 aa, Artificial Sequence
  Description of Artificial Sequence: Synthetic peptide
QQYSTYPLT

SEQ ID NO: 18779 - DNA, 27 bp, Artificial Sequence
  Description of Artificial Sequence: Synthetic oligonucleotide
ctacagcataaaaggtacccgctcact

SEQ ID NO: 18780 - protein, 9 aa, Artificial Sequence
  Description of Artificial Sequence: Synthetic peptide
LQHKRYPLT

SEQ ID NO: 18781 - DNA, 27 bp, Artificial Sequence
  Description of Artificial Sequence: Synthetic oligonucleotide
cagcaatatggtaactcaccgtgggcg

SEQ ID NO: 18782 - protein, 9 aa, Artificial Sequence
  Description of Artificial Sequence: Synthetic peptide
QQYGNSPWA

SEQ ID NO: 18783 - DNA, 27 bp, Artificial Sequence
  Description of Artificial Sequence: Synthetic oligonucleotide
cagcagtatggtaactcaccgtggacg

SEQ ID NO: 18784 - protein, 9 aa, Artificial Sequence
  Description of Artificial Sequence: Synthetic peptide
QQYGNSPWT

SEQ ID NO: 18785 - DNA, 27 bp, Artificial Sequence
  Description of Artificial Sequence: Synthetic oligonucleotide
caacagtataatagttacccattcact

SEQ ID NO: 18786 - protein, 9 aa, Artificial Sequence
  Description of Artificial Sequence: Synthetic peptide
QQYNSYPFT

SEQ ID NO: 18787 - DNA, 27 bp, Artificial Sequence
  Description of Artificial Sequence: Synthetic oligonucleotide
cagcagtatggtaactcaccgtggacg

SEQ ID NO: 18788 - protein, 9 aa, Artificial Sequence
  Description of Artificial Sequence: Synthetic peptide
QQYGNSPWT

SEQ ID NO: 18789 - DNA, 27 bp, Artificial Sequence
  Description of Artificial Sequence: Synthetic oligonucleotide
catcagagtagtcgtttaccgctcact

SEQ ID NO: 18790 - protein, 9 aa, Artificial Sequence
  Description of Artificial Sequence: Synthetic peptide
HQSSRLPLT

SEQ ID NO: 18791 - DNA, 27 bp, Artificial Sequence
  Description of Artificial Sequence: Synthetic oligonucleotide
caacattatcttacttaccctctcact

SEQ ID NO: 18792 - protein, 9 aa, Artificial Sequence
  Description of Artificial Sequence: Synthetic peptide
QHYLTYPLT

SEQ ID NO: 18793 - DNA, 30 bp, Artificial Sequence; identical to SEQ ID NO: 18581
  Description of Artificial Sequence: Synthetic oligonucleotide

SEQ ID NO: 18794 - protein, 10 aa, Artificial Sequence
  Description of Artificial Sequence: Synthetic peptide
QQYGSSPPWT

SEQ ID NO: 18795 - DNA, 27 bp, Artificial Sequence
  Description of Artificial Sequence: Synthetic oligonucleotide
cagcagtatggtaactcaccgtgggcg

SEQ ID NO: 18796 - protein, 9 aa, Artificial Sequence
  Description of Artificial Sequence: Synthetic peptide
QQYGNSPWA

SEQ ID NO: 18797 - DNA, 27 bp, Artificial Sequence
  Description of Artificial Sequence: Synthetic oligonucleotide
cagcagtataataactggccgtgcagt

SEQ ID NO: 18798 - protein, 9 aa, Artificial Sequence
  Description of Artificial Sequence: Synthetic peptide
QQYNNWPCS

SEQ ID NO: 18799 - DNA, 27 bp, Artificial Sequence
  Description of Artificial Sequence: Synthetic oligonucleotide
ctacattatcttacttaccctctcact

SEQ ID NO: 18800 - protein, 9 aa, Artificial Sequence
  Description of Artificial Sequence: Synthetic peptide
LHYLTYPLT

SEQ ID NO: 18801 - DNA, 27 bp, Artificial Sequence
  Description of Artificial Sequence: Synthetic oligonucleotide
cagcagagtagtagtttaccgtggacg

SEQ ID NO: 18802 - protein, 9 aa, Artificial Sequence
  Description of Artificial Sequence: Synthetic peptide
QQSSSLPWT

SEQ ID NO: 18803 - DNA, 27 bp, Artificial Sequence
  Description of Artificial Sequence: Synthetic oligonucleotide
cagcacaatgattactcaatgttcact

SEQ ID NO: 18804 - protein, 9 aa, Artificial Sequence
  Description of Artificial Sequence: Synthetic peptide
QHNDYSMFT

SEQ ID NO: 18805 - DNA, 27 bp, Artificial Sequence
  Description of Artificial Sequence: Synthetic oligonucleotide
atgcaaagtatacagcttccctggacg

SEQ ID NO: 18806 - protein, 9 aa, Artificial Sequence
  Description of Artificial Sequence: Synthetic peptide
MQSIQLPWT

SEQ ID NO: 18807 - DNA, 27 bp, Artificial Sequence
  Description of Artificial Sequence: Synthetic oligonucleotide
cagcagtatggtagttcaccgtggacg

SEQ ID NO: 18808 - protein, 9 aa, Artificial Sequence
  Description of Artificial Sequence: Synthetic peptide
QQYGSSPWT

SEQ ID NO: 18809 - DNA, 27 bp, Artificial Sequence
  Description of Artificial Sequence: Synthetic oligonucleotide
cagcagtatggtagctcaccgtggacg

SEQ ID NO: 18810 - protein, 9 aa, Artificial Sequence
  Description of Artificial Sequence: Synthetic peptide
QQYGSSPWT

SEQ ID NO: 18811 - DNA, 27 bp, Artificial Sequence
  Description of Artificial Sequence: Synthetic oligonucleotide
caacattatcttaattaccctctcacc

SEQ ID NO: 18812 - protein, 9 aa, Artificial Sequence
  Description of Artificial Sequence: Synthetic peptide
QHYLNYPLT

SEQ ID NO: 18813 - DNA, 27 bp, Artificial Sequence
  Description of Artificial Sequence: Synthetic oligonucleotide
caacaggctaacagtttcccgtggacg

SEQ ID NO: 18814 - protein, 9 aa, Artificial Sequence
  Description of Artificial Sequence: Synthetic peptide
QQANSFPWT

SEQ ID NO: 18815 - DNA, 27 bp, Artificial Sequence
  Description of Artificial Sequence: Synthetic oligonucleotide
cagcagtatgaaagctcaccgtggacg

SEQ ID NO: 18816 - protein, 9 aa, Artificial Sequence
  Description of Artificial Sequence: Synthetic peptide
QQYESSPWT

SEQ ID NO: 18817 - DNA, 27 bp, Artificial Sequence
  Description of Artificial Sequence: Synthetic oligonucleotide
ctacagcattatagtttcccattcact

SEQ ID NO: 18818 - protein, 9 aa, Artificial Sequence
  Description of Artificial Sequence: Synthetic peptide
LQHYSFPFT

SEQ ID NO: 18819 - DNA, 27 bp, Artificial Sequence
  Description of Artificial Sequence: Synthetic oligonucleotide
caacattatcttacttaccctctcact

SEQ ID NO: 18820 - protein, 9 aa, Artificial Sequence
  Description of Artificial Sequence: Synthetic peptide
QHYLTYPLT

SEQ ID NO: 18821 - DNA, 27 bp, Artificial Sequence
  Description of Artificial Sequence: Synthetic oligonucleotide
caacgatatgatacttacccattcact

SEQ ID NO: 18822 - protein, 9 aa, Artificial Sequence
  Description of Artificial Sequence: Synthetic peptide
QRYDTYPFT

SEQ ID NO: 18823 - DNA, 27 bp, Artificial Sequence
  Description of Artificial Sequence: Synthetic oligonucleotide
cagcagtatgaaagctcaccgtggacg

SEQ ID NO: 18824 - protein, 9 aa, Artificial Sequence
  Description of Artificial Sequence: Synthetic peptide
QQYESSPWT

SEQ ID NO: 18825 - DNA, 27 bp, Artificial Sequence
  Description of Artificial Sequence: Synthetic oligonucleotide
caacgggctaacagtttcccgtgcagt

SEQ ID NO: 18826 - protein, 9 aa, Artificial Sequence
  Description of Artificial Sequence: Synthetic peptide
QRANSFPCS

SEQ ID NO: 18827 - DNA, 27 bp, Artificial Sequence
  Description of Artificial Sequence: Synthetic oligonucleotide
catcagagtagaactttaccgctcact

SEQ ID NO: 18828 - protein, 9 aa, Artificial Sequence
  Description of Artificial Sequence: Synthetic peptide
HQSRTLPLT

SEQ ID NO: 18829 - DNA, 27 bp, Artificial Sequence
  Description of Artificial Sequence: Synthetic oligonucleotide
caacagtatatgacttacccgctcact

SEQ ID NO: 18830 - protein, 9 aa, Artificial Sequence
  Description of Artificial Sequence: Synthetic peptide
QQYMTYPLT

SEQ ID NO: 18831 - DNA, 27 bp, Artificial Sequence
  Description of Artificial Sequence: Synthetic oligonucleotide
cagcagtatggtaactcaccgtgggcg

SEQ ID NO: 18832 - protein, 9 aa, Artificial Sequence
  Description of Artificial Sequence: Synthetic peptide
QQYGNSPWA

SEQ ID NO: 18833 - DNA, 27 bp, Artificial Sequence
  Description of Artificial Sequence: Synthetic oligonucleotide
caacattatcttacttaccctctcact

SEQ ID NO: 18834 - protein, 9 aa, Artificial Sequence
  Description of Artificial Sequence: Synthetic peptide
QHYLTYPLT

SEQ ID NO: 18835 - DNA, 27 bp, Artificial Sequence
  Description of Artificial Sequence: Synthetic oligonucleotide
ctacagcattatcgttacccattcact

SEQ ID NO: 18836 - protein, 9 aa, Artificial Sequence
  Description of Artificial Sequence: Synthetic peptide
LQHYRYPFT

SEQ ID NO: 18837 - DNA, 27 bp, Artificial Sequence
  Description of Artificial Sequence: Synthetic oligonucleotide
catcagagtggtcgtttaccgctcact

SEQ ID NO: 18838 - protein, 9 aa, Artificial Sequence
  Description of Artificial Sequence: Synthetic peptide
HQSGRLPLT

SEQ ID NO: 18839 - DNA, 27 bp, Artificial Sequence
  Description of Artificial Sequence: Synthetic oligonucleotide
catcagagtagtcgtttaccattcact

SEQ ID NO: 18840 - protein, 9 aa, Artificial Sequence
  Description of Artificial Sequence: Synthetic peptide
HQSSRLPFT

SEQ ID NO: 18841 - DNA, 27 bp, Artificial Sequence
  Description of Artificial Sequence: Synthetic oligonucleotide
cagcaatattgtagttttccattcact

SEQ ID NO: 18842 - protein, 9 aa, Artificial Sequence
  Description of Artificial Sequence: Synthetic peptide
QQYCSFPFT

SEQ ID NO: 18843 - DNA, 27 bp, Artificial Sequence
  Description of Artificial Sequence: Synthetic oligonucleotide
caacaggctaacagtttcccgtggacg

SEQ ID NO: 18844 - protein, 9 aa, Artificial Sequence
  Description of Artificial Sequence: Synthetic peptide
QQANSFPWT

SEQ ID NO: 18845 - DNA, 27 bp, Artificial Sequence
  Description of Artificial Sequence: Synthetic oligonucleotide
cagcaatattctagtcttccattcact

SEQ ID NO: 18846 - protein, 9 aa, Artificial Sequence
  Description of Artificial Sequence: Synthetic peptide
QQYSSLPFT

SEQ ID NO: 18847 - DNA, 27 bp, Artificial Sequence
  Description of Artificial Sequence: Synthetic oligonucleotide
cagcaatattgtagttttccattcact

SEQ ID NO: 18848 - protein, 9 aa, Artificial Sequence
  Description of Artificial Sequence: Synthetic peptide
QQYCSFPFT

SEQ ID NO: 18849 - DNA, 27 bp, Artificial Sequence
  Description of Artificial Sequence: Synthetic oligonucleotide
caacagactaacagtgtcccattcact

SEQ ID NO: 18850 - protein, 9 aa, Artificial Sequence
  Description of Artificial Sequence: Synthetic peptide
QQTNSVPFT

SEQ ID NO: 18851 - DNA, 27 bp, Artificial Sequence
  Description of Artificial Sequence: Synthetic oligonucleotide
caacagagctacggttcccctctcact

SEQ ID NO: 18852 - protein, 9 aa, Artificial Sequence
  Description of Artificial Sequence: Synthetic peptide
QQSYGSPLT

SEQ ID NO: 18853 - DNA, 27 bp, Artificial Sequence
  Description of Artificial Sequence: Synthetic oligonucleotide
caacattatctcacttaccctctcact

SEQ ID NO: 18854 - protein, 9 aa, Artificial Sequence
  Description of Artificial Sequence: Synthetic peptide
QHYLTYPLT

SEQ ID NO: 18855 - DNA, 27 bp, Artificial Sequence
  Description of Artificial Sequence: Synthetic oligonucleotide
cagcaatattataatactcctccgaca

SEQ ID NO: 18856 - protein, 9 aa, Artificial Sequence
  Description of Artificial Sequence: Synthetic peptide
QQYYNTPPT

SEQ ID NO: 18857 - DNA, 27 bp, Artificial Sequence
  Description of Artificial Sequence: Synthetic oligonucleotide
caacagggtgacagtttccctccgacg

SEQ ID NO: 18858 - protein, 9 aa, Artificial Sequence
  Description of Artificial Sequence: Synthetic peptide
QQGDSFPPT

SEQ ID NO: 18859 - DNA, 27 bp, Artificial Sequence
  Description of Artificial Sequence: Synthetic oligonucleotide
caacgggataacagtttaccgtgcagt

SEQ ID NO: 18860 - protein, 9 aa, Artificial Sequence
  Description of Artificial Sequence: Synthetic peptide
QRDNSLPCS

SEQ ID NO: 18861 - DNA, 27 bp, Artificial Sequence
  Description of Artificial Sequence: Synthetic oligonucleotide
ctacaatataatagttaccctctcact

SEQ ID NO: 18862 - protein, 9 aa, Artificial Sequence
  Description of Artificial Sequence: Synthetic peptide
LQYNSYPLT

SEQ ID NO: 18863 - DNA, 30 bp, Artificial Sequence; identical to SEQ ID NO: 18581
  Description of Artificial Sequence: Synthetic oligonucleotide

SEQ ID NO: 18864 - protein, 10 aa, Artificial Sequence
  Description of Artificial Sequence: Synthetic peptide
QQYGSSPPWT

SEQ ID NO: 18865 - DNA, 27 bp, Artificial Sequence
  Description of Artificial Sequence: Synthetic oligonucleotide
ctacagcataatgatttcccgttcact

SEQ ID NO: 18866 - protein, 9 aa, Artificial Sequence
  Description of Artificial Sequence: Synthetic peptide
LQHNDFPFT

SEQ ID NO: 18867 - DNA, 27 bp, Artificial Sequence
  Description of Artificial Sequence: Synthetic oligonucleotide
cagcagtatggtaactcaccgtggacg

SEQ ID NO: 18868 - protein, 9 aa, Artificial Sequence
  Description of Artificial Sequence: Synthetic peptide
QQYGNSPWT

SEQ ID NO: 18869 - DNA, 27 bp, Artificial Sequence
  Description of Artificial Sequence: Synthetic oligonucleotide
caacaatatatcacttacccgctcact

SEQ ID NO: 18870 - protein, 9 aa, Artificial Sequence
  Description of Artificial Sequence: Synthetic peptide
QQYITYPLT

SEQ ID NO: 18871 - DNA, 27 bp, Artificial Sequence
  Description of Artificial Sequence: Synthetic oligonucleotide
caacagtatagtaattacccggtcact

SEQ ID NO: 18872 - protein, 9 aa, Artificial Sequence
  Description of Artificial Sequence: Synthetic peptide
QQYSNYPVT

SEQ ID NO: 18873 - DNA, 27 bp, Artificial Sequence
  Description of Artificial Sequence: Synthetic oligonucleotide
cagcagtatggaaactcaccgtgggcg

SEQ ID NO: 18874 - protein, 9 aa, Artificial Sequence
  Description of Artificial Sequence: Synthetic peptide
QQYGNSPWA

SEQ ID NO: 18875 - DNA, 27 bp, Artificial Sequence
  Description of Artificial Sequence: Synthetic oligonucleotide
caacaatattatagtactcctccgacg

SEQ ID NO: 18876 - protein, 9 aa, Artificial Sequence
  Description of Artificial Sequence: Synthetic peptide
QQYYSTPPT

SEQ ID NO: 18877 - DNA, 27 bp, Artificial Sequence
  Description of Artificial Sequence: Synthetic oligonucleotide
caacaatatagtacttacccgctcact

SEQ ID NO: 18878 - protein, 9 aa, Artificial Sequence
  Description of Artificial Sequence: Synthetic peptide
QQYSTYPLT

SEQ ID NO: 18879 - DNA, 27 bp, Artificial Sequence
  Description of Artificial Sequence: Synthetic oligonucleotide
caacaatattatagtactcctccgacg

SEQ ID NO: 18880 - protein, 9 aa, Artificial Sequence
  Description of Artificial Sequence: Synthetic peptide
QQYYSTPPT

SEQ ID NO: 18881 - DNA, 27 bp, Artificial Sequence
  Description of Artificial Sequence: Synthetic oligonucleotide
cagcagtcttatactattccattcact

SEQ ID NO: 18882 - protein, 9 aa, Artificial Sequence
  Description of Artificial Sequence: Synthetic peptide
QQSYTIPFT

SEQ ID NO: 18883 - DNA, 27 bp, Artificial Sequence
  Description of Artificial Sequence: Synthetic oligonucleotide
atgcaaagtatacagcttccctggacg

SEQ ID NO: 18884 - protein, 9 aa, Artificial Sequence
  Description of Artificial Sequence: Synthetic peptide
MQSIQLPWT

SEQ ID NO: 18885 - DNA, 27 bp, Artificial Sequence
  Description of Artificial Sequence: Synthetic oligonucleotide
caacaggctaacagtttcccgtggacg

SEQ ID NO: 18886 - protein, 9 aa, Artificial Sequence
  Description of Artificial Sequence: Synthetic peptide
QQANSFPWT

SEQ ID NO: 18887 - DNA, 27 bp, Artificial Sequence
  Description of Artificial Sequence: Synthetic oligonucleotide
ctacagcattataggtacccattcact

SEQ ID NO: 18888 - protein, 9 aa, Artificial Sequence
  Description of Artificial Sequence: Synthetic peptide
LQHYRYPFT

SEQ ID NO: 18889 - DNA, 27 bp, Artificial Sequence
  Description of Artificial Sequence: Synthetic oligonucleotide
caacgatatgacacttacccattcact

SEQ ID NO: 18890 - protein, 9 aa, Artificial Sequence
  Description of Artificial Sequence: Synthetic peptide
QRYDTYPFT

SEQ ID NO: 18891 - DNA, 27 bp, Artificial Sequence
  Description of Artificial Sequence: Synthetic oligonucleotide
caacaatatatgacttacccgctcact

SEQ ID NO: 18892 - protein, 9 aa, Artificial Sequence
  Description of Artificial Sequence: Synthetic peptide
QQYMTYPLT

SEQ ID NO: 18893 - DNA, 27 bp, Artificial Sequence
  Description of Artificial Sequence: Synthetic oligonucleotide
cagcagtatggtagctcaccgtggacg

SEQ ID NO: 18894 - protein, 9 aa, Artificial Sequence
  Description of Artificial Sequence: Synthetic peptide
QQYGSSPWT

SEQ ID NO: 18895 - DNA, 27 bp, Artificial Sequence
  Description of Artificial Sequence: Synthetic oligonucleotide
cagcagtatggtaattcaccgtggacg

SEQ ID NO: 18896 - protein, 9 aa, Artificial Sequence
  Description of Artificial Sequence: Synthetic peptide
QQYGNSPWT

SEQ ID NO: 18897 - DNA, 27 bp, Artificial Sequence
  Description of Artificial Sequence: Synthetic oligonucleotide
cagcagtatggtaactcaccgtggacg

SEQ ID NO: 18898 - protein, 9 aa, Artificial Sequence
  Description of Artificial Sequence: Synthetic peptide
QQYGNSPWT

SEQ ID NO: 18899 - DNA, 27 bp, Artificial Sequence
  Description of Artificial Sequence: Synthetic oligonucleotide
caacaatatagtacttacccgctcact

SEQ ID NO: 18900 - protein, 9 aa, Artificial Sequence
  Description of Artificial Sequence: Synthetic peptide
QQYSTYPLT

SEQ ID NO: 18901 - DNA, 27 bp, Artificial Sequence
  Description of Artificial Sequence: Synthetic oligonucleotide
ctacaacattatcgttaccctttcact

SEQ ID NO: 18902 - protein, 9 aa, Artificial Sequence
  Description of Artificial Sequence: Synthetic peptide
LQHYRYPFT

SEQ ID NO: 18903 - DNA, 27 bp, Artificial Sequence
  Description of Artificial Sequence: Synthetic oligonucleotide
atgcaaagtatacagcttccctggacg

SEQ ID NO: 18904 - protein, 9 aa, Artificial Sequence
  Description of Artificial Sequence: Synthetic peptide
MQSIQLPWT

SEQ ID NO: 18905 - DNA, 27 bp, Artificial Sequence
  Description of Artificial Sequence: Synthetic oligonucleotide
cagcagtatggtaactcaccgtgggcg

SEQ ID NO: 18906 - protein, 9 aa, Artificial Sequence
  Description of Artificial Sequence: Synthetic peptide
QQYGNSPWA

SEQ ID NO: 18907 - DNA, 27 bp, Artificial Sequence
  Description of Artificial Sequence: Synthetic oligonucleotide
cagcagtatggtaactcaccgtgggcg

SEQ ID NO: 18908 - protein, 9 aa, Artificial Sequence
  Description of Artificial Sequence: Synthetic peptide
QQYGNSPWA

SEQ ID NO: 18909 - DNA, 27 bp, Artificial Sequence
  Description of Artificial Sequence: Synthetic oligonucleotide
ctacagcataaaaggtacccgctcact

SEQ ID NO: 18910 - protein, 9 aa, Artificial Sequence
  Description of Artificial Sequence: Synthetic peptide
LQHKRYPLT

SEQ ID NO: 18911 - DNA, 27 bp, Artificial Sequence
  Description of Artificial Sequence: Synthetic oligonucleotide
caacagtatcttacttacccgctcact

SEQ ID NO: 18912 - protein, 9 aa, Artificial Sequence
  Description of Artificial Sequence: Synthetic peptide
QQYLTYPLT

SEQ ID NO: 18913 - DNA, 27 bp, Artificial Sequence
  Description of Artificial Sequence: Synthetic oligonucleotide
cagcagtataataactggccgctcact

SEQ ID NO: 18914 - protein, 9 aa, Artificial Sequence
  Description of Artificial Sequence: Synthetic peptide
QQYNNWPLT

SEQ ID NO: 18915 - DNA, 27 bp, Artificial Sequence
  Description of Artificial Sequence: Synthetic oligonucleotide
ctacaacattatcgttaccctttcact

SEQ ID NO: 18916 - protein, 9 aa, Artificial Sequence
  Description of Artificial Sequence: Synthetic peptide
LQHYRYPFT

SEQ ID NO: 18917 - DNA, 27 bp, Artificial Sequence
  Description of Artificial Sequence: Synthetic oligonucleotide
cagcagtatggtaactcaccgtggacg

SEQ ID NO: 18918 - protein, 9 aa, Artificial Sequence
  Description of Artificial Sequence: Synthetic peptide
QQYGNSPWT

SEQ ID NO: 18919 - DNA, 27 bp, Artificial Sequence
  Description of Artificial Sequence: Synthetic oligonucleotide
cagcagtatggtaactcaccgtggacg

SEQ ID NO: 18920 - protein, 9 aa, Artificial Sequence
  Description of Artificial Sequence: Synthetic peptide
QQYGNSPWT

SEQ ID NO: 18921 - DNA, 30 bp, Artificial Sequence; identical to SEQ ID NO: 18579
  Description of Artificial Sequence: Synthetic oligonucleotide

SEQ ID NO: 18922 - protein, 10 aa, Artificial Sequence
  Description of Artificial Sequence: Synthetic peptide
QQSYSSPPWT

SEQ ID NO: 18923 - DNA, 27 bp, Artificial Sequence
  Description of Artificial Sequence: Synthetic oligonucleotide
ctacagcattatcgttacccattcact

SEQ ID NO: 18924 - protein, 9 aa, Artificial Sequence
  Description of Artificial Sequence: Synthetic peptide
LQHYRYPFT

SEQ ID NO: 18925 - DNA, 27 bp, Artificial Sequence
  Description of Artificial Sequence: Synthetic oligonucleotide
catcagagtggtagtttacctcagacg

SEQ ID NO: 18926 - protein, 9 aa, Artificial Sequence
  Description of Artificial Sequence: Synthetic peptide
HQSGSLPQT

SEQ ID NO: 18927 - DNA, 27 bp, Artificial Sequence
  Description of Artificial Sequence: Synthetic oligonucleotide
cagcaatattataatactcctccgaca

SEQ ID NO: 18928 - protein, 9 aa, Artificial Sequence
  Description of Artificial Sequence: Synthetic peptide
QQYYNTPPT

SEQ ID NO: 18929 - DNA, 27 bp, Artificial Sequence
  Description of Artificial Sequence: Synthetic oligonucleotide
cagcagagtagtagtttaccgtggacg

SEQ ID NO: 18930 - protein, 9 aa, Artificial Sequence
  Description of Artificial Sequence: Synthetic peptide
QQSSSLPWT

SEQ ID NO: 18931 - DNA, 27 bp, Artificial Sequence
  Description of Artificial Sequence: Synthetic oligonucleotide
ctacagcataatagttacccgtggacg

SEQ ID NO: 18932 - protein, 9 aa, Artificial Sequence
  Description of Artificial Sequence: Synthetic peptide
LQHNSYPWT

SEQ ID NO: 18933 - DNA, 27 bp, Artificial Sequence
  Description of Artificial Sequence: Synthetic oligonucleotide
cagcagtatggtaactcaccgtgggcg

SEQ ID NO: 18934 - protein, 9 aa, Artificial Sequence
  Description of Artificial Sequence: Synthetic peptide
QQYGNSPWA

SEQ ID NO: 18935 - DNA, 27 bp, Artificial Sequence
  Description of Artificial Sequence: Synthetic oligonucleotide
ctacagcataagagttacccgctcact

SEQ ID NO: 18936 - protein, 9 aa, Artificial Sequence
  Description of Artificial Sequence: Synthetic peptide
LQHKSYPLT

SEQ ID NO: 18937 - DNA, 27 bp, Artificial Sequence
  Description of Artificial Sequence: Synthetic oligonucleotide
ctacagcataaaagttaccctctcact

SEQ ID NO: 18938 - protein, 9 aa, Artificial Sequence
  Description of Artificial Sequence: Synthetic peptide
LQHKSYPLT

SEQ ID NO: 18939 - DNA, 27 bp, Artificial Sequence
  Description of Artificial Sequence: Synthetic oligonucleotide
caccagtatgagacctcaccgtggacg

SEQ ID NO: 18940 - protein, 9 aa, Artificial Sequence
  Description of Artificial Sequence: Synthetic peptide
HQYETSPWT

SEQ ID NO: 18941 - DNA, 33 bp, Artificial Sequence
  Description of Artificial Sequence: Synthetic oligonucleotide
acagcatgggatgacagcctgaatggttgggtg

SEQ ID NO: 18942 - protein, 11 aa, Artificial Sequence
  Description of Artificial Sequence: Synthetic peptide
TAWDDSLNGWV

SEQ ID NO: 18943 - DNA, 27 bp, Artificial Sequence
  Description of Artificial Sequence: Synthetic oligonucleotide
cagcagttttataactggctgtgcagt

SEQ ID NO: 18944 - protein, 9 aa, Artificial Sequence
  Description of Artificial Sequence: Synthetic peptide
QQFYNWLCS

SEQ ID NO: 18945 - DNA, 27 bp, Artificial Sequence
  Description of Artificial Sequence: Synthetic oligonucleotide
cagcagtatgaaaactcaccgtggacg

SEQ ID NO: 18946 - protein, 9 aa, Artificial Sequence
  Description of Artificial Sequence: Synthetic peptide
QQYENSPWT

SEQ ID NO: 18947 - DNA, 27 bp, Artificial Sequence
  Description of Artificial Sequence: Synthetic oligonucleotide
catcagagtcgaagtttaccgctcact

SEQ ID NO: 18948 - protein, 9 aa, Artificial Sequence
  Description of Artificial Sequence: Synthetic peptide
HQSRSLPLT

SEQ ID NO: 18949 - DNA, 27 bp, Artificial Sequence
  Description of Artificial Sequence: Synthetic oligonucleotide
ctacagcataatagttacccgctcact

SEQ ID NO: 18950 - protein, 9 aa, Artificial Sequence
  Description of Artificial Sequence: Synthetic peptide
LQHNSYPLT

SEQ ID NO: 18951 - DNA, 27 bp, Artificial Sequence
  Description of Artificial Sequence: Synthetic oligonucleotide
caacagagttacagtttcccgctcact

SEQ ID NO: 18952 - protein, 9 aa, Artificial Sequence
  Description of Artificial Sequence: Synthetic peptide
QQSYSFPLT

SEQ ID NO: 18953 - DNA, 24 bp, Artificial Sequence
  Description of Artificial Sequence: Synthetic oligonucleotide
atgcaagctctacaaactcccact

SEQ ID NO: 18954 - protein, 8 aa, Artificial Sequence
  Description of Artificial Sequence: Synthetic peptide
MQALQTPT

SEQ ID NO: 18955 - DNA, 27 bp, Artificial Sequence
  Description of Artificial Sequence: Synthetic oligonucleotide
ctacagcatcatgactacccattcact

SEQ ID NO: 18956 - protein, 9 aa, Artificial Sequence
  Description of Artificial Sequence: Synthetic peptide
LQHHDYPFT

SEQ ID NO: 18957 - DNA, 27 bp, Artificial Sequence
  Description of Artificial Sequence: Synthetic oligonucleotide
cagcagttttataactggctgtgcagt

SEQ ID NO: 18958 - protein, 9 aa, Artificial Sequence
  Description of Artificial Sequence: Synthetic peptide
QQFYNWLCS

SEQ ID NO: 18959 - DNA, 27 bp, Artificial Sequence
  Description of Artificial Sequence: Synthetic oligonucleotide
cagcagtattataactggctgtgcagt

SEQ ID NO: 18960 - protein, 9 aa, Artificial Sequence
  Description of Artificial Sequence: Synthetic peptide
QQYYNWLCS

SEQ ID NO: 18961 - DNA, 24 bp, Artificial Sequence
  Description of Artificial Sequence: Synthetic oligonucleotide
atgcaagctctacaaactcccact

SEQ ID NO: 18962 - protein, 8 aa, Artificial Sequence
  Description of Artificial Sequence: Synthetic peptide
MQALQTPT

SEQ ID NO: 18963 - DNA, 27 bp, Artificial Sequence
  Description of Artificial Sequence: Synthetic oligonucleotide
caacaatatgagacctcaccgtggacg

SEQ ID NO: 18964 - protein, 9 aa, Artificial Sequence
  Description of Artificial Sequence: Synthetic peptide
QQYETSPWT

SEQ ID NO: 18965 - DNA, 30 bp, Artificial Sequence
  Description of Artificial Sequence: Synthetic oligonucleotide
cagcagtatgataactggcctccgtgcagt

SEQ ID NO: 18966 - protein, 10 aa, Artificial Sequence
  Description of Artificial Sequence: Synthetic peptide
QQYDNWPPCS

SEQ ID NO: 18967 - DNA, 27 bp, Artificial Sequence
  Description of Artificial Sequence: Synthetic oligonucleotide
caacggtatcatacttacccgctcact

SEQ ID NO: 18968 - protein, 9 aa, Artificial Sequence
  Description of Artificial Sequence: Synthetic peptide
QRYHTYPLT

SEQ ID NO: 18969 - DNA, 27 bp, Artificial Sequence
  Description of Artificial Sequence: Synthetic oligonucleotide
caacagagttacagtttcccgctcact

SEQ ID NO: 18970 - protein, 9 aa, Artificial Sequence
  Description of Artificial Sequence: Synthetic peptide
QQSYSFPLT

SEQ ID NO: 18971 - DNA, 27 bp, Artificial Sequence
  Description of Artificial Sequence: Synthetic oligonucleotide
ctacagcattatagtttccctcggacg

SEQ ID NO: 18972 - protein, 9 aa, Artificial Sequence
  Description of Artificial Sequence: Synthetic peptide
LQHYSFPRT

SEQ ID NO: 18973 - DNA, 27 bp, Artificial Sequence
  Description of Artificial Sequence: Synthetic oligonucleotide
ctacagcataatagttacccattcact

SEQ ID NO: 18974 - protein, 9 aa, Artificial Sequence
  Description of Artificial Sequence: Synthetic peptide
LQHNSYPFT

SEQ ID NO: 18975 - DNA, 27 bp, Artificial Sequence
  Description of Artificial Sequence: Synthetic oligonucleotide
caacaatattttagtcttccattcact

SEQ ID NO: 18976 - protein, 9 aa, Artificial Sequence
  Description of Artificial Sequence: Synthetic peptide
QQYFSLPFT

SEQ ID NO: 18977 - DNA, 27 bp, Artificial Sequence
  Description of Artificial Sequence: Synthetic oligonucleotide
cagcaatattatagtactcctccgacg

SEQ ID NO: 18978 - protein, 9 aa, Artificial Sequence
  Description of Artificial Sequence: Synthetic peptide
QQYYSTPPT

SEQ ID NO: 18979 - DNA, 27 bp, Artificial Sequence
  Description of Artificial Sequence: Synthetic oligonucleotide
ctacagcattatagttaccctcggacg

SEQ ID NO: 18980 - protein, 9 aa, Artificial Sequence
  Description of Artificial Sequence: Synthetic peptide
LQHYSYPRT

SEQ ID NO: 18981 - DNA, 27 bp, Artificial Sequence
  Description of Artificial Sequence: Synthetic oligonucleotide
caacagagttacagtttcccgctcact

SEQ ID NO: 18982 - protein, 9 aa, Artificial Sequence
  Description of Artificial Sequence: Synthetic peptide
QQSYSFPLT

SEQ ID NO: 18983 - DNA, 27 bp, Artificial Sequence
  Description of Artificial Sequence: Synthetic oligonucleotide
cagcagttttataactggctgtgcagt

SEQ ID NO: 18984 - protein, 9 aa, Artificial Sequence
  Description of Artificial Sequence: Synthetic peptide
QQFYNWLCS

SEQ ID NO: 18985 - DNA, 27 bp, Artificial Sequence
  Description of Artificial Sequence: Synthetic oligonucleotide
caacagagttacagttccccgctcact

SEQ ID NO: 18986 - protein, 9 aa, Artificial Sequence
  Description of Artificial Sequence: Synthetic peptide
QQSYSSPLT

SEQ ID NO: 18987 - DNA, 27 bp, Artificial Sequence
  Description of Artificial Sequence: Synthetic oligonucleotide
caacactatcttagttaccctctcact

SEQ ID NO: 18988 - protein, 9 aa, Artificial Sequence
  Description of Artificial Sequence: Synthetic peptide
QHYLSYPLT

SEQ ID NO: 18989 - DNA, 27 bp, Artificial Sequence
  Description of Artificial Sequence: Synthetic oligonucleotide
caacagtatagtaattacccggtcact

SEQ ID NO: 18990 - protein, 9 aa, Artificial Sequence
  Description of Artificial Sequence: Synthetic peptide
QQYSNYPVT

SEQ ID NO: 18991 - DNA, 27 bp, Artificial Sequence
  Description of Artificial Sequence: Synthetic oligonucleotide
ctacaacataatagttaccctctcact

SEQ ID NO: 18992 - protein, 9 aa, Artificial Sequence
  Description of Artificial Sequence: Synthetic peptide
LQHNSYPLT

SEQ ID NO: 18993 - DNA, 27 bp, Artificial Sequence
  Description of Artificial Sequence: Synthetic oligonucleotide
cagcagtatggtagctcaccgtgcagt

SEQ ID NO: 18994 - protein, 9 aa, Artificial Sequence
  Description of Artificial Sequence: Synthetic peptide
QQYGSSPCS

SEQ ID NO: 18995 - DNA, 27 bp, Artificial Sequence
  Description of Artificial Sequence: Synthetic oligonucleotide
caacaatatagtaattacccactcact

SEQ ID NO: 18996 - protein, 9 aa, Artificial Sequence
  Description of Artificial Sequence: Synthetic peptide
QQYSNYPLT

SEQ ID NO: 18997 - DNA, 27 bp, Artificial Sequence
  Description of Artificial Sequence: Synthetic oligonucleotide
cagcagttttataactggctgtgcagt

SEQ ID NO: 18998 - protein, 9 aa, Artificial Sequence
  Description of Artificial Sequence: Synthetic peptide
QQFYNWLCS

SEQ ID NO: 18999 - DNA, 27 bp, Artificial Sequence
  Description of Artificial Sequence: Synthetic oligonucleotide
caacaatatagtaattaccctctcact

SEQ ID NO: 19000 - protein, 9 aa, Artificial Sequence
  Description of Artificial Sequence: Synthetic peptide
QQYSNYPLT

SEQ ID NO: 19001 - DNA, 27 bp, Artificial Sequence
  Description of Artificial Sequence: Synthetic oligonucleotide
cagcagtatgaaagttcaccgtggacg

SEQ ID NO: 19002 - protein, 9 aa, Artificial Sequence
  Description of Artificial Sequence: Synthetic peptide
QQYESSPWT

SEQ ID NO: 19003 - DNA, 24 bp, Artificial Sequence
  Description of Artificial Sequence: Synthetic oligonucleotide
atgcaagctctacaaactcccact

SEQ ID NO: 19004 - protein, 8 aa, Artificial Sequence
  Description of Artificial Sequence: Synthetic peptide
MQALQTPT

SEQ ID NO: 19005 - DNA, 27 bp, Artificial Sequence
  Description of Artificial Sequence: Synthetic oligonucleotide
caagagtataatgactggccgtgcagt

SEQ ID NO: 19006 - protein, 9 aa, Artificial Sequence
  Description of Artificial Sequence: Synthetic peptide
QEYNDWPCS

SEQ ID NO: 19007 - DNA, 27 bp, Artificial Sequence
  Description of Artificial Sequence: Synthetic oligonucleotide
ctacagcataatagttacccgctcact

SEQ ID NO: 19008 - protein, 9 aa, Artificial Sequence
  Description of Artificial Sequence: Synthetic peptide
LQHNSYPLT

SEQ ID NO: 19009 - DNA, 27 bp, Artificial Sequence
  Description of Artificial Sequence: Synthetic oligonucleotide
cagcagtatgaaaactcaccgtggacg

SEQ ID NO: 19010 - protein, 9 aa, Artificial Sequence
  Description of Artificial Sequence: Synthetic peptide
QQYENSPWT

SEQ ID NO: 19011 - DNA, 27 bp, Artificial Sequence
  Description of Artificial Sequence: Synthetic oligonucleotide
caacagagttacagtttcccgctcact

SEQ ID NO: 19012 - protein, 9 aa, Artificial Sequence
  Description of Artificial Sequence: Synthetic peptide
QQSYSFPLT

SEQ ID NO: 19013 - DNA, 27 bp, Artificial Sequence
  Description of Artificial Sequence: Synthetic oligonucleotide
catcagagtagaagtttaccgctcact

SEQ ID NO: 19014 - protein, 9 aa, Artificial Sequence
  Description of Artificial Sequence: Synthetic peptide
HQSRSLPLT

SEQ ID NO: 19015 - DNA, 27 bp, Artificial Sequence
  Description of Artificial Sequence: Synthetic oligonucleotide
caacagagttacagtttcccgctcact

SEQ ID NO: 19016 - protein, 9 aa, Artificial Sequence
  Description of Artificial Sequence: Synthetic peptide
QQSYSFPLT

SEQ ID NO: 19017 - DNA, 27 bp, Artificial Sequence
  Description of Artificial Sequence: Synthetic oligonucleotide
caacagtacagtaattaccctctcact

SEQ ID NO: 19018 - protein, 9 aa, Artificial Sequence
  Description of Artificial Sequence: Synthetic peptide
QQYSNYPLT

SEQ ID NO: 19019 - DNA, 27 bp, Artificial Sequence
  Description of Artificial Sequence: Synthetic oligonucleotide
ctacagcataatagttaccctctcacc

SEQ ID NO: 19020 - protein, 9 aa, Artificial Sequence
  Description of Artificial Sequence: Synthetic peptide
LQHNSYPLT

SEQ ID NO: 19021 - DNA, 27 bp, Artificial Sequence
  Description of Artificial Sequence: Synthetic oligonucleotide
ctacagcattatagttaccctcggacg

SEQ ID NO: 19022 - protein, 9 aa, Artificial Sequence
  Description of Artificial Sequence: Synthetic peptide
LQHYSYPRT

SEQ ID NO: 19023 - DNA, 24 bp, Artificial Sequence
  Description of Artificial Sequence: Synthetic oligonucleotide
atgcaagctctacaaactcccact

SEQ ID NO: 19024 - protein, 8 aa, Artificial Sequence
  Description of Artificial Sequence: Synthetic peptide
MQALQTPT

SEQ ID NO: 19025 - DNA, 27 bp, Artificial Sequence
  Description of Artificial Sequence: Synthetic oligonucleotide
cagcactacgaaaactcaccgtggacg

SEQ ID NO: 19026 - protein, 9 aa, Artificial Sequence
  Description of Artificial Sequence: Synthetic peptide
QHYENSPWT

SEQ ID NO: 19027 - DNA, 27 bp, Artificial Sequence
  Description of Artificial Sequence: Synthetic oligonucleotide
caacagagttacagtttcccgctcact

SEQ ID NO: 19028 - protein, 9 aa, Artificial Sequence
  Description of Artificial Sequence: Synthetic peptide
QQSYSFPLT

SEQ ID NO: 19029 - DNA, 27 bp, Artificial Sequence
  Description of Artificial Sequence: Synthetic oligonucleotide
cagcactatcatagctcaccgtggacg

SEQ ID NO: 19030 - protein, 9 aa, Artificial Sequence
  Description of Artificial Sequence: Synthetic peptide
QHYHSSPWT

SEQ ID NO: 19031 - DNA, 27 bp, Artificial Sequence
  Description of Artificial Sequence: Synthetic oligonucleotide
caacagagttacagtttcccgctcact

SEQ ID NO: 19032 - protein, 9 aa, Artificial Sequence
  Description of Artificial Sequence: Synthetic peptide
QQSYSFPLT

SEQ ID NO: 19033 - DNA, 27 bp, Artificial Sequence
  Description of Artificial Sequence: Synthetic oligonucleotide
ctacagcataatagttacccattcact

SEQ ID NO: 19034 - protein, 9 aa, Artificial Sequence
  Description of Artificial Sequence: Synthetic peptide
LQHNSYPFT

SEQ ID NO: 19035 - DNA, 27 bp, Artificial Sequence
  Description of Artificial Sequence: Synthetic oligonucleotide
ctacaccattatagttaccctcggacg

SEQ ID NO: 19036 - protein, 9 aa, Artificial Sequence
  Description of Artificial Sequence: Synthetic peptide
LHHYSYPRT

SEQ ID NO: 19037 - DNA, 27 bp, Artificial Sequence
  Description of Artificial Sequence: Synthetic oligonucleotide
ctacagtataatagttaccctcccacc

SEQ ID NO: 19038 - protein, 9 aa, Artificial Sequence
  Description of Artificial Sequence: Synthetic peptide
LQYNSYPPT

SEQ ID NO: 19039 - DNA, 27 bp, Artificial Sequence
  Description of Artificial Sequence: Synthetic oligonucleotide
cagcagtattataactggctgtgcagt

SEQ ID NO: 19040 - protein, 9 aa, Artificial Sequence
  Description of Artificial Sequence: Synthetic peptide
QQYYNWLCS

SEQ ID NO: 19041 - DNA, 27 bp, Artificial Sequence
  Description of Artificial Sequence: Synthetic oligonucleotide
caacagagttacagtttcccgctcact

SEQ ID NO: 19042 - protein, 9 aa, Artificial Sequence
  Description of Artificial Sequence: Synthetic peptide
QQSYSFPLT

SEQ ID NO: 19043 - DNA, 27 bp, Artificial Sequence
  Description of Artificial Sequence: Synthetic oligonucleotide
caacaggctaaaagtttcccattcact

SEQ ID NO: 19044 - protein, 9 aa, Artificial Sequence
  Description of Artificial Sequence: Synthetic peptide
QQAKSFPFT

SEQ ID NO: 19045 - DNA, 30 bp, Artificial Sequence
  Description of Artificial Sequence: Synthetic oligonucleotide
atgcaagctctacaaactcccatgtgcagt

SEQ ID NO: 19046 - protein, 10 aa, Artificial Sequence
  Description of Artificial Sequence: Synthetic peptide
MQALQTPMCS

SEQ ID NO: 19047 - DNA, 27 bp, Artificial Sequence
  Description of Artificial Sequence: Synthetic oligonucleotide
caacactatatgacttacccgctcact

SEQ ID NO: 19048 - protein, 9 aa, Artificial Sequence
  Description of Artificial Sequence: Synthetic peptide
QHYMTYPLT

SEQ ID NO: 19049 - DNA, 27 bp, Artificial Sequence
  Description of Artificial Sequence: Synthetic oligonucleotide
caacagtatagtaattatccgctcact

SEQ ID NO: 19050 - protein, 9 aa, Artificial Sequence
  Description of Artificial Sequence: Synthetic peptide
QQYSNYPLT

SEQ ID NO: 19051 - DNA, 27 bp, Artificial Sequence
  Description of Artificial Sequence: Synthetic oligonucleotide
cagcagtatgttagctcaccgctcact

SEQ ID NO: 19052 - protein, 9 aa, Artificial Sequence
  Description of Artificial Sequence: Synthetic peptide
QQYVSSPLT

SEQ ID NO: 19053 - DNA, 27 bp, Artificial Sequence
  Description of Artificial Sequence: Synthetic oligonucleotide
caaaagtatgatacttacccattcact

SEQ ID NO: 19054 - protein, 9 aa, Artificial Sequence
  Description of Artificial Sequence: Synthetic peptide
QKYDTYPFT

SEQ ID NO: 19055 - DNA, 27 bp, Artificial Sequence
  Description of Artificial Sequence: Synthetic oligonucleotide
ctacggtatgatacttaccctctcatt

SEQ ID NO: 19056 - protein, 9 aa, Artificial Sequence
  Description of Artificial Sequence: Synthetic peptide
LRYDTYPLI

SEQ ID NO: 19057 - DNA, 30 bp, Artificial Sequence
  Description of Artificial Sequence: Synthetic oligonucleotide
atgcaagctctactaactcccgtgtgcagt

SEQ ID NO: 19058 - protein, 10 aa, Artificial Sequence
  Description of Artificial Sequence: Synthetic peptide
MQALLTPVCS

SEQ ID NO: 19059 - DNA, 27 bp, Artificial Sequence
  Description of Artificial Sequence: Synthetic oligonucleotide
caacagtatgttacctaccctctcact

SEQ ID NO: 19060 - protein, 9 aa, Artificial Sequence
  Description of Artificial Sequence: Synthetic peptide
QQYVTYPLT

SEQ ID NO: 19061 - DNA, 27 bp, Artificial Sequence
  Description of Artificial Sequence: Synthetic oligonucleotide
cagcagtatagtaattaccctctcact

SEQ ID NO: 19062 - protein, 9 aa, Artificial Sequence
  Description of Artificial Sequence: Synthetic peptide
QQYSNYPLT

SEQ ID NO: 19063 - DNA, 27 bp, Artificial Sequence
  Description of Artificial Sequence: Synthetic oligonucleotide
ctacggtatgatacttaccctctcact

SEQ ID NO: 19064 - protein, 9 aa, Artificial Sequence
  Description of Artificial Sequence: Synthetic peptide
LRYDTYPLT

SEQ ID NO: 19065 - DNA, 27 bp, Artificial Sequence
  Description of Artificial Sequence: Synthetic oligonucleotide
cagcagtataatgactggccgtgcagt

SEQ ID NO: 19066 - protein, 9 aa, Artificial Sequence
  Description of Artificial Sequence: Synthetic peptide
QQYNDWPCS

SEQ ID NO: 19067 - DNA, 27 bp, Artificial Sequence
  Description of Artificial Sequence: Synthetic oligonucleotide
caacactatagtaattacccgctcact

SEQ ID NO: 19068 - protein, 9 aa, Artificial Sequence
  Description of Artificial Sequence: Synthetic peptide
QHYSNYPLT

SEQ ID NO: 19069 - DNA, 27 bp, Artificial Sequence
  Description of Artificial Sequence: Synthetic oligonucleotide
ctactgcattatagttaccctcggacg

SEQ ID NO: 19070 - protein, 9 aa, Artificial Sequence
  Description of Artificial Sequence: Synthetic peptide
LLHYSYPRT

SEQ ID NO: 19071 - DNA, 27 bp, Artificial Sequence
  Description of Artificial Sequence: Synthetic oligonucleotide
caacactatagtaattatccgctcact

SEQ ID NO: 19072 - protein, 9 aa, Artificial Sequence
  Description of Artificial Sequence: Synthetic peptide
QHYSNYPLT

SEQ ID NO: 19073 - DNA, 27 bp, Artificial Sequence
  Description of Artificial Sequence: Synthetic oligonucleotide
caccagtatagtaattaccctctcact

SEQ ID NO: 19074 - protein, 9 aa, Artificial Sequence
  Description of Artificial Sequence: Synthetic peptide
HQYSNYPLT

SEQ ID NO: 19075 - DNA, 27 bp, Artificial Sequence
  Description of Artificial Sequence: Synthetic oligonucleotide
caaaagtatgatacttacccattcact

SEQ ID NO: 19076 - protein, 9 aa, Artificial Sequence
  Description of Artificial Sequence: Synthetic peptide
QKYDTYPFT

SEQ ID NO: 19077 - DNA, 27 bp, Artificial Sequence
  Description of Artificial Sequence: Synthetic oligonucleotide
caacagtatagtaattaccctctcact

SEQ ID NO: 19078 - protein, 9 aa, Artificial Sequence
  Description of Artificial Sequence: Synthetic peptide
QQYSNYPLT

SEQ ID NO: 19079 - DNA, 27 bp, Artificial Sequence
  Description of Artificial Sequence: Synthetic oligonucleotide
caacactatagtaattatccgctcact

SEQ ID NO: 19080 - protein, 9 aa, Artificial Sequence
  Description of Artificial Sequence: Synthetic peptide
QHYSNYPLT

SEQ ID NO: 19081 - DNA, 27 bp, Artificial Sequence
  Description of Artificial Sequence: Synthetic oligonucleotide
caacagtatagtaattaccctctcact

SEQ ID NO: 19082 - protein, 9 aa, Artificial Sequence
  Description of Artificial Sequence: Synthetic peptide
QQYSNYPLT

SEQ ID NO: 19083 - DNA, 27 bp, Artificial Sequence
  Description of Artificial Sequence: Synthetic oligonucleotide
cagcaatattataacattcctccgacg

SEQ ID NO: 19084 - protein, 9 aa, Artificial Sequence
  Description of Artificial Sequence: Synthetic peptide
QQYYNIPPT

SEQ ID NO: 19085 - DNA, 27 bp, Artificial Sequence
  Description of Artificial Sequence: Synthetic oligonucleotide
caccaatattatagtattccgtggacc

SEQ ID NO: 19086 - protein, 9 aa, Artificial Sequence
  Description of Artificial Sequence: Synthetic peptide
HQYYSIPWT

SEQ ID NO: 19087 - DNA, 27 bp, Artificial Sequence
  Description of Artificial Sequence: Synthetic oligonucleotide
caacaatatatgacttacccaatcact

SEQ ID NO: 19088 - protein, 9 aa, Artificial Sequence
  Description of Artificial Sequence: Synthetic peptide
QQYMTYPIT

SEQ ID NO: 19089 - DNA, 27 bp, Artificial Sequence
  Description of Artificial Sequence: Synthetic oligonucleotide
caacagtatcttacttacccattcact

SEQ ID NO: 19090 - protein, 9 aa, Artificial Sequence
  Description of Artificial Sequence: Synthetic peptide
QQYLTYPFT

SEQ ID NO: 19091 - DNA, 27 bp, Artificial Sequence
  Description of Artificial Sequence: Synthetic oligonucleotide
catcagagtcgtagtttaccattcact

SEQ ID NO: 19092 - protein, 9 aa, Artificial Sequence
  Description of Artificial Sequence: Synthetic peptide
HQSRSLPFT

SEQ ID NO: 19093 - DNA, 27 bp, Artificial Sequence
  Description of Artificial Sequence: Synthetic oligonucleotide
caacagtatagtaattaccctctcact

SEQ ID NO: 19094 - protein, 9 aa, Artificial Sequence
  Description of Artificial Sequence: Synthetic peptide
QQYSNYPLT

SEQ ID NO: 19095 - DNA, 27 bp, Artificial Sequence
  Description of Artificial Sequence: Synthetic oligonucleotide
ctacagcattatagttaccctcggacg

SEQ ID NO: 19096 - protein, 9 aa, Artificial Sequence
  Description of Artificial Sequence: Synthetic peptide
LQHYSYPRT

SEQ ID NO: 19097 - DNA, 27 bp, Artificial Sequence
  Description of Artificial Sequence: Synthetic oligonucleotide
ctactgcataatagttaccctcggacg

SEQ ID NO: 19098 - protein, 9 aa, Artificial Sequence
  Description of Artificial Sequence: Synthetic peptide
LLHNSYPRT

SEQ ID NO: 19099 - DNA, 27 bp, Artificial Sequence
  Description of Artificial Sequence: Synthetic oligonucleotide
gtaatgcattatagttaccctcggacg

SEQ ID NO: 19100 - protein, 9 aa, Artificial Sequence
  Description of Artificial Sequence: Synthetic peptide
VMHYSYPRT

SEQ ID NO: 19101 - DNA, 27 bp, Artificial Sequence
  Description of Artificial Sequence: Synthetic oligonucleotide
gtaatgcataatagttaccctcggacg

SEQ ID NO: 19102 - protein, 9 aa, Artificial Sequence
  Description of Artificial Sequence: Synthetic peptide
VMHNSYPRT

SEQ ID NO: 19103 - DNA, 27 bp, Artificial Sequence
  Description of Artificial Sequence: Synthetic oligonucleotide
cagcagtatattaattaccctctcact

SEQ ID NO: 19104 - protein, 9 aa, Artificial Sequence
  Description of Artificial Sequence: Synthetic peptide
QQYINYPLT

SEQ ID NO: 19105 - DNA, 27 bp, Artificial Sequence
  Description of Artificial Sequence: Synthetic oligonucleotide
caacagtatgttacttaccctctcact

SEQ ID NO: 19106 - protein, 9 aa, Artificial Sequence
  Description of Artificial Sequence: Synthetic peptide
QQYVTYPLT

SEQ ID NO: 19107 - DNA, 27 bp, Artificial Sequence
  Description of Artificial Sequence: Synthetic oligonucleotide
catcagagtcgcagtttaccattcact

SEQ ID NO: 19108 - protein, 9 aa, Artificial Sequence
  Description of Artificial Sequence: Synthetic peptide
HQSRSLPFT

SEQ ID NO: 19109 - DNA, 27 bp, Artificial Sequence
  Description of Artificial Sequence: Synthetic oligonucleotide
cagcagtatgttagttcattgctcact

SEQ ID NO: 19110 - protein, 9 aa, Artificial Sequence
  Description of Artificial Sequence: Synthetic peptide
QQYVSSLLT

SEQ ID NO: 19111 - DNA, 27 bp, Artificial Sequence
  Description of Artificial Sequence: Synthetic oligonucleotide
gtaatgcattatagttaccctcggacg

SEQ ID NO: 19112 - protein, 9 aa, Artificial Sequence
  Description of Artificial Sequence: Synthetic peptide
VMHYSYPRT

SEQ ID NO: 19113 - DNA, 27 bp, Artificial Sequence
  Description of Artificial Sequence: Synthetic oligonucleotide
caacagtatgttacttacccgctcact

SEQ ID NO: 19114 - protein, 9 aa, Artificial Sequence
  Description of Artificial Sequence: Synthetic peptide
QQYVTYPLT

SEQ ID NO: 19115 - DNA, 27 bp, Artificial Sequence
  Description of Artificial Sequence: Synthetic oligonucleotide
cagcagtatgttagctcaccgctcact

SEQ ID NO: 19116 - protein, 9 aa, Artificial Sequence
  Description of Artificial Sequence: Synthetic peptide
QQYVSSPLT

SEQ ID NO: 19117 - DNA, 27 bp, Artificial Sequence
  Description of Artificial Sequence: Synthetic oligonucleotide
cagcagtataatgactggccgtgcagt

SEQ ID NO: 19118 - protein, 9 aa, Artificial Sequence
  Description of Artificial Sequence: Synthetic peptide
QQYNDWPCS

SEQ ID NO: 19119 - DNA, 27 bp, Artificial Sequence
  Description of Artificial Sequence: Synthetic oligonucleotide
caacagtatgataggtcaccattcact

SEQ ID NO: 19120 - protein, 9 aa, Artificial Sequence
  Description of Artificial Sequence: Synthetic peptide
QQYDRSPFT

SEQ ID NO: 19121 - DNA, 27 bp, Artificial Sequence
  Description of Artificial Sequence: Synthetic oligonucleotide
ctaatgcattatagttaccctcggacg

SEQ ID NO: 19122 - protein, 9 aa, Artificial Sequence
  Description of Artificial Sequence: Synthetic peptide
LMHYSYPRT

SEQ ID NO: 19123 - DNA, 27 bp, Artificial Sequence
  Description of Artificial Sequence: Synthetic oligonucleotide
gtaatgcataatagttaccctcggacg

SEQ ID NO: 19124 - protein, 9 aa, Artificial Sequence
  Description of Artificial Sequence: Synthetic peptide
VMHNSYPRT

SEQ ID NO: 19125 - DNA, 27 bp, Artificial Sequence
  Description of Artificial Sequence: Synthetic oligonucleotide
catcagagtagaagtttaccgtggacg

SEQ ID NO: 19126 - protein, 9 aa, Artificial Sequence
  Description of Artificial Sequence: Synthetic peptide
HQSRSLPWT

SEQ ID NO: 19127 - DNA, 27 bp, Artificial Sequence
  Description of Artificial Sequence: Synthetic oligonucleotide
gtaatgcataatagttaccctcggacg

SEQ ID NO: 19128 - protein, 9 aa, Artificial Sequence
  Description of Artificial Sequence: Synthetic peptide
VMHNSYPRT

SEQ ID NO: 19129 - DNA, 27 bp, Artificial Sequence
  Description of Artificial Sequence: Synthetic oligonucleotide
caacagtatgttaattaccctctcact

SEQ ID NO: 19130 - protein, 9 aa, Artificial Sequence
  Description of Artificial Sequence: Synthetic peptide
QQYVNYPLT

SEQ ID NO: 19131 - DNA, 27 bp, Artificial Sequence
  Description of Artificial Sequence: Synthetic oligonucleotide
caacacaccagtaaatctccagtgcag

SEQ ID NO: 19132 - protein, 9 aa, Artificial Sequence
  Description of Artificial Sequence: Synthetic peptide
QHTSKSPVQ

SEQ ID NO: 19133 - DNA, 27 bp, Artificial Sequence
  Description of Artificial Sequence: Synthetic oligonucleotide
gtaatgcataatagttaccctcggacg

SEQ ID NO: 19134 - protein, 9 aa, Artificial Sequence
  Description of Artificial Sequence: Synthetic peptide
VMHNSYPRT

SEQ ID NO: 19135 - DNA, 27 bp, Artificial Sequence
  Description of Artificial Sequence: Synthetic oligonucleotide
ctaatgcattatagttaccctcggacg

SEQ ID NO: 19136 - protein, 9 aa, Artificial Sequence
  Description of Artificial Sequence: Synthetic peptide
LMHYSYPRT

SEQ ID NO: 19137 - DNA, 27 bp, Artificial Sequence
  Description of Artificial Sequence: Synthetic oligonucleotide
gtaatgcattatagttaccctcggacg

SEQ ID NO: 19138 - protein, 9 aa, Artificial Sequence
  Description of Artificial Sequence: Synthetic peptide
VMHYSYPRT

SEQ ID NO: 19139 - DNA, 27 bp, Artificial Sequence
  Description of Artificial Sequence: Synthetic oligonucleotide
caacactatagtaattacccgctcact

SEQ ID NO: 19140 - protein, 9 aa, Artificial Sequence
  Description of Artificial Sequence: Synthetic peptide
QHYSNYPLT

SEQ ID NO: 19141 - DNA, 27 bp, Artificial Sequence
  Description of Artificial Sequence: Synthetic oligonucleotide
cagcagtatggtagctcaccgtggacg

SEQ ID NO: 19142 - protein, 9 aa, Artificial Sequence
  Description of Artificial Sequence: Synthetic peptide
QQYGSSPWT

SEQ ID NO: 19143 - DNA, 27 bp, Artificial Sequence
  Description of Artificial Sequence: Synthetic oligonucleotide
gtaatgcataatagttaccctcggacg

SEQ ID NO: 19144 - protein, 9 aa, Artificial Sequence
  Description of Artificial Sequence: Synthetic peptide
VMHNSYPRT

SEQ ID NO: 19145 - DNA, 27 bp, Artificial Sequence
  Description of Artificial Sequence: Synthetic oligonucleotide
caacaggctaacagtttcccattcact

SEQ ID NO: 19146 - protein, 9 aa, Artificial Sequence
  Description of Artificial Sequence: Synthetic peptide
QQANSFPFT

SEQ ID NO: 19147 - DNA, 27 bp, Artificial Sequence
  Description of Artificial Sequence: Synthetic oligonucleotide
caacagtatatgacttacccgctcact

SEQ ID NO: 19148 - protein, 9 aa, Artificial Sequence
  Description of Artificial Sequence: Synthetic peptide
QQYMTYPLT

SEQ ID NO: 19149 - DNA, 27 bp, Artificial Sequence
  Description of Artificial Sequence: Synthetic oligonucleotide
caacaggctaacagtttcccattcact

SEQ ID NO: 19150 - protein, 9 aa, Artificial Sequence
  Description of Artificial Sequence: Synthetic peptide
QQANSFPFT

SEQ ID NO: 19151 - DNA, 27 bp, Artificial Sequence
  Description of Artificial Sequence: Synthetic oligonucleotide
caacaggctaacagtttcccattcact

SEQ ID NO: 19152 - protein, 9 aa, Artificial Sequence
  Description of Artificial Sequence: Synthetic peptide
QQANSFPFT

SEQ ID NO: 19153 - DNA, 27 bp, Artificial Sequence
  Description of Artificial Sequence: Synthetic oligonucleotide
cagcaatattcttctattccgtggacg

SEQ ID NO: 19154 - protein, 9 aa, Artificial Sequence
  Description of Artificial Sequence: Synthetic peptide
QQYSSIPWT

SEQ ID NO: 19155 - DNA, 27 bp, Artificial Sequence
  Description of Artificial Sequence: Synthetic oligonucleotide
ctatattatcttaattatccgctcact

SEQ ID NO: 19156 - protein, 9 aa, Artificial Sequence
  Description of Artificial Sequence: Synthetic peptide
LYYLNYPLT

SEQ ID NO: 19157 - DNA, 27 bp, Artificial Sequence
  Description of Artificial Sequence: Synthetic oligonucleotide
cagcagtattactttaccccattcact

SEQ ID NO: 19158 - protein, 9 aa, Artificial Sequence
  Description of Artificial Sequence: Synthetic peptide
QQYYFTPFT

SEQ ID NO: 19159 - DNA, 27 bp, Artificial Sequence
  Description of Artificial Sequence: Synthetic oligonucleotide
cagcagtatgaagactcaccgtggacg

SEQ ID NO: 19160 - protein, 9 aa, Artificial Sequence
  Description of Artificial Sequence: Synthetic peptide
QQYEDSPWT

SEQ ID NO: 19161 - DNA, 27 bp, Artificial Sequence
  Description of Artificial Sequence: Synthetic oligonucleotide
caacaggctaacagtttcccattcact

SEQ ID NO: 19162 - protein, 9 aa, Artificial Sequence
  Description of Artificial Sequence: Synthetic peptide
QQANSFPFT

SEQ ID NO: 19163 - DNA, 27 bp, Artificial Sequence
  Description of Artificial Sequence: Synthetic oligonucleotide
cagcagtattactttaccccattcact

SEQ ID NO: 19164 - protein, 9 aa, Artificial Sequence
  Description of Artificial Sequence: Synthetic peptide
QQYYFTPFT

SEQ ID NO: 19165 - DNA, 27 bp, Artificial Sequence
  Description of Artificial Sequence: Synthetic oligonucleotide
ctacattatcttaattacccgctcact

SEQ ID NO: 19166 - protein, 9 aa, Artificial Sequence
  Description of Artificial Sequence: Synthetic peptide
LHYLNYPLT

SEQ ID NO: 19167 - DNA, 27 bp, Artificial Sequence
  Description of Artificial Sequence: Synthetic oligonucleotide
caacaggataacagtttcccattcact

SEQ ID NO: 19168 - protein, 9 aa, Artificial Sequence
  Description of Artificial Sequence: Synthetic peptide
QQDNSFPFT

SEQ ID NO: 19169 - DNA, 27 bp, Artificial Sequence
  Description of Artificial Sequence: Synthetic oligonucleotide
ctgcaatattttagtactccgtggacg

SEQ ID NO: 19170 - protein, 9 aa, Artificial Sequence
  Description of Artificial Sequence: Synthetic peptide
LQYFSTPWT

SEQ ID NO: 19171 - DNA, 27 bp, Artificial Sequence
  Description of Artificial Sequence: Synthetic oligonucleotide
ctacattatcttaattacccactcact

SEQ ID NO: 19172 - protein, 9 aa, Artificial Sequence
  Description of Artificial Sequence: Synthetic peptide
LHYLNYPLT

SEQ ID NO: 19173 - DNA, 27 bp, Artificial Sequence
  Description of Artificial Sequence: Synthetic oligonucleotide
ctacagcataatagttacccgctcact

SEQ ID NO: 19174 - protein, 9 aa, Artificial Sequence
  Description of Artificial Sequence: Synthetic peptide
LQHNSYPLT

SEQ ID NO: 19175 - DNA, 27 bp, Artificial Sequence
  Description of Artificial Sequence: Synthetic oligonucleotide
ctacagcataatagttatcctcctact

SEQ ID NO: 19176 - protein, 9 aa, Artificial Sequence
  Description of Artificial Sequence: Synthetic peptide
LQHNSYPPT

SEQ ID NO: 19177 - DNA, 27 bp, Artificial Sequence
  Description of Artificial Sequence: Synthetic oligonucleotide
ctacagcattatagttaccctcggacg

SEQ ID NO: 19178 - protein, 9 aa, Artificial Sequence
  Description of Artificial Sequence: Synthetic peptide
LQHYSYPRT

SEQ ID NO: 19179 - DNA, 27 bp, Artificial Sequence
  Description of Artificial Sequence: Synthetic oligonucleotide
atgcaaagtacacagcttcctcggacg

SEQ ID NO: 19180 - protein, 9 aa, Artificial Sequence
  Description of Artificial Sequence: Synthetic peptide
MQSTQLPRT

SEQ ID NO: 19181 - DNA, 27 bp, Artificial Sequence
  Description of Artificial Sequence: Synthetic oligonucleotide
ctacagcataatagttacccgctcact

SEQ ID NO: 19182 - protein, 9 aa, Artificial Sequence
  Description of Artificial Sequence: Synthetic peptide
LQHNSYPLT

SEQ ID NO: 19183 - DNA, 27 bp, Artificial Sequence
  Description of Artificial Sequence: Synthetic oligonucleotide
cttcagcattataattaccctcgggcg

SEQ ID NO: 19184 - protein, 9 aa, Artificial Sequence
  Description of Artificial Sequence: Synthetic peptide
LQHYNYPRA

SEQ ID NO: 19185 - DNA, 27 bp, Artificial Sequence
  Description of Artificial Sequence: Synthetic oligonucleotide
cagcaatattatagtactcctccgacg

SEQ ID NO: 19186 - protein, 9 aa, Artificial Sequence
  Description of Artificial Sequence: Synthetic peptide
QQYYSTPPT

SEQ ID NO: 19187 - DNA, 27 bp, Artificial Sequence
  Description of Artificial Sequence: Synthetic oligonucleotide
caacaggctaacagtttcccgtggacg

SEQ ID NO: 19188 - protein, 9 aa, Artificial Sequence
  Description of Artificial Sequence: Synthetic peptide
QQANSFPWT

SEQ ID NO: 19189 - DNA, 27 bp, Artificial Sequence
  Description of Artificial Sequence: Synthetic oligonucleotide
atgcaaagtacacagcttcctcggacg

SEQ ID NO: 19190 - protein, 9 aa, Artificial Sequence
  Description of Artificial Sequence: Synthetic peptide
MQSTQLPRT

SEQ ID NO: 19191 - DNA, 27 bp, Artificial Sequence
  Description of Artificial Sequence: Synthetic oligonucleotide
cagcaatattttagtactcctccgacg

SEQ ID NO: 19192 - protein, 9 aa, Artificial Sequence
  Description of Artificial Sequence: Synthetic peptide
QQYFSTPPT

SEQ ID NO: 19193 - DNA, 27 bp, Artificial Sequence
  Description of Artificial Sequence: Synthetic oligonucleotide
caacaatattatattaatccgtgcagt

SEQ ID NO: 19194 - protein, 9 aa, Artificial Sequence
  Description of Artificial Sequence: Synthetic peptide
QQYYINPCS

SEQ ID NO: 19195 - DNA, 27 bp, Artificial Sequence
  Description of Artificial Sequence: Synthetic oligonucleotide
ctacaacataatagttacccgctcact

SEQ ID NO: 19196 - protein, 9 aa, Artificial Sequence
  Description of Artificial Sequence: Synthetic peptide
LQHNSYPLT

SEQ ID NO: 19197 - DNA, 27 bp, Artificial Sequence
  Description of Artificial Sequence: Synthetic oligonucleotide
atgcaaagtacacagcttcctcggacg

SEQ ID NO: 19198 - protein, 9 aa, Artificial Sequence
  Description of Artificial Sequence: Synthetic peptide
MQSTQLPRT

SEQ ID NO: 19199 - DNA, 27 bp, Artificial Sequence
  Description of Artificial Sequence: Synthetic oligonucleotide
cagcaatattatactactccgtgcagt

SEQ ID NO: 19200 - protein, 9 aa, Artificial Sequence
  Description of Artificial Sequence: Synthetic peptide
QQYYTTPCS

SEQ ID NO: 19201 - DNA, 27 bp, Artificial Sequence
  Description of Artificial Sequence: Synthetic oligonucleotide
atgcaaagtacacagcttcctcggacg

SEQ ID NO: 19202 - protein, 9 aa, Artificial Sequence
  Description of Artificial Sequence: Synthetic peptide
MQSTQLPRT

SEQ ID NO: 19203 - DNA, 27 bp, Artificial Sequence
  Description of Artificial Sequence: Synthetic oligonucleotide
ctgcagcattatagttaccctcggacg

SEQ ID NO: 19204 - protein, 9 aa, Artificial Sequence
  Description of Artificial Sequence: Synthetic peptide
LQHYSYPRT

SEQ ID NO: 19205 - DNA, 30 bp, Artificial Sequence
  Description of Artificial Sequence: Synthetic oligonucleotide
caggagtatggtagctcactcatgtgcagt

SEQ ID NO: 19206 - protein, 10 aa, Artificial Sequence
  Description of Artificial Sequence: Synthetic peptide
QEYGSSLMCS

SEQ ID NO: 19207 - DNA, 27 bp, Artificial Sequence
  Description of Artificial Sequence: Synthetic oligonucleotide
caccaatatcataattctcctcccact

SEQ ID NO: 19208 - protein, 9 aa, Artificial Sequence
  Description of Artificial Sequence: Synthetic peptide
HQYHNSPPT

SEQ ID NO: 19209 - DNA, 27 bp, Artificial Sequence
  Description of Artificial Sequence: Synthetic oligonucleotide
atgcaaagtacacagcttcctcggacg

SEQ ID NO: 19210 - protein, 9 aa, Artificial Sequence
  Description of Artificial Sequence: Synthetic peptide
MQSTQLPRT

SEQ ID NO: 19211 - DNA, 27 bp, Artificial Sequence
  Description of Artificial Sequence: Synthetic oligonucleotide
cagcaatattatagttctcctccgacg

SEQ ID NO: 19212 - protein, 9 aa, Artificial Sequence
  Description of Artificial Sequence: Synthetic peptide
QQYYSSPPT

SEQ ID NO: 19213 - DNA, 27 bp, Artificial Sequence
  Description of Artificial Sequence: Synthetic oligonucleotide
ctacagcataatagttatccattcact

SEQ ID NO: 19214 - protein, 9 aa, Artificial Sequence
  Description of Artificial Sequence: Synthetic peptide
LQHNSYPFT

SEQ ID NO: 19215 - DNA, 27 bp, Artificial Sequence
  Description of Artificial Sequence: Synthetic oligonucleotide
cttcagcataatacttacccattcact

SEQ ID NO: 19216 - protein, 9 aa, Artificial Sequence
  Description of Artificial Sequence: Synthetic peptide
LQHNTYPFT

SEQ ID NO: 19217 - DNA, 27 bp, Artificial Sequence
  Description of Artificial Sequence: Synthetic oligonucleotide
cagcagtatggtacctcacctcggacg

SEQ ID NO: 19218 - protein, 9 aa, Artificial Sequence
  Description of Artificial Sequence: Synthetic peptide
QQYGTSPRT

SEQ ID NO: 19219 - DNA, 27 bp, Artificial Sequence
  Description of Artificial Sequence: Synthetic oligonucleotide
ctacaacataatagttacccattcact

SEQ ID NO: 19220 - protein, 9 aa, Artificial Sequence
  Description of Artificial Sequence: Synthetic peptide
LQHNSYPFT

SEQ ID NO: 19221 - DNA, 27 bp, Artificial Sequence
  Description of Artificial Sequence: Synthetic oligonucleotide
caacactccaagagtattcctggtaag

SEQ ID NO: 19222 - protein, 9 aa, Artificial Sequence
  Description of Artificial Sequence: Synthetic peptide
QHSKSIPGK

SEQ ID NO: 19223 - DNA, 27 bp, Artificial Sequence
  Description of Artificial Sequence: Synthetic oligonucleotide
cagcaatattatactactcctccgacg

SEQ ID NO: 19224 - protein, 9 aa, Artificial Sequence
  Description of Artificial Sequence: Synthetic peptide
QQYYTTPPT

SEQ ID NO: 19225 - DNA, 27 bp, Artificial Sequence
  Description of Artificial Sequence: Synthetic oligonucleotide
cagcaatattatattactccgtgcagt

SEQ ID NO: 19226 - protein, 9 aa, Artificial Sequence
  Description of Artificial Sequence: Synthetic peptide
QQYYITPCS

SEQ ID NO: 19227 - DNA, 27 bp, Artificial Sequence
  Description of Artificial Sequence: Synthetic oligonucleotide
cagcaatattatattactccgtgcagt

SEQ ID NO: 19228 - protein, 9 aa, Artificial Sequence
  Description of Artificial Sequence: Synthetic peptide
QQYYITPCS

SEQ ID NO: 19229 - DNA, 27 bp, Artificial Sequence
  Description of Artificial Sequence: Synthetic oligonucleotide
atgcaaagtatacagattccgtggacg

SEQ ID NO: 19230 - protein, 9 aa, Artificial Sequence
  Description of Artificial Sequence: Synthetic peptide
MQSIQIPWT

SEQ ID NO: 19231 - DNA, 27 bp, Artificial Sequence
  Description of Artificial Sequence: Synthetic oligonucleotide
atgcaaagtatacagattccgtggacg

SEQ ID NO: 19232 - protein, 9 aa, Artificial Sequence
  Description of Artificial Sequence: Synthetic peptide
MQSIQIPWT

SEQ ID NO: 19233 - DNA, 27 bp, Artificial Sequence
  Description of Artificial Sequence: Synthetic oligonucleotide
ctacagcattataattaccctcgggcg

SEQ ID NO: 19234 - protein, 9 aa, Artificial Sequence
  Description of Artificial Sequence: Synthetic peptide
LQHYNYPRA

SEQ ID NO: 19235 - DNA, 27 bp, Artificial Sequence
  Description of Artificial Sequence: Synthetic oligonucleotide
cagcaatattatagttctccgtgcagt

SEQ ID NO: 19236 - protein, 9 aa, Artificial Sequence
  Description of Artificial Sequence: Synthetic peptide
QQYYSSPCS

SEQ ID NO: 19237 - DNA, 27 bp, Artificial Sequence
  Description of Artificial Sequence: Synthetic oligonucleotide
cagcaatattatactactcctccgacg

SEQ ID NO: 19238 - protein, 9 aa, Artificial Sequence
  Description of Artificial Sequence: Synthetic peptide
QQYYTTPPT

SEQ ID NO: 19239 - DNA, 27 bp, Artificial Sequence
  Description of Artificial Sequence: Synthetic oligonucleotide
atgcaaagtatacaggttccgtggacg

SEQ ID NO: 19240 - protein, 9 aa, Artificial Sequence
  Description of Artificial Sequence: Synthetic peptide
MQSIQVPWT

SEQ ID NO: 19241 - DNA, 27 bp, Artificial Sequence
  Description of Artificial Sequence: Synthetic oligonucleotide
ctacatcattatagttaccctcggacg

SEQ ID NO: 19242 - protein, 9 aa, Artificial Sequence
  Description of Artificial Sequence: Synthetic peptide
LHHYSYPRT

SEQ ID NO: 19243 - DNA, 27 bp, Artificial Sequence
  Description of Artificial Sequence: Synthetic oligonucleotide
atgcaaagtacacagcttcctcggacg

SEQ ID NO: 19244 - protein, 9 aa, Artificial Sequence
  Description of Artificial Sequence: Synthetic peptide
MQSTQLPRT

SEQ ID NO: 19245 - DNA, 27 bp, Artificial Sequence
  Description of Artificial Sequence: Synthetic oligonucleotide
ctacagcataatagttacccattcact

SEQ ID NO: 19246 - protein, 9 aa, Artificial Sequence
  Description of Artificial Sequence: Synthetic peptide
LQHNSYPFT

SEQ ID NO: 19247 - DNA, 27 bp, Artificial Sequence
  Description of Artificial Sequence: Synthetic oligonucleotide
atgcaaagtacacagcttcctcggacg

SEQ ID NO: 19248 - protein, 9 aa, Artificial Sequence
  Description of Artificial Sequence: Synthetic peptide
MQSTQLPRT

SEQ ID NO: 19249 - DNA, 27 bp, Artificial Sequence
  Description of Artificial Sequence: Synthetic oligonucleotide
atgcaaagtacacagcttcctcggacg

SEQ ID NO: 19250 - protein, 9 aa, Artificial Sequence
  Description of Artificial Sequence: Synthetic peptide
MQSTQLPRT

SEQ ID NO: 19251 - DNA, 27 bp, Artificial Sequence
  Description of Artificial Sequence: Synthetic oligonucleotide
atgcaaagtacacagcttcctcggacg

SEQ ID NO: 19252 - protein, 9 aa, Artificial Sequence
  Description of Artificial Sequence: Synthetic peptide
MQSTQLPRT

SEQ ID NO: 19253 - DNA, 27 bp, Artificial Sequence
  Description of Artificial Sequence: Synthetic oligonucleotide
cagcaatattataaaactccgtggacg

SEQ ID NO: 19254 - protein, 9 aa, Artificial Sequence
  Description of Artificial Sequence: Synthetic peptide
QQYYKTPWT

SEQ ID NO: 19255 - DNA, 27 bp, Artificial Sequence
  Description of Artificial Sequence: Synthetic oligonucleotide
atgcaaagtacacagcttcctcggacg

SEQ ID NO: 19256 - protein, 9 aa, Artificial Sequence
  Description of Artificial Sequence: Synthetic peptide
MQSTQLPRT

SEQ ID NO: 19257 - DNA, 27 bp, Artificial Sequence
  Description of Artificial Sequence: Synthetic oligonucleotide
ctacagcattatagttaccctcggacg

SEQ ID NO: 19258 - protein, 9 aa, Artificial Sequence
  Description of Artificial Sequence: Synthetic peptide
LQHYSYPRT

SEQ ID NO: 19259 - DNA, 27 bp, Artificial Sequence
  Description of Artificial Sequence: Synthetic oligonucleotide
cagcaatattatagtagtcctccgacg

SEQ ID NO: 19260 - protein, 9 aa, Artificial Sequence
  Description of Artificial Sequence: Synthetic peptide
QQYYSSPPT

SEQ ID NO: 19261 - DNA, 27 bp, Artificial Sequence
  Description of Artificial Sequence: Synthetic oligonucleotide
atgcaaagtacacagcttcctcggacg

SEQ ID NO: 19262 - protein, 9 aa, Artificial Sequence
  Description of Artificial Sequence: Synthetic peptide
MQSTQLPRT

SEQ ID NO: 19263 - DNA, 27 bp, Artificial Sequence
  Description of Artificial Sequence: Synthetic oligonucleotide
atgcaaagtacacagcttcctcggacg

SEQ ID NO: 19264 - protein, 9 aa, Artificial Sequence
  Description of Artificial Sequence: Synthetic peptide
MQSTQLPRT

SEQ ID NO: 19265 - DNA, 27 bp, Artificial Sequence
  Description of Artificial Sequence: Synthetic oligonucleotide
atgcaaagtacacagcttcctcggacg

SEQ ID NO: 19266 - protein, 9 aa, Artificial Sequence
  Description of Artificial Sequence: Synthetic peptide
MQSTQLPRT

SEQ ID NO: 19267 - DNA, 27 bp, Artificial Sequence
  Description of Artificial Sequence: Synthetic oligonucleotide
ctacaccataatagttacccattcact

SEQ ID NO: 19268 - protein, 9 aa, Artificial Sequence
  Description of Artificial Sequence: Synthetic peptide
LHHNSYPFT

SEQ ID NO: 19269 - DNA, 27 bp, Artificial Sequence
  Description of Artificial Sequence: Synthetic oligonucleotide
caacaggctaacagtttcccgtggacg

SEQ ID NO: 19270 - protein, 9 aa, Artificial Sequence
  Description of Artificial Sequence: Synthetic peptide
QQANSFPWT

SEQ ID NO: 19271 - DNA, 27 bp, Artificial Sequence
  Description of Artificial Sequence: Synthetic oligonucleotide
ctacagcataatagttacccattcact

SEQ ID NO: 19272 - protein, 9 aa, Artificial Sequence
  Description of Artificial Sequence: Synthetic peptide
LQHNSYPFT

SEQ ID NO: 19273 - DNA, 27 bp, Artificial Sequence
  Description of Artificial Sequence: Synthetic oligonucleotide
cagcaatattatattactccgtgcagt

SEQ ID NO: 19274 - protein, 9 aa, Artificial Sequence
  Description of Artificial Sequence: Synthetic peptide
QQYYITPCS

SEQ ID NO: 19275 - DNA, 27 bp, Artificial Sequence
  Description of Artificial Sequence: Synthetic oligonucleotide
cagcaatattatagttctcctccgacg

SEQ ID NO: 19276 - protein, 9 aa, Artificial Sequence
  Description of Artificial Sequence: Synthetic peptide
QQYYSSPPT

SEQ ID NO: 19277 - DNA, 27 bp, Artificial Sequence
  Description of Artificial Sequence: Synthetic oligonucleotide
atgcaaagtacacagcttcctcggacg

SEQ ID NO: 19278 - protein, 9 aa, Artificial Sequence
  Description of Artificial Sequence: Synthetic peptide
MQSTQLPRT

SEQ ID NO: 19279 - DNA, 27 bp, Artificial Sequence
  Description of Artificial Sequence: Synthetic oligonucleotide
cagcaatattatagtgctccgtacagt

SEQ ID NO: 19280 - protein, 9 aa, Artificial Sequence
  Description of Artificial Sequence: Synthetic peptide
QQYYSAPYS

SEQ ID NO: 19281 - DNA, 27 bp, Artificial Sequence
  Description of Artificial Sequence: Synthetic oligonucleotide
cagcaatattataatactccgtgcagt

SEQ ID NO: 19282 - protein, 9 aa, Artificial Sequence
  Description of Artificial Sequence: Synthetic peptide
QQYYNTPCS

SEQ ID NO: 19283 - DNA, 27 bp, Artificial Sequence
  Description of Artificial Sequence: Synthetic oligonucleotide
atgcaagctctacaaactcctctcacc

SEQ ID NO: 19284 - protein, 9 aa, Artificial Sequence
  Description of Artificial Sequence: Synthetic peptide
MQALQTPLT

SEQ ID NO: 19285 - DNA, 27 bp, Artificial Sequence
  Description of Artificial Sequence: Synthetic oligonucleotide
ctacagcataatagttacccattcact

SEQ ID NO: 19286 - protein, 9 aa, Artificial Sequence
  Description of Artificial Sequence: Synthetic peptide
LQHNSYPFT

SEQ ID NO: 19287 - DNA, 27 bp, Artificial Sequence
  Description of Artificial Sequence: Synthetic oligonucleotide
caggcgtgggacagcagcactgtggta

SEQ ID NO: 19288 - protein, 9 aa, Artificial Sequence
  Description of Artificial Sequence: Synthetic peptide
QAWDSSTVV

SEQ ID NO: 19289 - DNA, 27 bp, Artificial Sequence
  Description of Artificial Sequence: Synthetic oligonucleotide
caggcgtgggacagcagcactgtggta

SEQ ID NO: 19290 - protein, 9 aa, Artificial Sequence
  Description of Artificial Sequence: Synthetic peptide
QAWDSSTVV

SEQ ID NO: 19291 - DNA, 27 bp, Artificial Sequence
  Description of Artificial Sequence: Synthetic oligonucleotide
caggcgtgggacagcagcactgtggta

SEQ ID NO: 19292 - protein, 9 aa, Artificial Sequence
  Description of Artificial Sequence: Synthetic peptide
QAWDSSTVV

SEQ ID NO: 19293 - DNA, 33 bp, Artificial Sequence
  Description of Artificial Sequence: Synthetic oligonucleotide
gcagcatgggatgacagccttaatggcgtggta

SEQ ID NO: 19294 - protein, 11 aa, Artificial Sequence
  Description of Artificial Sequence: Synthetic peptide
AAWDDSLNGVV

SEQ ID NO: 19295 - DNA, 27 bp, Artificial Sequence
  Description of Artificial Sequence: Synthetic oligonucleotide
caggcgtgggacaggaacaccgctgtc

SEQ ID NO: 19296 - protein, 9 aa, Artificial Sequence
  Description of Artificial Sequence: Synthetic peptide
QAWDRNTAV

SEQ ID NO: 19297 - DNA, 27 bp, Artificial Sequence
  Description of Artificial Sequence: Synthetic oligonucleotide
caggcgtgggacagcagcactgtggta

SEQ ID NO: 19298 - protein, 9 aa, Artificial Sequence
  Description of Artificial Sequence: Synthetic peptide
QAWDSSTVV

SEQ ID NO: 19299 - DNA, 30 bp, Artificial Sequence
  Description of Artificial Sequence: Synthetic oligonucleotide
caggcgtggggcagtaacactgctgtggta

SEQ ID NO: 19300 - protein, 10 aa, Artificial Sequence
  Description of Artificial Sequence: Synthetic peptide
QAWGSNTAVV

SEQ ID NO: 19301 - DNA, 30 bp, Artificial Sequence
  Description of Artificial Sequence: Synthetic oligonucleotide
ctggcgtgggacagcagcacttttgtggta

SEQ ID NO: 19302 - protein, 10 aa, Artificial Sequence
  Description of Artificial Sequence: Synthetic peptide
LAWDSSTFVV

SEQ ID NO: 19303 - DNA, 30 bp, Artificial Sequence; identical to SEQ ID NO: 16113
  Description of Artificial Sequence: Synthetic oligonucleotide

SEQ ID NO: 19304 - protein, 10 aa, Artificial Sequence
  Description of Artificial Sequence: Synthetic peptide
QAWDRNTYVV

SEQ ID NO: 19305 - DNA, 27 bp, Artificial Sequence
  Description of Artificial Sequence: Synthetic oligonucleotide
caggcgtggcacagcagcactgtggta

SEQ ID NO: 19306 - protein, 9 aa, Artificial Sequence
  Description of Artificial Sequence: Synthetic peptide
QAWHSSTVV

SEQ ID NO: 19307 - DNA, 27 bp, Artificial Sequence
  Description of Artificial Sequence: Synthetic oligonucleotide
caggcgtggcacagcagtactgtggta

SEQ ID NO: 19308 - protein, 9 aa, Artificial Sequence
  Description of Artificial Sequence: Synthetic peptide
QAWHSSTVV

SEQ ID NO: 19309 - DNA, 27 bp, Artificial Sequence
  Description of Artificial Sequence: Synthetic oligonucleotide
caggcgtgggacagcagcactgtggta

SEQ ID NO: 19310 - protein, 9 aa, Artificial Sequence
  Description of Artificial Sequence: Synthetic peptide
QAWDSSTVV

SEQ ID NO: 19311 - DNA, 27 bp, Artificial Sequence
  Description of Artificial Sequence: Synthetic oligonucleotide
caggcgtgggacagcagcactgtggta

SEQ ID NO: 19312 - protein, 9 aa, Artificial Sequence
  Description of Artificial Sequence: Synthetic peptide
QAWDSSTVV

SEQ ID NO: 19313 - DNA, 33 bp, Artificial Sequence
  Description of Artificial Sequence: Synthetic oligonucleotide
gaagcatgggatgacagcctgaatggtccggta

SEQ ID NO: 19314 - protein, 11 aa, Artificial Sequence
  Description of Artificial Sequence: Synthetic peptide
EAWDDSLNGPV

SEQ ID NO: 19315 - DNA, 33 bp, Artificial Sequence
  Description of Artificial Sequence: Synthetic oligonucleotide
gcagcatgggatgacagcctgaacggcgtggta

SEQ ID NO: 19316 - protein, 11 aa, Artificial Sequence
  Description of Artificial Sequence: Synthetic peptide
AAWDDSLNGVV

SEQ ID NO: 19317 - DNA, 33 bp, Artificial Sequence
  Description of Artificial Sequence: Synthetic oligonucleotide
gcagcatgggatgacagcctgaatggcgtggta

SEQ ID NO: 19318 - protein, 11 aa, Artificial Sequence
  Description of Artificial Sequence: Synthetic peptide
AAWDDSLNGVV

SEQ ID NO: 19319 - DNA, 27 bp, Artificial Sequence
  Description of Artificial Sequence: Synthetic oligonucleotide
caggcgtgggacagcagcactgtggta

SEQ ID NO: 19320 - protein, 9 aa, Artificial Sequence
  Description of Artificial Sequence: Synthetic peptide
QAWDSSTVV

SEQ ID NO: 19321 - DNA, 30 bp, Artificial Sequence; identical to SEQ ID NO: 19301
  Description of Artificial Sequence: Synthetic oligonucleotide

SEQ ID NO: 19322 - protein, 10 aa, Artificial Sequence
  Description of Artificial Sequence: Synthetic peptide
LAWDSSTFVV

SEQ ID NO: 19323 - DNA, 27 bp, Artificial Sequence
  Description of Artificial Sequence: Synthetic oligonucleotide
caggcgtggcacagcagcactgtggta

SEQ ID NO: 19324 - protein, 9 aa, Artificial Sequence
  Description of Artificial Sequence: Synthetic peptide
QAWHSSTVV

SEQ ID NO: 19325 - DNA, 27 bp, Artificial Sequence
  Description of Artificial Sequence: Synthetic oligonucleotide
caggcgtgggacagcagcactgtggta

SEQ ID NO: 19326 - protein, 9 aa, Artificial Sequence
  Description of Artificial Sequence: Synthetic peptide
QAWDSSTVV

SEQ ID NO: 19327 - DNA, 33 bp, Artificial Sequence; identical to SEQ ID NO: 19317
  Description of Artificial Sequence: Synthetic oligonucleotide

SEQ ID NO: 19328 - protein, 11 aa, Artificial Sequence
  Description of Artificial Sequence: Synthetic peptide
AAWDDSLNGVV

SEQ ID NO: 19329 - DNA, 27 bp, Artificial Sequence
  Description of Artificial Sequence: Synthetic oligonucleotide
caggcgtgggacagcagcactgtggta

SEQ ID NO: 19330 - protein, 9 aa, Artificial Sequence
  Description of Artificial Sequence: Synthetic peptide
QAWDSSTVV

SEQ ID NO: 19331 - DNA, 27 bp, Artificial Sequence
  Description of Artificial Sequence: Synthetic oligonucleotide
caggcgtgggacagcagcactgtggta

SEQ ID NO: 19332 - protein, 9 aa, Artificial Sequence
  Description of Artificial Sequence: Synthetic peptide
QAWDSSTVV

SEQ ID NO: 19333 - DNA, 27 bp, Artificial Sequence
  Description of Artificial Sequence: Synthetic oligonucleotide
atgatttggcacagcagcgcttgggtg

SEQ ID NO: 19334 - protein, 9 aa, Artificial Sequence
  Description of Artificial Sequence: Synthetic peptide
MIWHSSAWV

SEQ ID NO: 19335 - DNA, 27 bp, Artificial Sequence
  Description of Artificial Sequence: Synthetic oligonucleotide
caggcgtgggacagcagcactgtggta

SEQ ID NO: 19336 - protein, 9 aa, Artificial Sequence
  Description of Artificial Sequence: Synthetic peptide
QAWDSSTVV

SEQ ID NO: 19337 - DNA, 30 bp, Artificial Sequence
  Description of Artificial Sequence: Synthetic oligonucleotide
ctggcgtgggacagcagcacttttgtggtc

SEQ ID NO: 19338 - protein, 10 aa, Artificial Sequence
  Description of Artificial Sequence: Synthetic peptide
LAWDSSTFVV

SEQ ID NO: 19339 - DNA, 27 bp, Artificial Sequence
  Description of Artificial Sequence: Synthetic oligonucleotide
caggcgtggcacagcagcactgtggta

SEQ ID NO: 19340 - protein, 9 aa, Artificial Sequence
  Description of Artificial Sequence: Synthetic peptide
QAWHSSTVV

SEQ ID NO: 19341 - DNA, 27 bp, Artificial Sequence
  Description of Artificial Sequence: Synthetic oligonucleotide
caggcgtgggacagcagcactgtggta

SEQ ID NO: 19342 - protein, 9 aa, Artificial Sequence
  Description of Artificial Sequence: Synthetic peptide
QAWDSSTVV

SEQ ID NO: 19343 - DNA, 33 bp, Artificial Sequence; identical to SEQ ID NO: 19317
  Description of Artificial Sequence: Synthetic oligonucleotide

SEQ ID NO: 19344 - protein, 11 aa, Artificial Sequence
  Description of Artificial Sequence: Synthetic peptide
AAWDDSLNGVV

SEQ ID NO: 19345 - DNA, 27 bp, Artificial Sequence
  Description of Artificial Sequence: Synthetic oligonucleotide
caggcgtgggacagcagcactgtggta

SEQ ID NO: 19346 - protein, 9 aa, Artificial Sequence
  Description of Artificial Sequence: Synthetic peptide
QAWDSSTVV

SEQ ID NO: 19347 - DNA, 27 bp, Artificial Sequence
  Description of Artificial Sequence: Synthetic oligonucleotide
caggcgtggcacagcagcactgtggta

SEQ ID NO: 19348 - protein, 9 aa, Artificial Sequence
  Description of Artificial Sequence: Synthetic peptide
QAWHSSTVV

SEQ ID NO: 19349 - DNA, 27 bp, Artificial Sequence
  Description of Artificial Sequence: Synthetic oligonucleotide
caggcgtgggacagcagcactgtggta

SEQ ID NO: 19350 - protein, 9 aa, Artificial Sequence
  Description of Artificial Sequence: Synthetic peptide
QAWDSSTVV

SEQ ID NO: 19351 - DNA, 27 bp, Artificial Sequence
  Description of Artificial Sequence: Synthetic oligonucleotide
caggcgtgggacagcagcacttatgtc

SEQ ID NO: 19352 - protein, 9 aa, Artificial Sequence
  Description of Artificial Sequence: Synthetic peptide
QAWDSSTYV

SEQ ID NO: 19353 - DNA, 27 bp, Artificial Sequence
  Description of Artificial Sequence: Synthetic oligonucleotide
caggcgtgggacagcagcactgtggta

SEQ ID NO: 19354 - protein, 9 aa, Artificial Sequence
  Description of Artificial Sequence: Synthetic peptide
QAWDSSTVV

SEQ ID NO: 19355 - DNA, 27 bp, Artificial Sequence
  Description of Artificial Sequence: Synthetic oligonucleotide
caggcgtgggacagcagcactgtggta

SEQ ID NO: 19356 - protein, 9 aa, Artificial Sequence
  Description of Artificial Sequence: Synthetic peptide
QAWDSSTVV

SEQ ID NO: 19357 - DNA, 27 bp, Artificial Sequence
  Description of Artificial Sequence: Synthetic oligonucleotide
caggcgtgggacagcagcacttatgtc

SEQ ID NO: 19358 - protein, 9 aa, Artificial Sequence
  Description of Artificial Sequence: Synthetic peptide
QAWDSSTYV

SEQ ID NO: 19359 - DNA, 27 bp, Artificial Sequence
  Description of Artificial Sequence: Synthetic oligonucleotide
caggcgtgggacaacagcactgtggta

SEQ ID NO: 19360 - protein, 9 aa, Artificial Sequence
  Description of Artificial Sequence: Synthetic peptide
QAWDNSTVV

SEQ ID NO: 19361 - DNA, 27 bp, Artificial Sequence
  Description of Artificial Sequence: Synthetic oligonucleotide
caggcgtgggacagcagcactgtggta

SEQ ID NO: 19362 - protein, 9 aa, Artificial Sequence
  Description of Artificial Sequence: Synthetic peptide
QAWDSSTVV

SEQ ID NO: 19363 - DNA, 27 bp, Artificial Sequence
  Description of Artificial Sequence: Synthetic oligonucleotide
caggcgtgggacagcagcacttatgtc

SEQ ID NO: 19364 - protein, 9 aa, Artificial Sequence
  Description of Artificial Sequence: Synthetic peptide
QAWDSSTYV

SEQ ID NO: 19365 - DNA, 27 bp, Artificial Sequence
  Description of Artificial Sequence: Synthetic oligonucleotide
caggcgtgggacagcagcacttatgtc

SEQ ID NO: 19366 - protein, 9 aa, Artificial Sequence
  Description of Artificial Sequence: Synthetic peptide
QAWDSSTYV

SEQ ID NO: 19367 - DNA, 30 bp, Artificial Sequence
  Description of Artificial Sequence: Synthetic oligonucleotide
caggcgtgggacagcagcacttatgtgata

SEQ ID NO: 19368 - protein, 10 aa, Artificial Sequence
  Description of Artificial Sequence: Synthetic peptide
QAWDSSTYVI

SEQ ID NO: 19369 - DNA, 27 bp, Artificial Sequence
  Description of Artificial Sequence: Synthetic oligonucleotide
caggcgtggcacagcagtactgtggta

SEQ ID NO: 19370 - protein, 9 aa, Artificial Sequence
  Description of Artificial Sequence: Synthetic peptide
QAWHSSTVV

SEQ ID NO: 19371 - DNA, 27 bp, Artificial Sequence
  Description of Artificial Sequence: Synthetic oligonucleotide
caggcgtggcacagcagcactgtggta

SEQ ID NO: 19372 - protein, 9 aa, Artificial Sequence
  Description of Artificial Sequence: Synthetic peptide
QAWHSSTVV

SEQ ID NO: 19373 - DNA, 27 bp, Artificial Sequence
  Description of Artificial Sequence: Synthetic oligonucleotide
caggcgtgggacagcagcactgtggta

SEQ ID NO: 19374 - protein, 9 aa, Artificial Sequence
  Description of Artificial Sequence: Synthetic peptide
QAWDSSTVV

SEQ ID NO: 19375 - DNA, 27 bp, Artificial Sequence
  Description of Artificial Sequence: Synthetic oligonucleotide
caggcgtgggacaacagtactttagta

SEQ ID NO: 19376 - protein, 9 aa, Artificial Sequence
  Description of Artificial Sequence: Synthetic peptide
QAWDNSTLV

SEQ ID NO: 19377 - DNA, 27 bp, Artificial Sequence
  Description of Artificial Sequence: Synthetic oligonucleotide
caggcgtgggacaacagcactgtggta

SEQ ID NO: 19378 - protein, 9 aa, Artificial Sequence
  Description of Artificial Sequence: Synthetic peptide
QAWDNSTVV

SEQ ID NO: 19379 - DNA, 27 bp, Artificial Sequence
  Description of Artificial Sequence: Synthetic oligonucleotide
caggcgtggcacagcagtattgtggta

SEQ ID NO: 19380 - protein, 9 aa, Artificial Sequence
  Description of Artificial Sequence: Synthetic peptide
QAWHSSIVV

SEQ ID NO: 19381 - DNA, 33 bp, Artificial Sequence
  Description of Artificial Sequence: Synthetic oligonucleotide
gcagcatgggatgacagcctgaagggtccggta

SEQ ID NO: 19382 - protein, 11 aa, Artificial Sequence
  Description of Artificial Sequence: Synthetic peptide
AAWDDSLKGPV

SEQ ID NO: 19383 - DNA, 36 bp, Artificial Sequence
  Description of Artificial Sequence: Synthetic oligonucleotide
cagtcctatgacagcagcctgagtggtcctgtgata

SEQ ID NO: 19384 - protein, 12 aa, Artificial Sequence
  Description of Artificial Sequence: Synthetic peptide
QSYDSSLSGPVI

SEQ ID NO: 19385 - DNA, 27 bp, Artificial Sequence
  Description of Artificial Sequence: Synthetic oligonucleotide
caggcgtgggacaatagtatttatgtc

SEQ ID NO: 19386 - protein, 9 aa, Artificial Sequence
  Description of Artificial Sequence: Synthetic peptide
QAWDNSIYV

SEQ ID NO: 19387 - DNA, 27 bp, Artificial Sequence
  Description of Artificial Sequence: Synthetic oligonucleotide
caggcgtgggacagcagcactgtggtg

SEQ ID NO: 19388 - protein, 9 aa, Artificial Sequence
  Description of Artificial Sequence: Synthetic peptide
QAWDSSTVV

SEQ ID NO: 19389 - DNA, 27 bp, Artificial Sequence
  Description of Artificial Sequence: Synthetic oligonucleotide
caggcgtgggacagcagcactgtggta

SEQ ID NO: 19390 - protein, 9 aa, Artificial Sequence
  Description of Artificial Sequence: Synthetic peptide
QAWDSSTVV

SEQ ID NO: 19391 - DNA, 30 bp, Artificial Sequence; identical to SEQ ID NO: 19301
  Description of Artificial Sequence: Synthetic oligonucleotide

SEQ ID NO: 19392 - protein, 10 aa, Artificial Sequence
  Description of Artificial Sequence: Synthetic peptide
LAWDSSTFVV

SEQ ID NO: 19393 - DNA, 33 bp, Artificial Sequence; identical to SEQ ID NO: 19317
  Description of Artificial Sequence: Synthetic oligonucleotide

SEQ ID NO: 19394 - protein, 11 aa, Artificial Sequence
  Description of Artificial Sequence: Synthetic peptide
AAWDDSLNGVV

SEQ ID NO: 19395 - DNA, 30 bp, Artificial Sequence
  Description of Artificial Sequence: Synthetic oligonucleotide
caggcgtgggacaacagcagctttgtgcta

SEQ ID NO: 19396 - protein, 10 aa, Artificial Sequence
  Description of Artificial Sequence: Synthetic peptide
QAWDNSSFVL

SEQ ID NO: 19397 - DNA, 30 bp, Artificial Sequence
  Description of Artificial Sequence: Synthetic oligonucleotide
caggcgtggggcaacagcagctttgtggta

SEQ ID NO: 19398 - protein, 10 aa, Artificial Sequence
  Description of Artificial Sequence: Synthetic peptide
QAWGNSSFVV

SEQ ID NO: 19399 - DNA, 30 bp, Artificial Sequence; identical to SEQ ID NO: 19397
  Description of Artificial Sequence: Synthetic oligonucleotide

SEQ ID NO: 19400 - protein, 10 aa, Artificial Sequence
  Description of Artificial Sequence: Synthetic peptide
QAWGNSSFVV

SEQ ID NO: 19401 - DNA, 30 bp, Artificial Sequence; identical to SEQ ID NO: 19397
  Description of Artificial Sequence: Synthetic oligonucleotide

SEQ ID NO: 19402 - protein, 10 aa, Artificial Sequence
  Description of Artificial Sequence: Synthetic peptide
QAWGNSSFVV

SEQ ID NO: 19403 - DNA, 30 bp, Artificial Sequence
  Description of Artificial Sequence: Synthetic oligonucleotide
caggcgtgggtcaacaacactgcagtggtt

SEQ ID NO: 19404 - protein, 10 aa, Artificial Sequence
  Description of Artificial Sequence: Synthetic peptide
QAWVNNTAVV

SEQ ID NO: 19405 - DNA, 30 bp, Artificial Sequence
  Description of Artificial Sequence: Synthetic oligonucleotide
cagacgtgggacaacagtagttttgcgctt

SEQ ID NO: 19406 - protein, 10 aa, Artificial Sequence
  Description of Artificial Sequence: Synthetic peptide
QTWDNSSFAL

SEQ ID NO: 19407 - DNA, 27 bp, Artificial Sequence
  Description of Artificial Sequence: Synthetic oligonucleotide
caggcgtgggacagcaccactctggtt

SEQ ID NO: 19408 - protein, 9 aa, Artificial Sequence
  Description of Artificial Sequence: Synthetic peptide
QAWDSTTLV

SEQ ID NO: 19409 - DNA, 27 bp, Artificial Sequence
  Description of Artificial Sequence: Synthetic oligonucleotide
caggcgtgggacagcaccactctggtt

SEQ ID NO: 19410 - protein, 9 aa, Artificial Sequence
  Description of Artificial Sequence: Synthetic peptide
QAWDSTTLV

SEQ ID NO: 19411 - DNA, 27 bp, Artificial Sequence
  Description of Artificial Sequence: Synthetic oligonucleotide
caggcgtgggacaacagcactgcggta

SEQ ID NO: 19412 - protein, 9 aa, Artificial Sequence
  Description of Artificial Sequence: Synthetic peptide
QAWDNSTAV

SEQ ID NO: 19413 - DNA, 27 bp, Artificial Sequence
  Description of Artificial Sequence: Synthetic oligonucleotide
caggcgtgggacaccaacactgtgata

SEQ ID NO: 19414 - protein, 9 aa, Artificial Sequence
  Description of Artificial Sequence: Synthetic peptide
QAWDTNTVI

SEQ ID NO: 19415 - DNA, 27 bp, Artificial Sequence
  Description of Artificial Sequence: Synthetic oligonucleotide
caggcgtgggacaccaacactgtgctt

SEQ ID NO: 19416 - protein, 9 aa, Artificial Sequence
  Description of Artificial Sequence: Synthetic peptide
QAWDTNTVL

SEQ ID NO: 19417 - DNA, 27 bp, Artificial Sequence
  Description of Artificial Sequence: Synthetic oligonucleotide
caggcgtgggacaagaacactgtggta

SEQ ID NO: 19418 - protein, 9 aa, Artificial Sequence
  Description of Artificial Sequence: Synthetic peptide
QAWDKNTVV

SEQ ID NO: 19419 - DNA, 27 bp, Artificial Sequence
  Description of Artificial Sequence: Synthetic oligonucleotide
caggcgtgggacaacagcactgcggta

SEQ ID NO: 19420 - protein, 9 aa, Artificial Sequence
  Description of Artificial Sequence: Synthetic peptide
QAWDNSTAV

SEQ ID NO: 19421 - DNA, 27 bp, Artificial Sequence
  Description of Artificial Sequence: Synthetic oligonucleotide
cagtcttattatagcggcaattgggtg

SEQ ID NO: 19422 - protein, 9 aa, Artificial Sequence
  Description of Artificial Sequence: Synthetic peptide
QSYYSGNWV

SEQ ID NO: 19423 - DNA, 27 bp, Artificial Sequence
  Description of Artificial Sequence: Synthetic oligonucleotide
caggcgtgggacagcaacactgcggta

SEQ ID NO: 19424 - protein, 9 aa, Artificial Sequence
  Description of Artificial Sequence: Synthetic peptide
QAWDSNTAV

SEQ ID NO: 19425 - DNA, 27 bp, Artificial Sequence
  Description of Artificial Sequence: Synthetic oligonucleotide
caggcgtgggacaacagcactatggta

SEQ ID NO: 19426 - protein, 9 aa, Artificial Sequence
  Description of Artificial Sequence: Synthetic peptide
QAWDNSTMV

SEQ ID NO: 19427 - DNA, 27 bp, Artificial Sequence
  Description of Artificial Sequence: Synthetic oligonucleotide
caggcgtgggacaagaacactgtggta

SEQ ID NO: 19428 - protein, 9 aa, Artificial Sequence
  Description of Artificial Sequence: Synthetic peptide
QAWDKNTVV

SEQ ID NO: 19429 - DNA, 33 bp, Artificial Sequence
  Description of Artificial Sequence: Synthetic oligonucleotide
aactcccgggacagcagtggcagccatgtggta

SEQ ID NO: 19430 - protein, 11 aa, Artificial Sequence
  Description of Artificial Sequence: Synthetic peptide
NSRDSSGSHVV

SEQ ID NO: 19431 - DNA, 30 bp, Artificial Sequence
  Description of Artificial Sequence: Synthetic oligonucleotide
caggcgtgggacatcagcacttatgtggta

SEQ ID NO: 19432 - protein, 10 aa, Artificial Sequence
  Description of Artificial Sequence: Synthetic peptide
QAWDISTYVV

SEQ ID NO: 19433 - DNA, 33 bp, Artificial Sequence
  Description of Artificial Sequence: Synthetic oligonucleotide
aactcccgggacagcagtggcaaccatgtggta

SEQ ID NO: 19434 - protein, 11 aa, Artificial Sequence
  Description of Artificial Sequence: Synthetic peptide
NSRDSSGNHVV

SEQ ID NO: 19435 - DNA, 33 bp, Artificial Sequence; identical to SEQ ID NO: 19433
  Description of Artificial Sequence: Synthetic oligonucleotide

SEQ ID NO: 19436 - protein, 11 aa, Artificial Sequence
  Description of Artificial Sequence: Synthetic peptide
NSRDSSGNHVV

SEQ ID NO: 19437 - DNA, 27 bp, Artificial Sequence
  Description of Artificial Sequence: Synthetic oligonucleotide
caggcgtgggacagcttcactgtggta

SEQ ID NO: 19438 - protein, 9 aa, Artificial Sequence
  Description of Artificial Sequence: Synthetic peptide
QAWDSFTVV

SEQ ID NO: 19439 - DNA, 33 bp, Artificial Sequence
  Description of Artificial Sequence: Synthetic oligonucleotide
tgctcatatgcaggtagtagcacctatgtggta

SEQ ID NO: 19440 - protein, 11 aa, Artificial Sequence
  Description of Artificial Sequence: Synthetic peptide
CSYAGSSTYVV

SEQ ID NO: 19441 - DNA, 27 bp, Artificial Sequence
  Description of Artificial Sequence: Synthetic oligonucleotide
caggcgtgggacaacagcactatggta

SEQ ID NO: 19442 - protein, 9 aa, Artificial Sequence
  Description of Artificial Sequence: Synthetic peptide
QAWDNSTMV

SEQ ID NO: 19443 - DNA, 33 bp, Artificial Sequence
  Description of Artificial Sequence: Synthetic oligonucleotide
tgctcatatgcaggtagtagcacctttgtagta

SEQ ID NO: 19444 - protein, 11 aa, Artificial Sequence
  Description of Artificial Sequence: Synthetic peptide
CSYAGSSTFVV

SEQ ID NO: 19445 - DNA, 33 bp, Artificial Sequence
  Description of Artificial Sequence: Synthetic oligonucleotide
aactcccgggacagcagtggtaaccattgggtg

SEQ ID NO: 19446 - protein, 11 aa, Artificial Sequence
  Description of Artificial Sequence: Synthetic peptide
NSRDSSGNHWV

SEQ ID NO: 19447 - DNA, 30 bp, Artificial Sequence
  Description of Artificial Sequence: Synthetic oligonucleotide
caggcgtgggacagcaacactgcagtggta

SEQ ID NO: 19448 - protein, 10 aa, Artificial Sequence
  Description of Artificial Sequence: Synthetic peptide
QAWDSNTAVV

SEQ ID NO: 19449 - DNA, 30 bp, Artificial Sequence
  Description of Artificial Sequence: Synthetic oligonucleotide
cagtcctatgatagaagcctgaatgtggtc

SEQ ID NO: 19450 - protein, 10 aa, Artificial Sequence
  Description of Artificial Sequence: Synthetic peptide
QSYDRSLNVV

SEQ ID NO: 19451 - DNA, 27 bp, Artificial Sequence
  Description of Artificial Sequence: Synthetic oligonucleotide
caggcgtgggacagtaggaaagtggta

SEQ ID NO: 19452 - protein, 9 aa, Artificial Sequence
  Description of Artificial Sequence: Synthetic peptide
QAWDSRKVV

SEQ ID NO: 19453 - DNA, 27 bp, Artificial Sequence
  Description of Artificial Sequence: Synthetic oligonucleotide
caggcgtgggacagcagcactgcggta

SEQ ID NO: 19454 - protein, 9 aa, Artificial Sequence
  Description of Artificial Sequence: Synthetic peptide
QAWDSSTAV

SEQ ID NO: 19455 - DNA, 27 bp, Artificial Sequence
  Description of Artificial Sequence: Synthetic oligonucleotide
caggcgtgggacatcaccactgcggta

SEQ ID NO: 19456 - protein, 9 aa, Artificial Sequence
  Description of Artificial Sequence: Synthetic peptide
QAWDITTAV

SEQ ID NO: 19457 - DNA, 27 bp, Artificial Sequence
  Description of Artificial Sequence: Synthetic oligonucleotide
caggcgtgggacagcaggaaagtggta

SEQ ID NO: 19458 - protein, 9 aa, Artificial Sequence
  Description of Artificial Sequence: Synthetic peptide
QAWDSRKVV

SEQ ID NO: 19459 - DNA, 33 bp, Artificial Sequence; identical to SEQ ID NO: 18941
  Description of Artificial Sequence: Synthetic oligonucleotide

SEQ ID NO: 19460 - protein, 11 aa, Artificial Sequence
  Description of Artificial Sequence: Synthetic peptide
TAWDDSLNGWV

SEQ ID NO: 19461 - DNA, 33 bp, Artificial Sequence
  Description of Artificial Sequence: Synthetic oligonucleotide
cagtcctatgacagcagcctgagtggttatgtc

SEQ ID NO: 19462 - protein, 11 aa, Artificial Sequence
  Description of Artificial Sequence: Synthetic peptide
QSYDSSLSGYV

SEQ ID NO: 19463 - DNA, 33 bp, Artificial Sequence
  Description of Artificial Sequence: Synthetic oligonucleotide
gcagcatgggatgacagcctgaatggttgggtg

SEQ ID NO: 19464 - protein, 11 aa, Artificial Sequence
  Description of Artificial Sequence: Synthetic peptide
AAWDDSLNGWV

SEQ ID NO: 19465 - DNA, 27 bp, Artificial Sequence
  Description of Artificial Sequence: Synthetic oligonucleotide
caggcgtgggacaacagcactgtggta

SEQ ID NO: 19466 - protein, 9 aa, Artificial Sequence
  Description of Artificial Sequence: Synthetic peptide
QAWDNSTVV

SEQ ID NO: 19467 - DNA, 30 bp, Artificial Sequence
  Description of Artificial Sequence: Synthetic oligonucleotide
aactcatatacaagcaacatcacttgggtg

SEQ ID NO: 19468 - protein, 10 aa, Artificial Sequence
  Description of Artificial Sequence: Synthetic peptide
NSYTSNITWV

SEQ ID NO: 19469 - DNA, 27 bp, Artificial Sequence
  Description of Artificial Sequence: Synthetic oligonucleotide
cagacgtgggacagcagcactgcggtt

SEQ ID NO: 19470 - protein, 9 aa, Artificial Sequence
  Description of Artificial Sequence: Synthetic peptide
QTWDSSTAV

SEQ ID NO: 19471 - DNA, 33 bp, Artificial Sequence; identical to SEQ ID NO: 19463
  Description of Artificial Sequence: Synthetic oligonucleotide

SEQ ID NO: 19472 - protein, 11 aa, Artificial Sequence
  Description of Artificial Sequence: Synthetic peptide
AAWDDSLNGWV

SEQ ID NO: 19473 - DNA, 33 bp, Artificial Sequence
  Description of Artificial Sequence: Synthetic oligonucleotide
gcagtatgggatgacagcctgattggttgggtg

SEQ ID NO: 19474 - protein, 11 aa, Artificial Sequence
  Description of Artificial Sequence: Synthetic peptide
AVWDDSLIGWV

SEQ ID NO: 19475 - DNA, 33 bp, Artificial Sequence; identical to SEQ ID NO: 19463
  Description of Artificial Sequence: Synthetic oligonucleotide

SEQ ID NO: 19476 - protein, 11 aa, Artificial Sequence
  Description of Artificial Sequence: Synthetic peptide
AAWDDSLNGWV

SEQ ID NO: 19477 - DNA, 27 bp, Artificial Sequence
  Description of Artificial Sequence: Synthetic oligonucleotide
caggcgtgggacagcagcactgtggta

SEQ ID NO: 19478 - protein, 9 aa, Artificial Sequence
  Description of Artificial Sequence: Synthetic peptide
QAWDSSTVV

SEQ ID NO: 19479 - DNA, 27 bp, Artificial Sequence
  Description of Artificial Sequence: Synthetic oligonucleotide
caggcgtgggacagcagcactgtggta

SEQ ID NO: 19480 - protein, 9 aa, Artificial Sequence
  Description of Artificial Sequence: Synthetic peptide
QAWDSSTVV

SEQ ID NO: 19481 - DNA, 27 bp, Artificial Sequence
  Description of Artificial Sequence: Synthetic oligonucleotide
caggcgtgggacagcagcactgtggta

SEQ ID NO: 19482 - protein, 9 aa, Artificial Sequence
  Description of Artificial Sequence: Synthetic peptide
QAWDSSTVV

SEQ ID NO: 19483 - DNA, 24 bp, Artificial Sequence
  Description of Artificial Sequence: Synthetic oligonucleotide
caggcgtgggacagcagcactgca

SEQ ID NO: 19484 - protein, 8 aa, Artificial Sequence
  Description of Artificial Sequence: Synthetic peptide
QAWDSSTA

SEQ ID NO: 19485 - DNA, 33 bp, Artificial Sequence
  Description of Artificial Sequence: Synthetic oligonucleotide
ggaacatgggatatcagtctgagtgttggggta

SEQ ID NO: 19486 - protein, 11 aa, Artificial Sequence
  Description of Artificial Sequence: Synthetic peptide
GTWDISLSVGV

SEQ ID NO: 19487 - DNA, 27 bp, Artificial Sequence
  Description of Artificial Sequence: Synthetic oligonucleotide
caggcgtggaacaactacactgtggta

SEQ ID NO: 19488 - protein, 9 aa, Artificial Sequence
  Description of Artificial Sequence: Synthetic peptide
QAWNNYTVV

SEQ ID NO: 19489 - DNA, 27 bp, Artificial Sequence
  Description of Artificial Sequence: Synthetic oligonucleotide
caggcgtgggacagcagcactgtggta

SEQ ID NO: 19490 - protein, 9 aa, Artificial Sequence
  Description of Artificial Sequence: Synthetic peptide
QAWDSSTVV

SEQ ID NO: 19491 - DNA, 27 bp, Artificial Sequence
  Description of Artificial Sequence: Synthetic oligonucleotide
caggcgtgggacagcagcactgtggta

SEQ ID NO: 19492 - protein, 9 aa, Artificial Sequence
  Description of Artificial Sequence: Synthetic peptide
QAWDSSTVV

SEQ ID NO: 19493 - DNA, 27 bp, Artificial Sequence
  Description of Artificial Sequence: Synthetic oligonucleotide
caggcgtggaacaacaacactgtaatg

SEQ ID NO: 19494 - protein, 9 aa, Artificial Sequence
  Description of Artificial Sequence: Synthetic peptide
QAWNNNTVM

SEQ ID NO: 19495 - DNA, 27 bp, Artificial Sequence
  Description of Artificial Sequence: Synthetic oligonucleotide
caggcgtgggacaacaacactgtggtc

SEQ ID NO: 19496 - protein, 9 aa, Artificial Sequence
  Description of Artificial Sequence: Synthetic peptide
QAWDNNTVV

SEQ ID NO: 19497 - DNA, 30 bp, Artificial Sequence; identical to SEQ ID NO: 16215
  Description of Artificial Sequence: Synthetic oligonucleotide

SEQ ID NO: 19498 - protein, 10 aa, Artificial Sequence
  Description of Artificial Sequence: Synthetic peptide
QAWDSSTYVV

SEQ ID NO: 19499 - DNA, 27 bp, Artificial Sequence
  Description of Artificial Sequence: Synthetic oligonucleotide
caggcgtgggacagcagcactgtggta

SEQ ID NO: 19500 - protein, 9 aa, Artificial Sequence
  Description of Artificial Sequence: Synthetic peptide
QAWDSSTVV

SEQ ID NO: 19501 - DNA, 27 bp, Artificial Sequence
  Description of Artificial Sequence: Synthetic oligonucleotide
caggcgtgggacaacaacactgtggtc

SEQ ID NO: 19502 - protein, 9 aa, Artificial Sequence
  Description of Artificial Sequence: Synthetic peptide
QAWDNNTVV

SEQ ID NO: 19503 - DNA, 24 bp, Artificial Sequence
  Description of Artificial Sequence: Synthetic oligonucleotide
caggcgtgggacagcagcactgct

SEQ ID NO: 19504 - protein, 8 aa, Artificial Sequence
  Description of Artificial Sequence: Synthetic peptide
QAWDSSTA

SEQ ID NO: 19505 - DNA, 27 bp, Artificial Sequence
  Description of Artificial Sequence: Synthetic oligonucleotide
caggcgtgggacagcagcactgtggtt

SEQ ID NO: 19506 - protein, 9 aa, Artificial Sequence
  Description of Artificial Sequence: Synthetic peptide
QAWDSSTVV

SEQ ID NO: 19507 - DNA, 27 bp, Artificial Sequence
  Description of Artificial Sequence: Synthetic oligonucleotide
caggcgtgggacagcagcactgcggta

SEQ ID NO: 19508 - protein, 9 aa, Artificial Sequence
  Description of Artificial Sequence: Synthetic peptide
QAWDSSTAV

SEQ ID NO: 19509 - DNA, 27 bp, Artificial Sequence
  Description of Artificial Sequence: Synthetic oligonucleotide
caggcgtgggacagcagcactgcggta

SEQ ID NO: 19510 - protein, 9 aa, Artificial Sequence
  Description of Artificial Sequence: Synthetic peptide
QAWDSSTAV

SEQ ID NO: 19511 - DNA, 27 bp, Artificial Sequence
  Description of Artificial Sequence: Synthetic oligonucleotide
caggcgtgggacagcagcactgcggta

SEQ ID NO: 19512 - protein, 9 aa, Artificial Sequence
  Description of Artificial Sequence: Synthetic peptide
QAWDSSTAV

SEQ ID NO: 19513 - DNA, 27 bp, Artificial Sequence
  Description of Artificial Sequence: Synthetic oligonucleotide
caggcgtgggacagcagcactgcggta

SEQ ID NO: 19514 - protein, 9 aa, Artificial Sequence
  Description of Artificial Sequence: Synthetic peptide
QAWDSSTAV

SEQ ID NO: 19515 - DNA, 27 bp, Artificial Sequence
  Description of Artificial Sequence: Synthetic oligonucleotide
caggcgtgggacagcagcactgcggta

SEQ ID NO: 19516 - protein, 9 aa, Artificial Sequence
  Description of Artificial Sequence: Synthetic peptide
QAWDSSTAV

SEQ ID NO: 19517 - DNA, 27 bp, Artificial Sequence
  Description of Artificial Sequence: Synthetic oligonucleotide
cagtcttatgatggcatcaatgtggta

SEQ ID NO: 19518 - protein, 9 aa, Artificial Sequence
  Description of Artificial Sequence: Synthetic peptide
QSYDGINVV

SEQ ID NO: 19519 - DNA, 27 bp, Artificial Sequence
  Description of Artificial Sequence: Synthetic oligonucleotide
cagtcttatgatagcatcaatgtggta

SEQ ID NO: 19520 - protein, 9 aa, Artificial Sequence
  Description of Artificial Sequence: Synthetic peptide
QSYDSINVV

SEQ ID NO: 19521 - DNA, 27 bp, Artificial Sequence
  Description of Artificial Sequence: Synthetic oligonucleotide
caggcgtgggacaacagcactgtggta

SEQ ID NO: 19522 - protein, 9 aa, Artificial Sequence
  Description of Artificial Sequence: Synthetic peptide
QAWDNSTVV

SEQ ID NO: 19523 - DNA, 27 bp, Artificial Sequence
  Description of Artificial Sequence: Synthetic oligonucleotide
caggcgtgggacatcaacactgcggta

SEQ ID NO: 19524 - protein, 9 aa, Artificial Sequence
  Description of Artificial Sequence: Synthetic peptide
QAWDINTAV

SEQ ID NO: 19525 - DNA, 27 bp, Artificial Sequence
  Description of Artificial Sequence: Synthetic oligonucleotide
caggcgtgggacaacagcactgtggta

SEQ ID NO: 19526 - protein, 9 aa, Artificial Sequence
  Description of Artificial Sequence: Synthetic peptide
QAWDNSTVV

SEQ ID NO: 19527 - DNA, 27 bp, Artificial Sequence
  Description of Artificial Sequence: Synthetic oligonucleotide
caggcgtgggacaacagcactgtggta

SEQ ID NO: 19528 - protein, 9 aa, Artificial Sequence
  Description of Artificial Sequence: Synthetic peptide
QAWDNSTVV

SEQ ID NO: 19529 - DNA, 27 bp, Artificial Sequence
  Description of Artificial Sequence: Synthetic oligonucleotide
caggcgtgggacaacagcactgtggta

SEQ ID NO: 19530 - protein, 9 aa, Artificial Sequence
  Description of Artificial Sequence: Synthetic peptide
QAWDNSTVV

SEQ ID NO: 19531 - DNA, 27 bp, Artificial Sequence
  Description of Artificial Sequence: Synthetic oligonucleotide
caggcgtgggacaacagcactgtggta

SEQ ID NO: 19532 - protein, 9 aa, Artificial Sequence
  Description of Artificial Sequence: Synthetic peptide
QAWDNSTVV

SEQ ID NO: 19533 - DNA, 27 bp, Artificial Sequence
  Description of Artificial Sequence: Synthetic oligonucleotide
caggcgtgggtcaacagcactgtggta

SEQ ID NO: 19534 - protein, 9 aa, Artificial Sequence
  Description of Artificial Sequence: Synthetic peptide
QAWVNSTVV

SEQ ID NO: 19535 - DNA, 27 bp, Artificial Sequence
  Description of Artificial Sequence: Synthetic oligonucleotide
caggcgtgggacaacagcactgtggta

SEQ ID NO: 19536 - protein, 9 aa, Artificial Sequence
  Description of Artificial Sequence: Synthetic peptide
QAWDNSTVV

SEQ ID NO: 19537 - DNA, 27 bp, Artificial Sequence
  Description of Artificial Sequence: Synthetic oligonucleotide
caggcgtgggacagcagcactgcggta

SEQ ID NO: 19538 - protein, 9 aa, Artificial Sequence
  Description of Artificial Sequence: Synthetic peptide
QAWDSSTAV

SEQ ID NO: 19539 - DNA, 30 bp, Artificial Sequence
  Description of Artificial Sequence: Synthetic oligonucleotide
gttctatatatgggtagtgccatttgggtg

SEQ ID NO: 19540 - protein, 10 aa, Artificial Sequence
  Description of Artificial Sequence: Synthetic peptide
VLYMGSAIWV

SEQ ID NO: 19541 - DNA, 27 bp, Artificial Sequence
  Description of Artificial Sequence: Synthetic oligonucleotide
caggcgtgggacagcagcactgcggta

SEQ ID NO: 19542 - protein, 9 aa, Artificial Sequence
  Description of Artificial Sequence: Synthetic peptide
QAWDSSTAV

SEQ ID NO: 19543 - DNA, 24 bp, Artificial Sequence
  Description of Artificial Sequence: Synthetic oligonucleotide
caggcgtgggacagcagcactgta

SEQ ID NO: 19544 - protein, 8 aa, Artificial Sequence
  Description of Artificial Sequence: Synthetic peptide
QAWDSSTV

SEQ ID NO: 19545 - DNA, 27 bp, Artificial Sequence
  Description of Artificial Sequence: Synthetic oligonucleotide
caggcgtgggacagcagtcctgtgata

SEQ ID NO: 19546 - protein, 9 aa, Artificial Sequence
  Description of Artificial Sequence: Synthetic peptide
QAWDSSPVI

SEQ ID NO: 19547 - DNA, 27 bp, Artificial Sequence
  Description of Artificial Sequence: Synthetic oligonucleotide
caggcgtgggacagcagtactgcggta

SEQ ID NO: 19548 - protein, 9 aa, Artificial Sequence
  Description of Artificial Sequence: Synthetic peptide
QAWDSSTAV

SEQ ID NO: 19549 - DNA, 30 bp, Artificial Sequence
  Description of Artificial Sequence: Synthetic oligonucleotide
ctgctctactatggtggtgctcaactggta

SEQ ID NO: 19550 - protein, 10 aa, Artificial Sequence
  Description of Artificial Sequence: Synthetic peptide
LLYYGGAQLV

SEQ ID NO: 19551 - DNA, 27 bp, Artificial Sequence
  Description of Artificial Sequence: Synthetic oligonucleotide
caggcgtgggacagcagccctgtgata

SEQ ID NO: 19552 - protein, 9 aa, Artificial Sequence
  Description of Artificial Sequence: Synthetic peptide
QAWDSSPVI

SEQ ID NO: 19553 - DNA, 27 bp, Artificial Sequence
  Description of Artificial Sequence: Synthetic oligonucleotide
caggcgtgggacagcaccactgtggta

SEQ ID NO: 19554 - protein, 9 aa, Artificial Sequence
  Description of Artificial Sequence: Synthetic peptide
QAWDSTTVV

SEQ ID NO: 19555 - DNA, 30 bp, Artificial Sequence
  Description of Artificial Sequence: Synthetic oligonucleotide
ctcctctactatggtggtgctcagctgatg

SEQ ID NO: 19556 - protein, 10 aa, Artificial Sequence
  Description of Artificial Sequence: Synthetic peptide
LLYYGGAQLM

SEQ ID NO: 19557 - DNA, 27 bp, Artificial Sequence
  Description of Artificial Sequence: Synthetic oligonucleotide
caggcgtgggacagcagccctgtgata

SEQ ID NO: 19558 - protein, 9 aa, Artificial Sequence
  Description of Artificial Sequence: Synthetic peptide
QAWDSSPVI

SEQ ID NO: 19559 - DNA, 27 bp, Artificial Sequence
  Description of Artificial Sequence: Synthetic oligonucleotide
caggcgtgggacagcagccctgtgata

SEQ ID NO: 19560 - protein, 9 aa, Artificial Sequence
  Description of Artificial Sequence: Synthetic peptide
QAWDSSPVI

SEQ ID NO: 19561 - DNA, 24 bp, Artificial Sequence
  Description of Artificial Sequence: Synthetic oligonucleotide
caggcgtgggacagcagcactgta

SEQ ID NO: 19562 - protein, 8 aa, Artificial Sequence
  Description of Artificial Sequence: Synthetic peptide
QAWDSSTV

SEQ ID NO: 19563 - DNA, 27 bp, Artificial Sequence
  Description of Artificial Sequence: Synthetic oligonucleotide
caggcgtgggacagcacccctgtgata

SEQ ID NO: 19564 - protein, 9 aa, Artificial Sequence
  Description of Artificial Sequence: Synthetic peptide
QAWDSTPVI

SEQ ID NO: 19565 - DNA, 27 bp, Artificial Sequence
  Description of Artificial Sequence: Synthetic oligonucleotide
caggcgtgggacagcagcactgtggta

SEQ ID NO: 19566 - protein, 9 aa, Artificial Sequence
  Description of Artificial Sequence: Synthetic peptide
QAWDSSTVV

SEQ ID NO: 19567 - DNA, 27 bp, Artificial Sequence
  Description of Artificial Sequence: Synthetic oligonucleotide
caggcgtggcacagcagcactgtggta

SEQ ID NO: 19568 - protein, 9 aa, Artificial Sequence
  Description of Artificial Sequence: Synthetic peptide
QAWHSSTVV

SEQ ID NO: 19569 - DNA, 27 bp, Artificial Sequence
  Description of Artificial Sequence: Synthetic oligonucleotide
caggcgtgggacatcagaactgtggta

SEQ ID NO: 19570 - protein, 9 aa, Artificial Sequence
  Description of Artificial Sequence: Synthetic peptide
QAWDIRTVV

SEQ ID NO: 19571 - DNA, 27 bp, Artificial Sequence
  Description of Artificial Sequence: Synthetic oligonucleotide
caggcgtgggacagtagaactgcggta

SEQ ID NO: 19572 - protein, 9 aa, Artificial Sequence
  Description of Artificial Sequence: Synthetic peptide
QAWDSRTAV

SEQ ID NO: 19573 - DNA, 30 bp, Artificial Sequence
  Description of Artificial Sequence: Synthetic oligonucleotide
caggcgtgggacaacagcactgctgtggta

SEQ ID NO: 19574 - protein, 10 aa, Artificial Sequence
  Description of Artificial Sequence: Synthetic peptide
QAWDNSTAVV

SEQ ID NO: 19575 - DNA, 30 bp, Artificial Sequence
  Description of Artificial Sequence: Synthetic oligonucleotide
gtgctttatatgggtagtggcatttgggtg

SEQ ID NO: 19576 - protein, 10 aa, Artificial Sequence
  Description of Artificial Sequence: Synthetic peptide
VLYMGSGIWV

SEQ ID NO: 19577 - DNA, 27 bp, Artificial Sequence
  Description of Artificial Sequence: Synthetic oligonucleotide
caggcgtgggacagccgcactgtggta

SEQ ID NO: 19578 - protein, 9 aa, Artificial Sequence
  Description of Artificial Sequence: Synthetic peptide
QAWDSRTVV

SEQ ID NO: 19579 - DNA, 27 bp, Artificial Sequence
  Description of Artificial Sequence: Synthetic oligonucleotide
caggcgtgggacagcaggaaagtggta

SEQ ID NO: 19580 - protein, 9 aa, Artificial Sequence
  Description of Artificial Sequence: Synthetic peptide
QAWDSRKVV

SEQ ID NO: 19581 - DNA, 24 bp, Artificial Sequence
  Description of Artificial Sequence: Synthetic oligonucleotide
caggcgtgggacagcagcacggta

SEQ ID NO: 19582 - protein, 8 aa, Artificial Sequence
  Description of Artificial Sequence: Synthetic peptide
QAWDSSTV

SEQ ID NO: 19583 - DNA, 27 bp, Artificial Sequence
  Description of Artificial Sequence: Synthetic oligonucleotide
caggcgtgggacagcagcactgcggta

SEQ ID NO: 19584 - protein, 9 aa, Artificial Sequence
  Description of Artificial Sequence: Synthetic peptide
QAWDSSTAV

SEQ ID NO: 19585 - DNA, 30 bp, Artificial Sequence
  Description of Artificial Sequence: Synthetic oligonucleotide
ctgctctactatggtggtgctcaggtggca

SEQ ID NO: 19586 - protein, 10 aa, Artificial Sequence
  Description of Artificial Sequence: Synthetic peptide
LLYYGGAQVA

SEQ ID NO: 19587 - DNA, 33 bp, Artificial Sequence
  Description of Artificial Sequence: Synthetic oligonucleotide
ggaacatgggatagcagactgaatgttggggta

SEQ ID NO: 19588 - protein, 11 aa, Artificial Sequence
  Description of Artificial Sequence: Synthetic peptide
GTWDSRLNVGV

SEQ ID NO: 19589 - DNA, 27 bp, Artificial Sequence
  Description of Artificial Sequence: Synthetic oligonucleotide
aaggcgtgggacagcagcactgtggta

SEQ ID NO: 19590 - protein, 9 aa, Artificial Sequence
  Description of Artificial Sequence: Synthetic peptide
KAWDSSTVV

SEQ ID NO: 19591 - DNA, 36 bp, Artificial Sequence
  Description of Artificial Sequence: Synthetic oligonucleotide
aactcccgggacagcagtggtaaccatcttgtacta

SEQ ID NO: 19592 - protein, 12 aa, Artificial Sequence
  Description of Artificial Sequence: Synthetic peptide
NSRDSSGNHLVL

SEQ ID NO: 19593 - DNA, 33 bp, Artificial Sequence
  Description of Artificial Sequence: Synthetic oligonucleotide
ggaacatgggatagcagcctgagtactgtggta

SEQ ID NO: 19594 - protein, 11 aa, Artificial Sequence
  Description of Artificial Sequence: Synthetic peptide
GTWDSSLSTVV

SEQ ID NO: 19595 - DNA, 33 bp, Artificial Sequence
  Description of Artificial Sequence: Synthetic oligonucleotide
ggaacatgggatagcagcctgagtgctggggtt

SEQ ID NO: 19596 - protein, 11 aa, Artificial Sequence
  Description of Artificial Sequence: Synthetic peptide
GTWDSSLSAGV

SEQ ID NO: 19597 - DNA, 36 bp, Artificial Sequence
  Description of Artificial Sequence: Synthetic oligonucleotide
aactcccgggacagcagtggtaaccatcttgtggta

SEQ ID NO: 19598 - protein, 12 aa, Artificial Sequence
  Description of Artificial Sequence: Synthetic peptide
NSRDSSGNHLVV

SEQ ID NO: 19599 - DNA, 33 bp, Artificial Sequence
  Description of Artificial Sequence: Synthetic oligonucleotide
ggaacatgggatcgcaccctgagtgattgggta

SEQ ID NO: 19600 - protein, 11 aa, Artificial Sequence
  Description of Artificial Sequence: Synthetic peptide
GTWDRTLSDWV

SEQ ID NO: 19601 - DNA, 33 bp, Artificial Sequence
  Description of Artificial Sequence: Synthetic oligonucleotide
ggaacatgggatggcagactgaatgttggggta

SEQ ID NO: 19602 - protein, 11 aa, Artificial Sequence
  Description of Artificial Sequence: Synthetic peptide
GTWDGRLNVGV

SEQ ID NO: 19603 - DNA, 33 bp, Artificial Sequence
  Description of Artificial Sequence: Synthetic oligonucleotide
ggaacatgggatagtagtctgagtactgtggta

SEQ ID NO: 19604 - protein, 11 aa, Artificial Sequence
  Description of Artificial Sequence: Synthetic peptide
GTWDSSLSTVV

SEQ ID NO: 19605 - DNA, 27 bp, Artificial Sequence
  Description of Artificial Sequence: Synthetic oligonucleotide
caggcgtgggacagcagcactgtggta

SEQ ID NO: 19606 - protein, 9 aa, Artificial Sequence
  Description of Artificial Sequence: Synthetic peptide
QAWDSSTVV

SEQ ID NO: 19607 - DNA, 36 bp, Artificial Sequence; identical to SEQ ID NO: 19597
  Description of Artificial Sequence: Synthetic oligonucleotide

SEQ ID NO: 19608 - protein, 12 aa, Artificial Sequence
  Description of Artificial Sequence: Synthetic peptide
NSRDSSGNHLVV

SEQ ID NO: 19609 - DNA, 33 bp, Artificial Sequence; identical to SEQ ID NO: 19587
  Description of Artificial Sequence: Synthetic oligonucleotide

SEQ ID NO: 19610 - protein, 11 aa, Artificial Sequence
  Description of Artificial Sequence: Synthetic peptide
GTWDSRLNVGV

SEQ ID NO: 19611 - DNA, 30 bp, Artificial Sequence
  Description of Artificial Sequence: Synthetic oligonucleotide
ctgctctactgtggtggtgctcagctggtg

SEQ ID NO: 19612 - protein, 10 aa, Artificial Sequence
  Description of Artificial Sequence: Synthetic peptide
LLYCGGAQLV

SEQ ID NO: 19613 - DNA, 33 bp, Artificial Sequence
  Description of Artificial Sequence: Synthetic oligonucleotide
ggaacatgggatagcagcctgaatactggggta

SEQ ID NO: 19614 - protein, 11 aa, Artificial Sequence
  Description of Artificial Sequence: Synthetic peptide
GTWDSSLNTGV

SEQ ID NO: 19615 - DNA, 30 bp, Artificial Sequence
  Description of Artificial Sequence: Synthetic oligonucleotide
atgctctactgtggtggtgctcagctggtg

SEQ ID NO: 19616 - protein, 10 aa, Artificial Sequence
  Description of Artificial Sequence: Synthetic peptide
MLYCGGAQLV

SEQ ID NO: 19617 - DNA, 36 bp, Artificial Sequence; identical to SEQ ID NO: 19597
  Description of Artificial Sequence: Synthetic oligonucleotide

SEQ ID NO: 19618 - protein, 12 aa, Artificial Sequence
  Description of Artificial Sequence: Synthetic peptide
NSRDSSGNHLVV

SEQ ID NO: 19619 - DNA, 36 bp, Artificial Sequence
  Description of Artificial Sequence: Synthetic oligonucleotide
aactcccgggacagctgtggtaaccatcttgtggta

SEQ ID NO: 19620 - protein, 12 aa, Artificial Sequence
  Description of Artificial Sequence: Synthetic peptide
NSRDSCGNHLVV

SEQ ID NO: 19621 - DNA, 33 bp, Artificial Sequence
  Description of Artificial Sequence: Synthetic oligonucleotide
ggaacatgggatagcagcctgagtgtttgtgtc

SEQ ID NO: 19622 - protein, 11 aa, Artificial Sequence
  Description of Artificial Sequence: Synthetic peptide
GTWDSSLSVCV

SEQ ID NO: 19623 - DNA, 27 bp, Artificial Sequence
  Description of Artificial Sequence: Synthetic oligonucleotide
atgatttggcacagcagcgctgtggta

SEQ ID NO: 19624 - protein, 9 aa, Artificial Sequence
  Description of Artificial Sequence: Synthetic peptide
MIWHSSAVV

SEQ ID NO: 19625 - DNA, 30 bp, Artificial Sequence
  Description of Artificial Sequence: Synthetic oligonucleotide
ctgatcttctatggtggtgtacatgtgata

SEQ ID NO: 19626 - protein, 10 aa, Artificial Sequence
  Description of Artificial Sequence: Synthetic peptide
LIFYGGVHVI

SEQ ID NO: 19627 - DNA, 33 bp, Artificial Sequence
  Description of Artificial Sequence: Synthetic oligonucleotide
ggaacatgggatagcagcctgagtgctggggta

SEQ ID NO: 19628 - protein, 11 aa, Artificial Sequence
  Description of Artificial Sequence: Synthetic peptide
GTWDSSLSAGV

SEQ ID NO: 19629 - DNA, 30 bp, Artificial Sequence
  Description of Artificial Sequence: Synthetic oligonucleotide
ctgctatactatggtggtgctcagctggtg

SEQ ID NO: 19630 - protein, 10 aa, Artificial Sequence
  Description of Artificial Sequence: Synthetic peptide
LLYYGGAQLV

SEQ ID NO: 19631 - DNA, 33 bp, Artificial Sequence
  Description of Artificial Sequence: Synthetic oligonucleotide
gcagcgtgggatgacagcctgaatggttgggtg

SEQ ID NO: 19632 - protein, 11 aa, Artificial Sequence
  Description of Artificial Sequence: Synthetic peptide
AAWDDSLNGWV

SEQ ID NO: 19633 - DNA, 30 bp, Artificial Sequence
  Description of Artificial Sequence: Synthetic oligonucleotide
ctgttctactatggtggtgctcaggtgata

SEQ ID NO: 19634 - protein, 10 aa, Artificial Sequence
  Description of Artificial Sequence: Synthetic peptide
LFYYGGAQVI

SEQ ID NO: 19635 - DNA, 30 bp, Artificial Sequence
  Description of Artificial Sequence: Synthetic oligonucleotide
ctgctgtactatggtggtgctcagctgatg

SEQ ID NO: 19636 - protein, 10 aa, Artificial Sequence
  Description of Artificial Sequence: Synthetic peptide
LLYYGGAQLM

SEQ ID NO: 19637 - DNA, 33 bp, Artificial Sequence
  Description of Artificial Sequence: Synthetic oligonucleotide
aattcccgggacagcagtggtaaccatctggta

SEQ ID NO: 19638 - protein, 11 aa, Artificial Sequence
  Description of Artificial Sequence: Synthetic peptide
NSRDSSGNHLV

SEQ ID NO: 19639 - DNA, 27 bp, Artificial Sequence
  Description of Artificial Sequence: Synthetic oligonucleotide
caggcgtgggacagcagcactgcggta

SEQ ID NO: 19640 - protein, 9 aa, Artificial Sequence
  Description of Artificial Sequence: Synthetic peptide
QAWDSSTAV

SEQ ID NO: 19641 - DNA, 33 bp, Artificial Sequence
  Description of Artificial Sequence: Synthetic oligonucleotide
ggaacatgggatcgcaccatgagtgattgggta

SEQ ID NO: 19642 - protein, 11 aa, Artificial Sequence
  Description of Artificial Sequence: Synthetic peptide
GTWDRTMSDWV

SEQ ID NO: 19643 - DNA, 30 bp, Artificial Sequence
  Description of Artificial Sequence: Synthetic oligonucleotide
ctgatctactatggtggtgctcagctgatg

SEQ ID NO: 19644 - protein, 10 aa, Artificial Sequence
  Description of Artificial Sequence: Synthetic peptide
LIYYGGAQLM

SEQ ID NO: 19645 - DNA, 33 bp, Artificial Sequence; identical to SEQ ID NO: 19595
  Description of Artificial Sequence: Synthetic oligonucleotide

SEQ ID NO: 19646 - protein, 11 aa, Artificial Sequence
  Description of Artificial Sequence: Synthetic peptide
GTWDSSLSAGV

SEQ ID NO: 19647 - DNA, 30 bp, Artificial Sequence
  Description of Artificial Sequence: Synthetic oligonucleotide
ctgatctactatggtggtgctcagctggca

SEQ ID NO: 19648 - protein, 10 aa, Artificial Sequence
  Description of Artificial Sequence: Synthetic peptide
LIYYGGAQLA

SEQ ID NO: 19649 - DNA, 33 bp, Artificial Sequence
  Description of Artificial Sequence: Synthetic oligonucleotide
ggaacatgggatagcagcctgagtgttggggta

SEQ ID NO: 19650 - protein, 11 aa, Artificial Sequence
  Description of Artificial Sequence: Synthetic peptide
GTWDSSLSVGV

SEQ ID NO: 19651 - DNA, 27 bp, Artificial Sequence
  Description of Artificial Sequence: Synthetic oligonucleotide
caggcgtgggacagtgtcactgtggta

SEQ ID NO: 19652 - protein, 9 aa, Artificial Sequence
  Description of Artificial Sequence: Synthetic peptide
QAWDSVTVV

SEQ ID NO: 19653 - DNA, 33 bp, Artificial Sequence
  Description of Artificial Sequence: Synthetic oligonucleotide
gcaacatgggatgacagcctgagtgtttgggtg

SEQ ID NO: 19654 - protein, 11 aa, Artificial Sequence
  Description of Artificial Sequence: Synthetic peptide
ATWDDSLSVWV

SEQ ID NO: 19655 - DNA, 27 bp, Artificial Sequence
  Description of Artificial Sequence: Synthetic oligonucleotide
caggcgtgggacagaggaattgtggta

SEQ ID NO: 19656 - protein, 9 aa, Artificial Sequence
  Description of Artificial Sequence: Synthetic peptide
QAWDRGIVV

SEQ ID NO: 19657 - DNA, 33 bp, Artificial Sequence; identical to SEQ ID NO: 19641
  Description of Artificial Sequence: Synthetic oligonucleotide

SEQ ID NO: 19658 - protein, 11 aa, Artificial Sequence
  Description of Artificial Sequence: Synthetic peptide
GTWDRTMSDWV

SEQ ID NO: 19659 - DNA, 30 bp, Artificial Sequence
  Description of Artificial Sequence: Synthetic oligonucleotide
ctgattttctatggtggtgtacatgtgata

SEQ ID NO: 19660 - protein, 10 aa, Artificial Sequence
  Description of Artificial Sequence: Synthetic peptide
LIFYGGVHVI

SEQ ID NO: 19661 - DNA, 33 bp, Artificial Sequence
  Description of Artificial Sequence: Synthetic oligonucleotide
ggaatatgggatcgcagtctgagtgttatggtg

SEQ ID NO: 19662 - protein, 11 aa, Artificial Sequence
  Description of Artificial Sequence: Synthetic peptide
GIWDRSLSVMV

SEQ ID NO: 19663 - DNA, 33 bp, Artificial Sequence
  Description of Artificial Sequence: Synthetic oligonucleotide
gcagcatgggatgacagtatgaatggtccggtg

SEQ ID NO: 19664 - protein, 11 aa, Artificial Sequence
  Description of Artificial Sequence: Synthetic peptide
AAWDDSMNGPV

SEQ ID NO: 19665 - DNA, 30 bp, Artificial Sequence
  Description of Artificial Sequence: Synthetic oligonucleotide
ctgctctactatggtggtgctcagctggtg

SEQ ID NO: 19666 - protein, 10 aa, Artificial Sequence
  Description of Artificial Sequence: Synthetic peptide
LLYYGGAQLV

SEQ ID NO: 19667 - DNA, 30 bp, Artificial Sequence; identical to SEQ ID NO: 19625
  Description of Artificial Sequence: Synthetic oligonucleotide

SEQ ID NO: 19668 - protein, 10 aa, Artificial Sequence
  Description of Artificial Sequence: Synthetic peptide
LIFYGGVHVI

SEQ ID NO: 19669 - DNA, 33 bp, Artificial Sequence; identical to SEQ ID NO: 19621
  Description of Artificial Sequence: Synthetic oligonucleotide

SEQ ID NO: 19670 - protein, 11 aa, Artificial Sequence
  Description of Artificial Sequence: Synthetic peptide
GTWDSSLSVCV

SEQ ID NO: 19671 - DNA, 30 bp, Artificial Sequence
  Description of Artificial Sequence: Synthetic oligonucleotide
atgctttacagtggtggagctcagatggtg

SEQ ID NO: 19672 - protein, 10 aa, Artificial Sequence
  Description of Artificial Sequence: Synthetic peptide
MLYSGGAQMV

SEQ ID NO: 19673 - DNA, 33 bp, Artificial Sequence
  Description of Artificial Sequence: Synthetic oligonucleotide
ggaacatgggatagcagcctgagtgcttgtgtc

SEQ ID NO: 19674 - protein, 11 aa, Artificial Sequence
  Description of Artificial Sequence: Synthetic peptide
GTWDSSLSACV

SEQ ID NO: 19675 - DNA, 33 bp, Artificial Sequence
  Description of Artificial Sequence: Synthetic oligonucleotide
gcagcatgggatgacagcctgaatggtccggtg

SEQ ID NO: 19676 - protein, 11 aa, Artificial Sequence
  Description of Artificial Sequence: Synthetic peptide
AAWDDSLNGPV

SEQ ID NO: 19677 - DNA, 30 bp, Artificial Sequence
  Description of Artificial Sequence: Synthetic oligonucleotide
ctgatctactatggtggtgctcagctggtg

SEQ ID NO: 19678 - protein, 10 aa, Artificial Sequence
  Description of Artificial Sequence: Synthetic peptide
LIYYGGAQLV

SEQ ID NO: 19679 - DNA, 33 bp, Artificial Sequence
  Description of Artificial Sequence: Synthetic oligonucleotide
ggaacttgggatagcagcctgaatactggggta

SEQ ID NO: 19680 - protein, 11 aa, Artificial Sequence
  Description of Artificial Sequence: Synthetic peptide
GTWDSSLNTGV

SEQ ID NO: 19681 - DNA, 30 bp, Artificial Sequence; identical to SEQ ID NO: 19677
  Description of Artificial Sequence: Synthetic oligonucleotide

SEQ ID NO: 19682 - protein, 10 aa, Artificial Sequence
  Description of Artificial Sequence: Synthetic peptide
LIYYGGAQLV

SEQ ID NO: 19683 - DNA, 30 bp, Artificial Sequence
  Description of Artificial Sequence: Synthetic oligonucleotide
ctgctctattatggtggtgctcacctggca

SEQ ID NO: 19684 - protein, 10 aa, Artificial Sequence
  Description of Artificial Sequence: Synthetic peptide
LLYYGGAHLA

SEQ ID NO: 19685 - DNA, 27 bp, Artificial Sequence
  Description of Artificial Sequence: Synthetic oligonucleotide
caggcgtgggacagcagcactgtggta

SEQ ID NO: 19686 - protein, 9 aa, Artificial Sequence
  Description of Artificial Sequence: Synthetic peptide
QAWDSSTVV

SEQ ID NO: 19687 - DNA, 27 bp, Artificial Sequence
  Description of Artificial Sequence: Synthetic oligonucleotide
caggtgtgggacagcggcactgcggta

SEQ ID NO: 19688 - protein, 9 aa, Artificial Sequence
  Description of Artificial Sequence: Synthetic peptide
QVWDSGTAV

SEQ ID NO: 19689 - DNA, 27 bp, Artificial Sequence
  Description of Artificial Sequence: Synthetic oligonucleotide
caggcgtgggacagcagcactgtggta

SEQ ID NO: 19690 - protein, 9 aa, Artificial Sequence
  Description of Artificial Sequence: Synthetic peptide
QAWDSSTVV

SEQ ID NO: 19691 - DNA, 27 bp, Artificial Sequence
  Description of Artificial Sequence: Synthetic oligonucleotide
caggtgtgggacagcggcactgcggta

SEQ ID NO: 19692 - protein, 9 aa, Artificial Sequence
  Description of Artificial Sequence: Synthetic peptide
QVWDSGTAV

SEQ ID NO: 19693 - DNA, 27 bp, Artificial Sequence
  Description of Artificial Sequence: Synthetic oligonucleotide
caggattgggacagcagcactgtggtg

SEQ ID NO: 19694 - protein, 9 aa, Artificial Sequence
  Description of Artificial Sequence: Synthetic peptide
QDWDSSTVV

SEQ ID NO: 19695 - DNA, 33 bp, Artificial Sequence; identical to SEQ ID NO: 19627
  Description of Artificial Sequence: Synthetic oligonucleotide

SEQ ID NO: 19696 - protein, 11 aa, Artificial Sequence
  Description of Artificial Sequence: Synthetic peptide
GTWDSSLSAGV

SEQ ID NO: 19697 - DNA, 27 bp, Artificial Sequence
  Description of Artificial Sequence: Synthetic oligonucleotide
caggattgggacagcagcactgtggtg

SEQ ID NO: 19698 - protein, 9 aa, Artificial Sequence
  Description of Artificial Sequence: Synthetic peptide
QDWDSSTVV

SEQ ID NO: 19699 - DNA, 30 bp, Artificial Sequence; identical to SEQ ID NO: 19665
  Description of Artificial Sequence: Synthetic oligonucleotide

SEQ ID NO: 19700 - protein, 10 aa, Artificial Sequence
  Description of Artificial Sequence: Synthetic peptide
LLYYGGAQLV

SEQ ID NO: 19701 - DNA, 30 bp, Artificial Sequence
  Description of Artificial Sequence: Synthetic oligonucleotide
agctcatataccagcagccgcactctggta

SEQ ID NO: 19702 - protein, 10 aa, Artificial Sequence
  Description of Artificial Sequence: Synthetic peptide
SSYTSSRTLV

SEQ ID NO: 19703 - DNA, 30 bp, Artificial Sequence
  Description of Artificial Sequence: Synthetic oligonucleotide
aactcatatacaagcagcatcacttgggtg

SEQ ID NO: 19704 - protein, 10 aa, Artificial Sequence
  Description of Artificial Sequence: Synthetic peptide
NSYTSSITWV

SEQ ID NO: 19705 - DNA, 30 bp, Artificial Sequence
  Description of Artificial Sequence: Synthetic oligonucleotide
ggctcatatgtaaaaggcatcacttgggtg

SEQ ID NO: 19706 - protein, 10 aa, Artificial Sequence
  Description of Artificial Sequence: Synthetic peptide
GSYVKGITWV

SEQ ID NO: 19707 - DNA, 30 bp, Artificial Sequence; identical to SEQ ID NO: 19703
  Description of Artificial Sequence: Synthetic oligonucleotide

SEQ ID NO: 19708 - protein, 10 aa, Artificial Sequence
  Description of Artificial Sequence: Synthetic peptide
NSYTSSITWV

SEQ ID NO: 19709 - DNA, 27 bp, Artificial Sequence
  Description of Artificial Sequence: Synthetic oligonucleotide
caggtgtgggacagcagtactgcggtg

SEQ ID NO: 19710 - protein, 9 aa, Artificial Sequence
  Description of Artificial Sequence: Synthetic peptide
QVWDSSTAV

SEQ ID NO: 19711 - DNA, 30 bp, Artificial Sequence
  Description of Artificial Sequence: Synthetic oligonucleotide
caattagtgtacagcagtgatacttatgtc

SEQ ID NO: 19712 - protein, 10 aa, Artificial Sequence
  Description of Artificial Sequence: Synthetic peptide
QLVYSSDTYV

SEQ ID NO: 19713 - DNA, 30 bp, Artificial Sequence
  Description of Artificial Sequence: Synthetic oligonucleotide
aactcatatacaagaagcatcacttgggtg

SEQ ID NO: 19714 - protein, 10 aa, Artificial Sequence
  Description of Artificial Sequence: Synthetic peptide
NSYTRSITWV

SEQ ID NO: 19715 - DNA, 30 bp, Artificial Sequence; identical to SEQ ID NO: 19665
  Description of Artificial Sequence: Synthetic oligonucleotide

SEQ ID NO: 19716 - protein, 10 aa, Artificial Sequence
  Description of Artificial Sequence: Synthetic peptide
LLYYGGAQLV

SEQ ID NO: 19717 - DNA, 30 bp, Artificial Sequence
  Description of Artificial Sequence: Synthetic oligonucleotide
ctgctctactatggtggtgctcagctggca

SEQ ID NO: 19718 - protein, 10 aa, Artificial Sequence
  Description of Artificial Sequence: Synthetic peptide
LLYYGGAQLA

SEQ ID NO: 19719 - DNA, 30 bp, Artificial Sequence; identical to SEQ ID NO: 19717
  Description of Artificial Sequence: Synthetic oligonucleotide

SEQ ID NO: 19720 - protein, 10 aa, Artificial Sequence
  Description of Artificial Sequence: Synthetic peptide
LLYYGGAQLA

SEQ ID NO: 19721 - DNA, 30 bp, Artificial Sequence
  Description of Artificial Sequence: Synthetic oligonucleotide
agctcatatacacgcagcatcacttgggtg

SEQ ID NO: 19722 - protein, 10 aa, Artificial Sequence
  Description of Artificial Sequence: Synthetic peptide
SSYTRSITWV

SEQ ID NO: 19723 - DNA, 30 bp, Artificial Sequence; identical to SEQ ID NO: 19705
  Description of Artificial Sequence: Synthetic oligonucleotide

SEQ ID NO: 19724 - protein, 10 aa, Artificial Sequence
  Description of Artificial Sequence: Synthetic peptide
GSYVKGITWV

SEQ ID NO: 19725 - DNA, 30 bp, Artificial Sequence; identical to SEQ ID NO: 19703
  Description of Artificial Sequence: Synthetic oligonucleotide

SEQ ID NO: 19726 - protein, 10 aa, Artificial Sequence
  Description of Artificial Sequence: Synthetic peptide
NSYTSSITWV

SEQ ID NO: 19727 - DNA, 30 bp, Artificial Sequence; identical to SEQ ID NO: 19703
  Description of Artificial Sequence: Synthetic oligonucleotide

SEQ ID NO: 19728 - protein, 10 aa, Artificial Sequence
  Description of Artificial Sequence: Synthetic peptide
NSYTSSITWV

SEQ ID NO: 19729 - DNA, 30 bp, Artificial Sequence
  Description of Artificial Sequence: Synthetic oligonucleotide
ctgctctactatggtggtgctcaggtggga

SEQ ID NO: 19730 - protein, 10 aa, Artificial Sequence
  Description of Artificial Sequence: Synthetic peptide
LLYYGGAQVG

SEQ ID NO: 19731 - DNA, 30 bp, Artificial Sequence
  Description of Artificial Sequence: Synthetic oligonucleotide
ctgctctactatggtggtgctcatgtggta

SEQ ID NO: 19732 - protein, 10 aa, Artificial Sequence
  Description of Artificial Sequence: Synthetic peptide
LLYYGGAHVV

SEQ ID NO: 19733 - DNA, 30 bp, Artificial Sequence
  Description of Artificial Sequence: Synthetic oligonucleotide
aactcatatacacgcagcatcacttgggtg

SEQ ID NO: 19734 - protein, 10 aa, Artificial Sequence
  Description of Artificial Sequence: Synthetic peptide
NSYTRSITWV

SEQ ID NO: 19735 - DNA, 30 bp, Artificial Sequence
  Description of Artificial Sequence: Synthetic oligonucleotide
tgctcatatacaagaagaatcacttgggtg

SEQ ID NO: 19736 - protein, 10 aa, Artificial Sequence
  Description of Artificial Sequence: Synthetic peptide
CSYTRRITWV

SEQ ID NO: 19737 - DNA, 30 bp, Artificial Sequence
  Description of Artificial Sequence: Synthetic oligonucleotide
ctgctctactttggtggtgctcagctggca

SEQ ID NO: 19738 - protein, 10 aa, Artificial Sequence
  Description of Artificial Sequence: Synthetic peptide
LLYFGGAQLA

SEQ ID NO: 19739 - DNA, 30 bp, Artificial Sequence; identical to SEQ ID NO: 19701
  Description of Artificial Sequence: Synthetic oligonucleotide

SEQ ID NO: 19740 - protein, 10 aa, Artificial Sequence
  Description of Artificial Sequence: Synthetic peptide
SSYTSSRTLV

SEQ ID NO: 19741 - DNA, 30 bp, Artificial Sequence; identical to SEQ ID NO: 19731
  Description of Artificial Sequence: Synthetic oligonucleotide

SEQ ID NO: 19742 - protein, 10 aa, Artificial Sequence
  Description of Artificial Sequence: Synthetic peptide
LLYYGGAHVV

SEQ ID NO: 19743 - DNA, 33 bp, Artificial Sequence
  Description of Artificial Sequence: Synthetic oligonucleotide
ggagcatgggatagcagcctgagtgctgtggta

SEQ ID NO: 19744 - protein, 11 aa, Artificial Sequence
  Description of Artificial Sequence: Synthetic peptide
GAWDSSLSAVV

SEQ ID NO: 19745 - DNA, 30 bp, Artificial Sequence
  Description of Artificial Sequence: Synthetic oligonucleotide
ctgctctactgtgatggtgcccagctggtg

SEQ ID NO: 19746 - protein, 10 aa, Artificial Sequence
  Description of Artificial Sequence: Synthetic peptide
LLYCDGAQLV

SEQ ID NO: 19747 - DNA, 30 bp, Artificial Sequence
  Description of Artificial Sequence: Synthetic oligonucleotide
ctgctctactatggtggcgctcagctggca

SEQ ID NO: 19748 - protein, 10 aa, Artificial Sequence
  Description of Artificial Sequence: Synthetic peptide
LLYYGGAQLA

SEQ ID NO: 19749 - DNA, 27 bp, Artificial Sequence
  Description of Artificial Sequence: Synthetic oligonucleotide
caggcgtgggacagcagcactgtggta

SEQ ID NO: 19750 - protein, 9 aa, Artificial Sequence
  Description of Artificial Sequence: Synthetic peptide
QAWDSSTVV

SEQ ID NO: 19751 - DNA, 30 bp, Artificial Sequence
  Description of Artificial Sequence: Synthetic oligonucleotide
aactcatataaaaggggcagcacttgggtg

SEQ ID NO: 19752 - protein, 10 aa, Artificial Sequence
  Description of Artificial Sequence: Synthetic peptide
NSYKRGSTWV

SEQ ID NO: 19753 - DNA, 30 bp, Artificial Sequence; identical to SEQ ID NO: 19729
  Description of Artificial Sequence: Synthetic oligonucleotide

SEQ ID NO: 19754 - protein, 10 aa, Artificial Sequence
  Description of Artificial Sequence: Synthetic peptide
LLYYGGAQVG

SEQ ID NO: 19755 - DNA, 30 bp, Artificial Sequence; identical to SEQ ID NO: 19703
  Description of Artificial Sequence: Synthetic oligonucleotide

SEQ ID NO: 19756 - protein, 10 aa, Artificial Sequence
  Description of Artificial Sequence: Synthetic peptide
NSYTSSITWV

SEQ ID NO: 19757 - DNA, 30 bp, Artificial Sequence; identical to SEQ ID NO: 19729
  Description of Artificial Sequence: Synthetic oligonucleotide

SEQ ID NO: 19758 - protein, 10 aa, Artificial Sequence
  Description of Artificial Sequence: Synthetic peptide
LLYYGGAQVG

SEQ ID NO: 19759 - DNA, 30 bp, Artificial Sequence
  Description of Artificial Sequence: Synthetic oligonucleotide
ctgctctactgtgatggtgctcagctggtg

SEQ ID NO: 19760 - protein, 10 aa, Artificial Sequence
  Description of Artificial Sequence: Synthetic peptide
LLYCDGAQLV

SEQ ID NO: 19761 - DNA, 27 bp, Artificial Sequence
  Description of Artificial Sequence: Synthetic oligonucleotide
caggtgtgggacagcagcactggggtg

SEQ ID NO: 19762 - protein, 9 aa, Artificial Sequence
  Description of Artificial Sequence: Synthetic peptide
QVWDSSTGV

SEQ ID NO: 19763 - DNA, 30 bp, Artificial Sequence; identical to SEQ ID NO: 19705
  Description of Artificial Sequence: Synthetic oligonucleotide

SEQ ID NO: 19764 - protein, 10 aa, Artificial Sequence
  Description of Artificial Sequence: Synthetic peptide
GSYVKGITWV

SEQ ID NO: 19765 - DNA, 30 bp, Artificial Sequence
  Description of Artificial Sequence: Synthetic oligonucleotide
caattaatagtcagcagtgatacttatgtc

SEQ ID NO: 19766 - protein, 10 aa, Artificial Sequence
  Description of Artificial Sequence: Synthetic peptide
QLIVSSDTYV

SEQ ID NO: 19767 - DNA, 30 bp, Artificial Sequence; identical to SEQ ID NO: 19711
  Description of Artificial Sequence: Synthetic oligonucleotide

SEQ ID NO: 19768 - protein, 10 aa, Artificial Sequence
  Description of Artificial Sequence: Synthetic peptide
QLVYSSDTYV

SEQ ID NO: 19769 - DNA, 33 bp, Artificial Sequence
  Description of Artificial Sequence: Synthetic oligonucleotide
ggaacatgggatagcagcctgaatactgtggta

SEQ ID NO: 19770 - protein, 11 aa, Artificial Sequence
  Description of Artificial Sequence: Synthetic peptide
GTWDSSLNTVV

SEQ ID NO: 19771 - DNA, 30 bp, Artificial Sequence
  Description of Artificial Sequence: Synthetic oligonucleotide
caattagttgtcagcagtgatacttatgtc

SEQ ID NO: 19772 - protein, 10 aa, Artificial Sequence
  Description of Artificial Sequence: Synthetic peptide
QLVVSSDTYV

SEQ ID NO: 19773 - DNA, 30 bp, Artificial Sequence
  Description of Artificial Sequence: Synthetic oligonucleotide
tgctcatatacaaggagcatcacttgggtg

SEQ ID NO: 19774 - protein, 10 aa, Artificial Sequence
  Description of Artificial Sequence: Synthetic peptide
CSYTRSITWV

SEQ ID NO: 19775 - DNA, 30 bp, Artificial Sequence; identical to SEQ ID NO: 19733
  Description of Artificial Sequence: Synthetic oligonucleotide

SEQ ID NO: 19776 - protein, 10 aa, Artificial Sequence
  Description of Artificial Sequence: Synthetic peptide
NSYTRSITWV

SEQ ID NO: 19777 - DNA, 30 bp, Artificial Sequence; identical to SEQ ID NO: 19733
  Description of Artificial Sequence: Synthetic oligonucleotide

SEQ ID NO: 19778 - protein, 10 aa, Artificial Sequence
  Description of Artificial Sequence: Synthetic peptide
NSYTRSITWV

SEQ ID NO: 19779 - DNA, 27 bp, Artificial Sequence
  Description of Artificial Sequence: Synthetic oligonucleotide
caggcgtgggacagcagcactgtggta

SEQ ID NO: 19780 - protein, 9 aa, Artificial Sequence
  Description of Artificial Sequence: Synthetic peptide
QAWDSSTVV

SEQ ID NO: 19781 - DNA, 30 bp, Artificial Sequence
  Description of Artificial Sequence: Synthetic oligonucleotide
cagtcctatgacaacagcctgagtggtgtg

SEQ ID NO: 19782 - protein, 10 aa, Artificial Sequence
  Description of Artificial Sequence: Synthetic peptide
QSYDNSLSGV

SEQ ID NO: 19783 - DNA, 30 bp, Artificial Sequence
  Description of Artificial Sequence: Synthetic oligonucleotide
caggcgtgggacagcaacactgcatgtgtc

SEQ ID NO: 19784 - protein, 10 aa, Artificial Sequence
  Description of Artificial Sequence: Synthetic peptide
QAWDSNTACV

SEQ ID NO: 19785 - DNA, 30 bp, Artificial Sequence
  Description of Artificial Sequence: Synthetic oligonucleotide
caggcgtgggacagcagaactgctgtggta

SEQ ID NO: 19786 - protein, 10 aa, Artificial Sequence
  Description of Artificial Sequence: Synthetic peptide
QAWDSRTAVV

SEQ ID NO: 19787 - DNA, 27 bp, Artificial Sequence
  Description of Artificial Sequence: Synthetic oligonucleotide
caggcgtgggacaacggcgctgcggtt

SEQ ID NO: 19788 - protein, 9 aa, Artificial Sequence
  Description of Artificial Sequence: Synthetic peptide
QAWDNGAAV

SEQ ID NO: 19789 - DNA, 30 bp, Artificial Sequence
  Description of Artificial Sequence: Synthetic oligonucleotide
caatcagcagacagcagtggtacttatgtc

SEQ ID NO: 19790 - protein, 10 aa, Artificial Sequence
  Description of Artificial Sequence: Synthetic peptide
QSADSSGTYV

SEQ ID NO: 19791 - DNA, 30 bp, Artificial Sequence; identical to SEQ ID NO: 19781
  Description of Artificial Sequence: Synthetic oligonucleotide

SEQ ID NO: 19792 - protein, 10 aa, Artificial Sequence
  Description of Artificial Sequence: Synthetic peptide
QSYDNSLSGV

SEQ ID NO: 19793 - DNA, 27 bp, Artificial Sequence
  Description of Artificial Sequence: Synthetic oligonucleotide
caggcgtgggacaacggcgctgcggtt

SEQ ID NO: 19794 - protein, 9 aa, Artificial Sequence
  Description of Artificial Sequence: Synthetic peptide
QAWDNGAAV

SEQ ID NO: 19795 - DNA, 30 bp, Artificial Sequence; identical to SEQ ID NO: 19781
  Description of Artificial Sequence: Synthetic oligonucleotide

SEQ ID NO: 19796 - protein, 10 aa, Artificial Sequence
  Description of Artificial Sequence: Synthetic peptide
QSYDNSLSGV

SEQ ID NO: 19797 - DNA, 27 bp, Artificial Sequence
  Description of Artificial Sequence: Synthetic oligonucleotide
caggcgtgggtcaacaacactatgata

SEQ ID NO: 19798 - protein, 9 aa, Artificial Sequence
  Description of Artificial Sequence: Synthetic peptide
QAWVNNTMI

SEQ ID NO: 19799 - DNA, 30 bp, Artificial Sequence
  Description of Artificial Sequence: Synthetic oligonucleotide
cagtcctatgacaacaacctgagtggtgtg

SEQ ID NO: 19800 - protein, 10 aa, Artificial Sequence
  Description of Artificial Sequence: Synthetic peptide
QSYDNNLSGV

SEQ ID NO: 19801 - DNA, 27 bp, Artificial Sequence
  Description of Artificial Sequence: Synthetic oligonucleotide
caggcgtggaacagcagcaatgtggta

SEQ ID NO: 19802 - protein, 9 aa, Artificial Sequence
  Description of Artificial Sequence: Synthetic peptide
QAWNSSNVV

SEQ ID NO: 19803 - DNA, 33 bp, Artificial Sequence
  Description of Artificial Sequence: Synthetic oligonucleotide
aactcaacagacagcagtggtaatcatgtggta

SEQ ID NO: 19804 - protein, 11 aa, Artificial Sequence
  Description of Artificial Sequence: Synthetic peptide
NSTDSSGNHVV

SEQ ID NO: 19805 - DNA, 27 bp, Artificial Sequence
  Description of Artificial Sequence: Synthetic oligonucleotide
caacagtattatagttacccattcact

SEQ ID NO: 19806 - protein, 9 aa, Artificial Sequence
  Description of Artificial Sequence: Synthetic peptide
QQYYSYPFT

SEQ ID NO: 19807 - DNA, 27 bp, Artificial Sequence
  Description of Artificial Sequence: Synthetic oligonucleotide
ctacagcgtgatagttacccgttcact

SEQ ID NO: 19808 - protein, 9 aa, Artificial Sequence
  Description of Artificial Sequence: Synthetic peptide
LQRDSYPFT

SEQ ID NO: 19809 - DNA, 27 bp, Artificial Sequence
  Description of Artificial Sequence: Synthetic oligonucleotide
caacaatatcagaattaccccttcact

SEQ ID NO: 19810 - protein, 9 aa, Artificial Sequence
  Description of Artificial Sequence: Synthetic peptide
QQYQNYPFT

SEQ ID NO: 19811 - DNA, 27 bp, Artificial Sequence
  Description of Artificial Sequence: Synthetic oligonucleotide
gtgcaaggtacacactggcctcggacg

SEQ ID NO: 19812 - protein, 9 aa, Artificial Sequence
  Description of Artificial Sequence: Synthetic peptide
VQGTHWPRT

SEQ ID NO: 19813 - DNA, 27 bp, Artificial Sequence
  Description of Artificial Sequence: Synthetic oligonucleotide
cagcagtatagtaactggccattcact

SEQ ID NO: 19814 - protein, 9 aa, Artificial Sequence
  Description of Artificial Sequence: Synthetic peptide
QQYSNWPFT

SEQ ID NO: 19815 - DNA, 27 bp, Artificial Sequence
  Description of Artificial Sequence: Synthetic oligonucleotide
caacagagtcacagtttcccattcact

SEQ ID NO: 19816 - protein, 9 aa, Artificial Sequence
  Description of Artificial Sequence: Synthetic peptide
QQSHSFPFT

SEQ ID NO: 19817 - DNA, 27 bp, Artificial Sequence
  Description of Artificial Sequence: Synthetic oligonucleotide
caacaggctaacagtttcccgctcact

SEQ ID NO: 19818 - protein, 9 aa, Artificial Sequence
  Description of Artificial Sequence: Synthetic peptide
QQANSFPLT

SEQ ID NO: 19819 - DNA, 27 bp, Artificial Sequence
  Description of Artificial Sequence: Synthetic oligonucleotide
caacaggctaacagtttcccattcact

SEQ ID NO: 19820 - protein, 9 aa, Artificial Sequence
  Description of Artificial Sequence: Synthetic peptide
QQANSFPFT

SEQ ID NO: 19821 - DNA, 27 bp, Artificial Sequence
  Description of Artificial Sequence: Synthetic oligonucleotide
atgcaacctctacaaactccgttcact

SEQ ID NO: 19822 - protein, 9 aa, Artificial Sequence
  Description of Artificial Sequence: Synthetic peptide
MQPLQTPFT

SEQ ID NO: 19823 - DNA, 27 bp, Artificial Sequence
  Description of Artificial Sequence: Synthetic oligonucleotide
atgcaaggtacacactggtcgctcact

SEQ ID NO: 19824 - protein, 9 aa, Artificial Sequence
  Description of Artificial Sequence: Synthetic peptide
MQGTHWSLT

SEQ ID NO: 19825 - DNA, 27 bp, Artificial Sequence
  Description of Artificial Sequence: Synthetic oligonucleotide
atgcaaggtacacactggttgctcact

SEQ ID NO: 19826 - protein, 9 aa, Artificial Sequence
  Description of Artificial Sequence: Synthetic peptide
MQGTHWLLT

SEQ ID NO: 19827 - DNA, 27 bp, Artificial Sequence
  Description of Artificial Sequence: Synthetic oligonucleotide
atgcaaggtacacactggcctcccact

SEQ ID NO: 19828 - protein, 9 aa, Artificial Sequence
  Description of Artificial Sequence: Synthetic peptide
MQGTHWPPT

SEQ ID NO: 19829 - DNA, 27 bp, Artificial Sequence
  Description of Artificial Sequence: Synthetic oligonucleotide
atgcaaggtacacactggcctcccact

SEQ ID NO: 19830 - protein, 9 aa, Artificial Sequence
  Description of Artificial Sequence: Synthetic peptide
MQGTHWPPT

SEQ ID NO: 19831 - DNA, 27 bp, Artificial Sequence
  Description of Artificial Sequence: Synthetic oligonucleotide
caacagtataatagttacccgctcagt

SEQ ID NO: 19832 - protein, 9 aa, Artificial Sequence
  Description of Artificial Sequence: Synthetic peptide
QQYNSYPLS

SEQ ID NO: 19833 - DNA, 27 bp, Artificial Sequence
  Description of Artificial Sequence: Synthetic oligonucleotide
caacagtgtgatagtttccctctcact

SEQ ID NO: 19834 - protein, 9 aa, Artificial Sequence
  Description of Artificial Sequence: Synthetic peptide
QQCDSFPLT

SEQ ID NO: 19835 - DNA, 30 bp, Artificial Sequence
  Description of Artificial Sequence: Synthetic oligonucleotide
ctacagcacaatagttaccctccgtggacg

SEQ ID NO: 19836 - protein, 10 aa, Artificial Sequence
  Description of Artificial Sequence: Synthetic peptide
LQHNSYPPWT

SEQ ID NO: 19837 - DNA, 27 bp, Artificial Sequence
  Description of Artificial Sequence: Synthetic oligonucleotide
caacaatctgatagttaccctctcact

SEQ ID NO: 19838 - protein, 9 aa, Artificial Sequence
  Description of Artificial Sequence: Synthetic peptide
QQSDSYPLT

SEQ ID NO: 19839 - DNA, 27 bp, Artificial Sequence
  Description of Artificial Sequence: Synthetic oligonucleotide
caacaatctgatagttaccctctcact

SEQ ID NO: 19840 - protein, 9 aa, Artificial Sequence
  Description of Artificial Sequence: Synthetic peptide
QQSDSYPLT

SEQ ID NO: 19841 - DNA, 27 bp, Artificial Sequence
  Description of Artificial Sequence: Synthetic oligonucleotide
atgcaaggtacacactggcctctcact

SEQ ID NO: 19842 - protein, 9 aa, Artificial Sequence
  Description of Artificial Sequence: Synthetic peptide
MQGTHWPLT

SEQ ID NO: 19843 - DNA, 27 bp, Artificial Sequence
  Description of Artificial Sequence: Synthetic oligonucleotide
caacaatctaatagttaccctctcact

SEQ ID NO: 19844 - protein, 9 aa, Artificial Sequence
  Description of Artificial Sequence: Synthetic peptide
QQSNSYPLT

SEQ ID NO: 19845 - DNA, 27 bp, Artificial Sequence
  Description of Artificial Sequence: Synthetic oligonucleotide
caacattatcttaattaccctctcacc

SEQ ID NO: 19846 - protein, 9 aa, Artificial Sequence
  Description of Artificial Sequence: Synthetic peptide
QHYLNYPLT

SEQ ID NO: 19847 - DNA, 27 bp, Artificial Sequence
  Description of Artificial Sequence: Synthetic oligonucleotide
ctacagcataatagttacccgtggacg

SEQ ID NO: 19848 - protein, 9 aa, Artificial Sequence
  Description of Artificial Sequence: Synthetic peptide
LQHNSYPWT

SEQ ID NO: 19849 - DNA, 27 bp, Artificial Sequence
  Description of Artificial Sequence: Synthetic oligonucleotide
caacagagttacagtattccgctcact

SEQ ID NO: 19850 - protein, 9 aa, Artificial Sequence
  Description of Artificial Sequence: Synthetic peptide
QQSYSIPLT

SEQ ID NO: 19851 - DNA, 27 bp, Artificial Sequence
  Description of Artificial Sequence: Synthetic oligonucleotide
ctacagcattatagtttccctcggacg

SEQ ID NO: 19852 - protein, 9 aa, Artificial Sequence
  Description of Artificial Sequence: Synthetic peptide
LQHYSFPRT

SEQ ID NO: 19853 - DNA, 27 bp, Artificial Sequence
  Description of Artificial Sequence: Synthetic oligonucleotide
gtacagcattatagtttccctcggacg

SEQ ID NO: 19854 - protein, 9 aa, Artificial Sequence
  Description of Artificial Sequence: Synthetic peptide
VQHYSFPRT

SEQ ID NO: 19855 - DNA, 24 bp, Artificial Sequence
  Description of Artificial Sequence: Synthetic oligonucleotide
atgcaaggtgcacactggttcacc

SEQ ID NO: 19856 - protein, 8 aa, Artificial Sequence
  Description of Artificial Sequence: Synthetic peptide
MQGAHWFT

SEQ ID NO: 19857 - DNA, 27 bp, Artificial Sequence
  Description of Artificial Sequence: Synthetic oligonucleotide
caacagtatgataatctcccgatcacc

SEQ ID NO: 19858 - protein, 9 aa, Artificial Sequence
  Description of Artificial Sequence: Synthetic peptide
QQYDNLPIT

SEQ ID NO: 19859 - DNA, 27 bp, Artificial Sequence
  Description of Artificial Sequence: Synthetic oligonucleotide
atgcaacctctacaaactccgttcact

SEQ ID NO: 19860 - protein, 9 aa, Artificial Sequence
  Description of Artificial Sequence: Synthetic peptide
MQPLQTPFT

SEQ ID NO: 19861 - DNA, 27 bp, Artificial Sequence
  Description of Artificial Sequence: Synthetic oligonucleotide
cagcagtatggttgctcaccgctcact

SEQ ID NO: 19862 - protein, 9 aa, Artificial Sequence
  Description of Artificial Sequence: Synthetic peptide
QQYGCSPLT

SEQ ID NO: 19863 - DNA, 27 bp, Artificial Sequence
  Description of Artificial Sequence: Synthetic oligonucleotide
cagcactatgataactcaccgtggacg

SEQ ID NO: 19864 - protein, 9 aa, Artificial Sequence
  Description of Artificial Sequence: Synthetic peptide
QHYDNSPWT

SEQ ID NO: 19865 - DNA, 27 bp, Artificial Sequence
  Description of Artificial Sequence: Synthetic oligonucleotide
caacaggctaaaagtttcccgctcact

SEQ ID NO: 19866 - protein, 9 aa, Artificial Sequence
  Description of Artificial Sequence: Synthetic peptide
QQAKSFPLT

SEQ ID NO: 19867 - DNA, 27 bp, Artificial Sequence
  Description of Artificial Sequence: Synthetic oligonucleotide
cagcactatgataactcaccgtggacg

SEQ ID NO: 19868 - protein, 9 aa, Artificial Sequence
  Description of Artificial Sequence: Synthetic peptide
QHYDNSPWT

SEQ ID NO: 19869 - DNA, 27 bp, Artificial Sequence
  Description of Artificial Sequence: Synthetic oligonucleotide
cagcactatgataactcaccgtggacg

SEQ ID NO: 19870 - protein, 9 aa, Artificial Sequence
  Description of Artificial Sequence: Synthetic peptide
QHYDNSPWT

SEQ ID NO: 19871 - DNA, 30 bp, Artificial Sequence; identical to SEQ ID NO: 17805
  Description of Artificial Sequence: Synthetic oligonucleotide

SEQ ID NO: 19872 - protein, 10 aa, Artificial Sequence
  Description of Artificial Sequence: Synthetic peptide
QQYNNWPPLT

SEQ ID NO: 19873 - DNA, 27 bp, Artificial Sequence
  Description of Artificial Sequence: Synthetic oligonucleotide
cagcagtatgaaagttcaccgtggacg

SEQ ID NO: 19874 - protein, 9 aa, Artificial Sequence
  Description of Artificial Sequence: Synthetic peptide
QQYESSPWT

SEQ ID NO: 19875 - DNA, 27 bp, Artificial Sequence
  Description of Artificial Sequence: Synthetic oligonucleotide
cagcactatgataactcaccgtggacg

SEQ ID NO: 19876 - protein, 9 aa, Artificial Sequence
  Description of Artificial Sequence: Synthetic peptide
QHYDNSPWT

SEQ ID NO: 19877 - DNA, 27 bp, Artificial Sequence
  Description of Artificial Sequence: Synthetic oligonucleotide
atacagcatagtaattacccgctcact

SEQ ID NO: 19878 - protein, 9 aa, Artificial Sequence
  Description of Artificial Sequence: Synthetic peptide
IQHSNYPLT

SEQ ID NO: 19879 - DNA, 27 bp, Artificial Sequence
  Description of Artificial Sequence: Synthetic oligonucleotide
cagcactctgataactcaccgtggacg

SEQ ID NO: 19880 - protein, 9 aa, Artificial Sequence
  Description of Artificial Sequence: Synthetic peptide
QHSDNSPWT

SEQ ID NO: 19881 - DNA, 27 bp, Artificial Sequence
  Description of Artificial Sequence: Synthetic oligonucleotide
cagcaatattatagtactcctccgacg

SEQ ID NO: 19882 - protein, 9 aa, Artificial Sequence
  Description of Artificial Sequence: Synthetic peptide
QQYYSTPPT

SEQ ID NO: 19883 - DNA, 27 bp, Artificial Sequence
  Description of Artificial Sequence: Synthetic oligonucleotide
cagcaatattatagtactccgtggacg

SEQ ID NO: 19884 - protein, 9 aa, Artificial Sequence
  Description of Artificial Sequence: Synthetic peptide
QQYYSTPWT

SEQ ID NO: 19885 - DNA, 27 bp, Artificial Sequence
  Description of Artificial Sequence: Synthetic oligonucleotide
cagcaatattatagtactccgtgcagt

SEQ ID NO: 19886 - protein, 9 aa, Artificial Sequence
  Description of Artificial Sequence: Synthetic peptide
QQYYSTPCS

SEQ ID NO: 19887 - DNA, 27 bp, Artificial Sequence
  Description of Artificial Sequence: Synthetic oligonucleotide
cagcattatgataactcaccgtggacg

SEQ ID NO: 19888 - protein, 9 aa, Artificial Sequence
  Description of Artificial Sequence: Synthetic peptide
QHYDNSPWT

SEQ ID NO: 19889 - DNA, 27 bp, Artificial Sequence
  Description of Artificial Sequence: Synthetic oligonucleotide
atgcaagctctacaccctcctctcact

SEQ ID NO: 19890 - protein, 9 aa, Artificial Sequence
  Description of Artificial Sequence: Synthetic peptide
MQALHPPLT

SEQ ID NO: 19891 - DNA, 27 bp, Artificial Sequence
  Description of Artificial Sequence: Synthetic oligonucleotide
cagcagtatggttgctcaccgctcact

SEQ ID NO: 19892 - protein, 9 aa, Artificial Sequence
  Description of Artificial Sequence: Synthetic peptide
QQYGCSPLT

SEQ ID NO: 19893 - DNA, 27 bp, Artificial Sequence
  Description of Artificial Sequence: Synthetic oligonucleotide
cagcaatattatagtattcctccgacg

SEQ ID NO: 19894 - protein, 9 aa, Artificial Sequence
  Description of Artificial Sequence: Synthetic peptide
QQYYSIPPT

SEQ ID NO: 19895 - DNA, 24 bp, Artificial Sequence
  Description of Artificial Sequence: Synthetic oligonucleotide
cagcagtatggtagctcaaggacg

SEQ ID NO: 19896 - protein, 8 aa, Artificial Sequence
  Description of Artificial Sequence: Synthetic peptide
QQYGSSRT

SEQ ID NO: 19897 - DNA, 27 bp, Artificial Sequence
  Description of Artificial Sequence: Synthetic oligonucleotide
ctacggtatgatacttaccctctcact

SEQ ID NO: 19898 - protein, 9 aa, Artificial Sequence
  Description of Artificial Sequence: Synthetic peptide
LRYDTYPLT

SEQ ID NO: 19899 - DNA, 27 bp, Artificial Sequence
  Description of Artificial Sequence: Synthetic oligonucleotide
cagcagtattatagtactcctccgacg

SEQ ID NO: 19900 - protein, 9 aa, Artificial Sequence
  Description of Artificial Sequence: Synthetic peptide
QQYYSTPPT

SEQ ID NO: 19901 - DNA, 27 bp, Artificial Sequence
  Description of Artificial Sequence: Synthetic oligonucleotide
cagcagtattatagtactcctccgacg

SEQ ID NO: 19902 - protein, 9 aa, Artificial Sequence
  Description of Artificial Sequence: Synthetic peptide
QQYYSTPPT

SEQ ID NO: 19903 - DNA, 27 bp, Artificial Sequence
  Description of Artificial Sequence: Synthetic oligonucleotide
cagcagtattatagtactcctccgacg

SEQ ID NO: 19904 - protein, 9 aa, Artificial Sequence
  Description of Artificial Sequence: Synthetic peptide
QQYYSTPPT

SEQ ID NO: 19905 - DNA, 27 bp, Artificial Sequence
  Description of Artificial Sequence: Synthetic oligonucleotide
cagcagtattatagtactcctccgacg

SEQ ID NO: 19906 - protein, 9 aa, Artificial Sequence
  Description of Artificial Sequence: Synthetic peptide
QQYYSTPPT

SEQ ID NO: 19907 - DNA, 27 bp, Artificial Sequence
  Description of Artificial Sequence: Synthetic oligonucleotide
cagcagtattatagtactcctccgacg

SEQ ID NO: 19908 - protein, 9 aa, Artificial Sequence
  Description of Artificial Sequence: Synthetic peptide
QQYYSTPPT

SEQ ID NO: 19909 - DNA, 27 bp, Artificial Sequence
  Description of Artificial Sequence: Synthetic oligonucleotide
cagcagtattatagtactcctccgacg

SEQ ID NO: 19910 - protein, 9 aa, Artificial Sequence
  Description of Artificial Sequence: Synthetic peptide
QQYYSTPPT

SEQ ID NO: 19911 - DNA, 27 bp, Artificial Sequence
  Description of Artificial Sequence: Synthetic oligonucleotide
cagcagtattatagtactcctccgacg

SEQ ID NO: 19912 - protein, 9 aa, Artificial Sequence
  Description of Artificial Sequence: Synthetic peptide
QQYYSTPPT

SEQ ID NO: 19913 - DNA, 27 bp, Artificial Sequence
  Description of Artificial Sequence: Synthetic oligonucleotide
cagcagtattatagtactcctccgacg

SEQ ID NO: 19914 - protein, 9 aa, Artificial Sequence
  Description of Artificial Sequence: Synthetic peptide
QQYYSTPPT

SEQ ID NO: 19915 - DNA, 27 bp, Artificial Sequence
  Description of Artificial Sequence: Synthetic oligonucleotide
cagcagtattatagtactcctccgacg

SEQ ID NO: 19916 - protein, 9 aa, Artificial Sequence
  Description of Artificial Sequence: Synthetic peptide
QQYYSTPPT

SEQ ID NO: 19917 - DNA, 27 bp, Artificial Sequence
  Description of Artificial Sequence: Synthetic oligonucleotide
cagcagtattatagtactcctccgacg

SEQ ID NO: 19918 - protein, 9 aa, Artificial Sequence
  Description of Artificial Sequence: Synthetic peptide
QQYYSTPPT

SEQ ID NO: 19919 - DNA, 27 bp, Artificial Sequence
  Description of Artificial Sequence: Synthetic oligonucleotide
cagcagtattatagtactcctccgacg

SEQ ID NO: 19920 - protein, 9 aa, Artificial Sequence
  Description of Artificial Sequence: Synthetic peptide
QQYYSTPPT

SEQ ID NO: 19921 - DNA, 27 bp, Artificial Sequence
  Description of Artificial Sequence: Synthetic oligonucleotide
cagcagtattatagtactcctccgacg

SEQ ID NO: 19922 - protein, 9 aa, Artificial Sequence
  Description of Artificial Sequence: Synthetic peptide
QQYYSTPPT

SEQ ID NO: 19923 - DNA, 27 bp, Artificial Sequence
  Description of Artificial Sequence: Synthetic oligonucleotide
cagcaatattatagtactccagtcact

SEQ ID NO: 19924 - protein, 9 aa, Artificial Sequence
  Description of Artificial Sequence: Synthetic peptide
QQYYSTPVT

SEQ ID NO: 19925 - DNA, 27 bp, Artificial Sequence
  Description of Artificial Sequence: Synthetic oligonucleotide
cagcaatattataatgctccagtcact

SEQ ID NO: 19926 - protein, 9 aa, Artificial Sequence
  Description of Artificial Sequence: Synthetic peptide
QQYYNAPVT

SEQ ID NO: 19927 - DNA, 27 bp, Artificial Sequence
  Description of Artificial Sequence: Synthetic oligonucleotide
cagcaatattatcaaactccagtcact

SEQ ID NO: 19928 - protein, 9 aa, Artificial Sequence
  Description of Artificial Sequence: Synthetic peptide
QQYYQTPVT

SEQ ID NO: 19929 - DNA, 27 bp, Artificial Sequence
  Description of Artificial Sequence: Synthetic oligonucleotide
cagcaatattataatactccagtcact

SEQ ID NO: 19930 - protein, 9 aa, Artificial Sequence
  Description of Artificial Sequence: Synthetic peptide
QQYYNTPVT

SEQ ID NO: 19931 - DNA, 27 bp, Artificial Sequence
  Description of Artificial Sequence: Synthetic oligonucleotide
cagcaatattataatactccagtcact

SEQ ID NO: 19932 - protein, 9 aa, Artificial Sequence
  Description of Artificial Sequence: Synthetic peptide
QQYYNTPVT

SEQ ID NO: 19933 - DNA, 27 bp, Artificial Sequence
  Description of Artificial Sequence: Synthetic oligonucleotide
cagcaatattataatactccagtcact

SEQ ID NO: 19934 - protein, 9 aa, Artificial Sequence
  Description of Artificial Sequence: Synthetic peptide
QQYYNTPVT

SEQ ID NO: 19935 - DNA, 27 bp, Artificial Sequence
  Description of Artificial Sequence: Synthetic oligonucleotide
cagcaatattatagtactccagtcact

SEQ ID NO: 19936 - protein, 9 aa, Artificial Sequence
  Description of Artificial Sequence: Synthetic peptide
QQYYSTPVT

SEQ ID NO: 19937 - DNA, 27 bp, Artificial Sequence
  Description of Artificial Sequence: Synthetic oligonucleotide
cagcaatattatagtactccagtcact

SEQ ID NO: 19938 - protein, 9 aa, Artificial Sequence
  Description of Artificial Sequence: Synthetic peptide
QQYYSTPVT

SEQ ID NO: 19939 - DNA, 27 bp, Artificial Sequence
  Description of Artificial Sequence: Synthetic oligonucleotide
cagcaatattataatgctccagtcact

SEQ ID NO: 19940 - protein, 9 aa, Artificial Sequence
  Description of Artificial Sequence: Synthetic peptide
QQYYNAPVT

SEQ ID NO: 19941 - DNA, 27 bp, Artificial Sequence
  Description of Artificial Sequence: Synthetic oligonucleotide
cagcaatattatcaaactccagtcact

SEQ ID NO: 19942 - protein, 9 aa, Artificial Sequence
  Description of Artificial Sequence: Synthetic peptide
QQYYQTPVT

SEQ ID NO: 19943 - DNA, 27 bp, Artificial Sequence
  Description of Artificial Sequence: Synthetic oligonucleotide
cagcaatattatcaaactccagtcact

SEQ ID NO: 19944 - protein, 9 aa, Artificial Sequence
  Description of Artificial Sequence: Synthetic peptide
QQYYQTPVT

SEQ ID NO: 19945 - DNA, 27 bp, Artificial Sequence
  Description of Artificial Sequence: Synthetic oligonucleotide
cagcaatattatcaaactccagtcact

SEQ ID NO: 19946 - protein, 9 aa, Artificial Sequence
  Description of Artificial Sequence: Synthetic peptide
QQYYQTPVT

SEQ ID NO: 19947 - DNA, 27 bp, Artificial Sequence
  Description of Artificial Sequence: Synthetic oligonucleotide
cagcaatattatagtactccagtcact

SEQ ID NO: 19948 - protein, 9 aa, Artificial Sequence
  Description of Artificial Sequence: Synthetic peptide
QQYYSTPVT

SEQ ID NO: 19949 - DNA, 27 bp, Artificial Sequence
  Description of Artificial Sequence: Synthetic oligonucleotide
cagcaatattatagtactccagtcact

SEQ ID NO: 19950 - protein, 9 aa, Artificial Sequence
  Description of Artificial Sequence: Synthetic peptide
QQYYSTPVT

SEQ ID NO: 19951 - DNA, 27 bp, Artificial Sequence
  Description of Artificial Sequence: Synthetic oligonucleotide
cagcaatattatagtactccagtcact

SEQ ID NO: 19952 - protein, 9 aa, Artificial Sequence
  Description of Artificial Sequence: Synthetic peptide
QQYYSTPVT

SEQ ID NO: 19953 - DNA, 27 bp, Artificial Sequence
  Description of Artificial Sequence: Synthetic oligonucleotide
cagcaatattatagtactccagtcact

SEQ ID NO: 19954 - protein, 9 aa, Artificial Sequence
  Description of Artificial Sequence: Synthetic peptide
QQYYSTPVT

SEQ ID NO: 19955 - DNA, 27 bp, Artificial Sequence
  Description of Artificial Sequence: Synthetic oligonucleotide
cagcaatattatagtactccagtcact

SEQ ID NO: 19956 - protein, 9 aa, Artificial Sequence
  Description of Artificial Sequence: Synthetic peptide
QQYYSTPVT

SEQ ID NO: 19957 - DNA, 27 bp, Artificial Sequence
  Description of Artificial Sequence: Synthetic oligonucleotide
cagcaatattataatactccagtcact

SEQ ID NO: 19958 - protein, 9 aa, Artificial Sequence
  Description of Artificial Sequence: Synthetic peptide
QQYYNTPVT

SEQ ID NO: 19959 - DNA, 27 bp, Artificial Sequence
  Description of Artificial Sequence: Synthetic oligonucleotide
caacaggctaacagtttcccattcact

SEQ ID NO: 19960 - protein, 9 aa, Artificial Sequence
  Description of Artificial Sequence: Synthetic peptide
QQANSFPFT

SEQ ID NO: 19961 - DNA, 27 bp, Artificial Sequence
  Description of Artificial Sequence: Synthetic oligonucleotide
caacaggctaacagtttcccattcact

SEQ ID NO: 19962 - protein, 9 aa, Artificial Sequence
  Description of Artificial Sequence: Synthetic peptide
QQANSFPFT

SEQ ID NO: 19963 - DNA, 27 bp, Artificial Sequence
  Description of Artificial Sequence: Synthetic oligonucleotide
caacaggctaacagtttcccattcact

SEQ ID NO: 19964 - protein, 9 aa, Artificial Sequence
  Description of Artificial Sequence: Synthetic peptide
QQANSFPFT

SEQ ID NO: 19965 - DNA, 27 bp, Artificial Sequence
  Description of Artificial Sequence: Synthetic oligonucleotide
caacaggctaacagtttcccattcact

SEQ ID NO: 19966 - protein, 9 aa, Artificial Sequence
  Description of Artificial Sequence: Synthetic peptide
QQANSFPFT

SEQ ID NO: 19967 - DNA, 27 bp, Artificial Sequence
  Description of Artificial Sequence: Synthetic oligonucleotide
caacaggctaacagtttcccattcact

SEQ ID NO: 19968 - protein, 9 aa, Artificial Sequence
  Description of Artificial Sequence: Synthetic peptide
QQANSFPFT

SEQ ID NO: 19969 - DNA, 27 bp, Artificial Sequence
  Description of Artificial Sequence: Synthetic oligonucleotide
caacaggctaacagtttcccattcact

SEQ ID NO: 19970 - protein, 9 aa, Artificial Sequence
  Description of Artificial Sequence: Synthetic peptide
QQANSFPFT

SEQ ID NO: 19971 - DNA, 27 bp, Artificial Sequence
  Description of Artificial Sequence: Synthetic oligonucleotide
caacaggctaacagtttcccattcact

SEQ ID NO: 19972 - protein, 9 aa, Artificial Sequence
  Description of Artificial Sequence: Synthetic peptide
QQANSFPFT

SEQ ID NO: 19973 - DNA, 27 bp, Artificial Sequence
  Description of Artificial Sequence: Synthetic oligonucleotide
caacaggctaacagtttcccattcact

SEQ ID NO: 19974 - protein, 9 aa, Artificial Sequence
  Description of Artificial Sequence: Synthetic peptide
QQANSFPFT

SEQ ID NO: 19975 - DNA, 27 bp, Artificial Sequence
  Description of Artificial Sequence: Synthetic oligonucleotide
ctacagcattatagttaccctcggacg

SEQ ID NO: 19976 - protein, 9 aa, Artificial Sequence
  Description of Artificial Sequence: Synthetic peptide
LQHYSYPRT

SEQ ID NO: 19977 - DNA, 27 bp, Artificial Sequence
  Description of Artificial Sequence: Synthetic oligonucleotide
ctacagcattatagttaccctcggacg

SEQ ID NO: 19978 - protein, 9 aa, Artificial Sequence
  Description of Artificial Sequence: Synthetic peptide
LQHYSYPRT

SEQ ID NO: 19979 - DNA, 27 bp, Artificial Sequence
  Description of Artificial Sequence: Synthetic oligonucleotide
ctacagcattatagttaccctcggacg

SEQ ID NO: 19980 - protein, 9 aa, Artificial Sequence
  Description of Artificial Sequence: Synthetic peptide
LQHYSYPRT

SEQ ID NO: 19981 - DNA, 27 bp, Artificial Sequence
  Description of Artificial Sequence: Synthetic oligonucleotide
ctacagcattatagttaccctcggacg

SEQ ID NO: 19982 - protein, 9 aa, Artificial Sequence
  Description of Artificial Sequence: Synthetic peptide
LQHYSYPRT

SEQ ID NO: 19983 - DNA, 27 bp, Artificial Sequence
  Description of Artificial Sequence: Synthetic oligonucleotide
ctacagcattatagttaccctcggacg

SEQ ID NO: 19984 - protein, 9 aa, Artificial Sequence
  Description of Artificial Sequence: Synthetic peptide
LQHYSYPRT

SEQ ID NO: 19985 - DNA, 27 bp, Artificial Sequence
  Description of Artificial Sequence: Synthetic oligonucleotide
ctacagcattatagttaccctcggacg

SEQ ID NO: 19986 - protein, 9 aa, Artificial Sequence
  Description of Artificial Sequence: Synthetic peptide
LQHYSYPRT

SEQ ID NO: 19987 - DNA, 27 bp, Artificial Sequence
  Description of Artificial Sequence: Synthetic oligonucleotide
ctacagcattatagttaccctcggacg

SEQ ID NO: 19988 - protein, 9 aa, Artificial Sequence
  Description of Artificial Sequence: Synthetic peptide
LQHYSYPRT

SEQ ID NO: 19989 - DNA, 27 bp, Artificial Sequence
  Description of Artificial Sequence: Synthetic oligonucleotide
ctacagcattatagttaccctcggacg

SEQ ID NO: 19990 - protein, 9 aa, Artificial Sequence
  Description of Artificial Sequence: Synthetic peptide
LQHYSYPRT

SEQ ID NO: 19991 - DNA, 27 bp, Artificial Sequence
  Description of Artificial Sequence: Synthetic oligonucleotide
ctacagcattatagttaccctcggacg

SEQ ID NO: 19992 - protein, 9 aa, Artificial Sequence
  Description of Artificial Sequence: Synthetic peptide
LQHYSYPRT

SEQ ID NO: 19993 - DNA, 27 bp, Artificial Sequence
  Description of Artificial Sequence: Synthetic oligonucleotide
ctacagcattatagttaccctcggacg

SEQ ID NO: 19994 - protein, 9 aa, Artificial Sequence
  Description of Artificial Sequence: Synthetic peptide
LQHYSYPRT

SEQ ID NO: 19995 - DNA, 27 bp, Artificial Sequence
  Description of Artificial Sequence: Synthetic oligonucleotide
ctacagcattatagttaccctcggacg

SEQ ID NO: 19996 - protein, 9 aa, Artificial Sequence
  Description of Artificial Sequence: Synthetic peptide
LQHYSYPRT

SEQ ID NO: 19997 - DNA, 27 bp, Artificial Sequence
  Description of Artificial Sequence: Synthetic oligonucleotide
ctacagcattatagttaccctcggacg

SEQ ID NO: 19998 - protein, 9 aa, Artificial Sequence
  Description of Artificial Sequence: Synthetic peptide
LQHYSYPRT

SEQ ID NO: 19999 - DNA, 27 bp, Artificial Sequence
  Description of Artificial Sequence: Synthetic oligonucleotide
ctacagcattatagttaccctcggacg

SEQ ID NO: 20000 - protein, 9 aa, Artificial Sequence
  Description of Artificial Sequence: Synthetic peptide
LQHYSYPRT

SEQ ID NO: 20001 - DNA, 27 bp, Artificial Sequence
  Description of Artificial Sequence: Synthetic oligonucleotide
ctacagcattatagttaccctcggacg

SEQ ID NO: 20002 - protein, 9 aa, Artificial Sequence
  Description of Artificial Sequence: Synthetic peptide
LQHYSYPRT

SEQ ID NO: 20003 - DNA, 27 bp, Artificial Sequence
  Description of Artificial Sequence: Synthetic oligonucleotide
caacagacttacagtaccccgctcact

SEQ ID NO: 20004 - protein, 9 aa, Artificial Sequence
  Description of Artificial Sequence: Synthetic peptide
QQTYSTPLT

SEQ ID NO: 20005 - DNA, 27 bp, Artificial Sequence
  Description of Artificial Sequence: Synthetic oligonucleotide
caacagacttacagtaccccgctcact

SEQ ID NO: 20006 - protein, 9 aa, Artificial Sequence
  Description of Artificial Sequence: Synthetic peptide
QQTYSTPLT

SEQ ID NO: 20007 - DNA, 27 bp, Artificial Sequence
  Description of Artificial Sequence: Synthetic oligonucleotide
caacagacttacagtaccccgctcact

SEQ ID NO: 20008 - protein, 9 aa, Artificial Sequence
  Description of Artificial Sequence: Synthetic peptide
QQTYSTPLT

SEQ ID NO: 20009 - DNA, 27 bp, Artificial Sequence
  Description of Artificial Sequence: Synthetic oligonucleotide
caacagacttacagtaccccgctcact

SEQ ID NO: 20010 - protein, 9 aa, Artificial Sequence
  Description of Artificial Sequence: Synthetic peptide
QQTYSTPLT

SEQ ID NO: 20011 - DNA, 27 bp, Artificial Sequence
  Description of Artificial Sequence: Synthetic oligonucleotide
caacagacttacagtaccccgctcact

SEQ ID NO: 20012 - protein, 9 aa, Artificial Sequence
  Description of Artificial Sequence: Synthetic peptide
QQTYSTPLT

SEQ ID NO: 20013 - DNA, 27 bp, Artificial Sequence
  Description of Artificial Sequence: Synthetic oligonucleotide
caacagacttacagtaccccgctcact

SEQ ID NO: 20014 - protein, 9 aa, Artificial Sequence
  Description of Artificial Sequence: Synthetic peptide
QQTYSTPLT

SEQ ID NO: 20015 - DNA, 27 bp, Artificial Sequence
  Description of Artificial Sequence: Synthetic oligonucleotide
caacagacttacagtaccccgctcact

SEQ ID NO: 20016 - protein, 9 aa, Artificial Sequence
  Description of Artificial Sequence: Synthetic peptide
QQTYSTPLT

SEQ ID NO: 20017 - DNA, 27 bp, Artificial Sequence
  Description of Artificial Sequence: Synthetic oligonucleotide
caacagacttacagtaccccgctcact

SEQ ID NO: 20018 - protein, 9 aa, Artificial Sequence
  Description of Artificial Sequence: Synthetic peptide
QQTYSTPLT

SEQ ID NO: 20019 - DNA, 27 bp, Artificial Sequence
  Description of Artificial Sequence: Synthetic oligonucleotide
caacagacttacagtaccccgctcact

SEQ ID NO: 20020 - protein, 9 aa, Artificial Sequence
  Description of Artificial Sequence: Synthetic peptide
QQTYSTPLT

SEQ ID NO: 20021 - DNA, 27 bp, Artificial Sequence
  Description of Artificial Sequence: Synthetic oligonucleotide
caacagacttacagtaccccgctcact

SEQ ID NO: 20022 - protein, 9 aa, Artificial Sequence
  Description of Artificial Sequence: Synthetic peptide
QQTYSTPLT

SEQ ID NO: 20023 - DNA, 27 bp, Artificial Sequence
  Description of Artificial Sequence: Synthetic oligonucleotide
caacagacttacagtaccccgctcact

SEQ ID NO: 20024 - protein, 9 aa, Artificial Sequence
  Description of Artificial Sequence: Synthetic peptide
QQTYSTPLT

SEQ ID NO: 20025 - DNA, 27 bp, Artificial Sequence
  Description of Artificial Sequence: Synthetic oligonucleotide
caacagacttacagtaccccgctcact

SEQ ID NO: 20026 - protein, 9 aa, Artificial Sequence
  Description of Artificial Sequence: Synthetic peptide
QQTYSTPLT

SEQ ID NO: 20027 - DNA, 27 bp, Artificial Sequence
  Description of Artificial Sequence: Synthetic oligonucleotide
caacagacttacagtaccccgctcact

SEQ ID NO: 20028 - protein, 9 aa, Artificial Sequence
  Description of Artificial Sequence: Synthetic peptide
QQTYSTPLT

SEQ ID NO: 20029 - DNA, 27 bp, Artificial Sequence
  Description of Artificial Sequence: Synthetic oligonucleotide
caacagacttacagtaccccgctcact

SEQ ID NO: 20030 - protein, 9 aa, Artificial Sequence
  Description of Artificial Sequence: Synthetic peptide
QQTYSTPLT

SEQ ID NO: 20031 - DNA, 27 bp, Artificial Sequence
  Description of Artificial Sequence: Synthetic oligonucleotide
caacagacttacagtaccccgctcact

SEQ ID NO: 20032 - protein, 9 aa, Artificial Sequence
  Description of Artificial Sequence: Synthetic peptide
QQTYSTPLT

SEQ ID NO: 20033 - DNA, 27 bp, Artificial Sequence
  Description of Artificial Sequence: Synthetic oligonucleotide
caacagacttacagtaccccgctcact

SEQ ID NO: 20034 - protein, 9 aa, Artificial Sequence
  Description of Artificial Sequence: Synthetic peptide
QQTYSTPLT

SEQ ID NO: 20035 - DNA, 27 bp, Artificial Sequence
  Description of Artificial Sequence: Synthetic oligonucleotide
caacagacttacagtaccccgctcact

SEQ ID NO: 20036 - protein, 9 aa, Artificial Sequence
  Description of Artificial Sequence: Synthetic peptide
QQTYSTPLT

SEQ ID NO: 20037 - DNA, 27 bp, Artificial Sequence
  Description of Artificial Sequence: Synthetic oligonucleotide
caacagacttacagtaccccgctcact

SEQ ID NO: 20038 - protein, 9 aa, Artificial Sequence
  Description of Artificial Sequence: Synthetic peptide
QQTYSTPLT

SEQ ID NO: 20039 - DNA, 27 bp, Artificial Sequence
  Description of Artificial Sequence: Synthetic oligonucleotide
caacagacttacagtaccccgctcact

SEQ ID NO: 20040 - protein, 9 aa, Artificial Sequence
  Description of Artificial Sequence: Synthetic peptide
QQTYSTPLT

SEQ ID NO: 20041 - DNA, 27 bp, Artificial Sequence
  Description of Artificial Sequence: Synthetic oligonucleotide
caacagacttacagtaccccgctcact

SEQ ID NO: 20042 - protein, 9 aa, Artificial Sequence
  Description of Artificial Sequence: Synthetic peptide
QQTYSTPLT

SEQ ID NO: 20043 - DNA, 27 bp, Artificial Sequence
  Description of Artificial Sequence: Synthetic oligonucleotide
caacagacttacagtaccccgctcact

SEQ ID NO: 20044 - protein, 9 aa, Artificial Sequence
  Description of Artificial Sequence: Synthetic peptide
QQTYSTPLT

SEQ ID NO: 20045 - DNA, 27 bp, Artificial Sequence
  Description of Artificial Sequence: Synthetic oligonucleotide
caacaatatggtaggtcaccattcaat

SEQ ID NO: 20046 - protein, 9 aa, Artificial Sequence
  Description of Artificial Sequence: Synthetic peptide
QQYGRSPFN

SEQ ID NO: 20047 - DNA, 33 bp, Artificial Sequence
  Description of Artificial Sequence: Synthetic oligonucleotide
cagtcctatgacaacagcctgagtggttcggta

SEQ ID NO: 20048 - protein, 11 aa, Artificial Sequence
  Description of Artificial Sequence: Synthetic peptide
QSYDNSLSGSV

SEQ ID NO: 20049 - DNA, 27 bp, Artificial Sequence
  Description of Artificial Sequence: Synthetic oligonucleotide
atgcaaggtacacactggccgctcact

SEQ ID NO: 20050 - protein, 9 aa, Artificial Sequence
  Description of Artificial Sequence: Synthetic peptide
MQGTHWPLT

SEQ ID NO: 20051 - DNA, 27 bp, Artificial Sequence
  Description of Artificial Sequence: Synthetic oligonucleotide
cagcagtattatagtactcctccgacg

SEQ ID NO: 20052 - protein, 9 aa, Artificial Sequence
  Description of Artificial Sequence: Synthetic peptide
QQYYSTPPT

SEQ ID NO: 20053 - DNA, 27 bp, Artificial Sequence
  Description of Artificial Sequence: Synthetic oligonucleotide
caacaggctaacagtttcccattcact

SEQ ID NO: 20054 - protein, 9 aa, Artificial Sequence
  Description of Artificial Sequence: Synthetic peptide
QQANSFPFT

SEQ ID NO: 20055 - DNA, 27 bp, Artificial Sequence
  Description of Artificial Sequence: Synthetic oligonucleotide
caacagacttacagtaccccgctcact

SEQ ID NO: 20056 - protein, 9 aa, Artificial Sequence
  Description of Artificial Sequence: Synthetic peptide
QQTYSTPLT

SEQ ID NO: 20057 - DNA, 27 bp, Artificial Sequence
  Description of Artificial Sequence: Synthetic oligonucleotide
cagcaatattatagttctcctcctact

SEQ ID NO: 20058 - protein, 9 aa, Artificial Sequence
  Description of Artificial Sequence: Synthetic peptide
QQYYSSPPT

SEQ ID NO: 20059 - DNA, 27 bp, Artificial Sequence
  Description of Artificial Sequence: Synthetic oligonucleotide
caccaatatcttagtagtcctctgacg

SEQ ID NO: 20060 - protein, 9 aa, Artificial Sequence
  Description of Artificial Sequence: Synthetic peptide
HQYLSSPLT

SEQ ID NO: 20061 - DNA, 27 bp, Artificial Sequence
  Description of Artificial Sequence: Synthetic oligonucleotide
cagcagtataatacctggcctctcact

SEQ ID NO: 20062 - protein, 9 aa, Artificial Sequence
  Description of Artificial Sequence: Synthetic peptide
QQYNTWPLT

SEQ ID NO: 20063 - DNA, 27 bp, Artificial Sequence
  Description of Artificial Sequence: Synthetic oligonucleotide
caacagagtcacagtttcccattcact

SEQ ID NO: 20064 - protein, 9 aa, Artificial Sequence
  Description of Artificial Sequence: Synthetic peptide
QQSHSFPFT

SEQ ID NO: 20065 - DNA, 27 bp, Artificial Sequence
  Description of Artificial Sequence: Synthetic oligonucleotide
caggcgcggaacagccgcagaggggta

SEQ ID NO: 20066 - protein, 9 aa, Artificial Sequence
  Description of Artificial Sequence: Synthetic peptide
QARNSRRGV

SEQ ID NO: 20067 - DNA, 27 bp, Artificial Sequence
  Description of Artificial Sequence: Synthetic oligonucleotide
caggcgtgggacaacagaactatggta

SEQ ID NO: 20068 - protein, 9 aa, Artificial Sequence
  Description of Artificial Sequence: Synthetic peptide
QAWDNRTMV

SEQ ID NO: 20069 - DNA, 33 bp, Artificial Sequence; identical to SEQ ID NO: 18941
  Description of Artificial Sequence: Synthetic oligonucleotide

SEQ ID NO: 20070 - protein, 11 aa, Artificial Sequence
  Description of Artificial Sequence: Synthetic peptide
TAWDDSLNGWV

SEQ ID NO: 20071 - DNA, 33 bp, Artificial Sequence; identical to SEQ ID NO: 19463
  Description of Artificial Sequence: Synthetic oligonucleotide

SEQ ID NO: 20072 - protein, 11 aa, Artificial Sequence
  Description of Artificial Sequence: Synthetic peptide
AAWDDSLNGWV

SEQ ID NO: 20073 - DNA, 33 bp, Artificial Sequence
  Description of Artificial Sequence: Synthetic oligonucleotide
acagcatgggatgacagcctgaatgattgggtg

SEQ ID NO: 20074 - protein, 11 aa, Artificial Sequence
  Description of Artificial Sequence: Synthetic peptide
TAWDDSLNDWV

SEQ ID NO: 20075 - DNA, 27 bp, Artificial Sequence
  Description of Artificial Sequence: Synthetic oligonucleotide
caggcgtgggacagcacccctgtgata

SEQ ID NO: 20076 - protein, 9 aa, Artificial Sequence
  Description of Artificial Sequence: Synthetic peptide
QAWDSTPVI

SEQ ID NO: 20077 - DNA, 27 bp, Artificial Sequence
  Description of Artificial Sequence: Synthetic oligonucleotide
caggcgtgggacagcagcactgtggta

SEQ ID NO: 20078 - protein, 9 aa, Artificial Sequence
  Description of Artificial Sequence: Synthetic peptide
QAWDSSTVV

SEQ ID NO: 20079 - DNA, 27 bp, Artificial Sequence
  Description of Artificial Sequence: Synthetic oligonucleotide
ctacagcatcatagttatcctcggacg

SEQ ID NO: 20080 - protein, 9 aa, Artificial Sequence
  Description of Artificial Sequence: Synthetic peptide
LQHHSYPRT

SEQ ID NO: 20081 - DNA, 27 bp, Artificial Sequence
  Description of Artificial Sequence: Synthetic oligonucleotide
cagcaatattttagtactccgtggacg

SEQ ID NO: 20082 - protein, 9 aa, Artificial Sequence
  Description of Artificial Sequence: Synthetic peptide
QQYFSTPWT

SEQ ID NO: 20083 - DNA, 27 bp, Artificial Sequence
  Description of Artificial Sequence: Synthetic oligonucleotide
cagcagtcttttacctggctccggacg

SEQ ID NO: 20084 - protein, 9 aa, Artificial Sequence
  Description of Artificial Sequence: Synthetic peptide
QQSFTWLRT

SEQ ID NO: 20085 - DNA, 27 bp, Artificial Sequence
  Description of Artificial Sequence: Synthetic oligonucleotide
caacattatcttacttacccgctcact

SEQ ID NO: 20086 - protein, 9 aa, Artificial Sequence
  Description of Artificial Sequence: Synthetic peptide
QHYLTYPLT

SEQ ID NO: 20087 - DNA, 27 bp, Artificial Sequence
  Description of Artificial Sequence: Synthetic oligonucleotide
cagcagtatgagatctcaccgtggacg

SEQ ID NO: 20088 - protein, 9 aa, Artificial Sequence
  Description of Artificial Sequence: Synthetic peptide
QQYEISPWT

SEQ ID NO: 20089 - DNA, 27 bp, Artificial Sequence
  Description of Artificial Sequence: Synthetic oligonucleotide
cagcaatattttagtgttcctctgacg

SEQ ID NO: 20090 - protein, 9 aa, Artificial Sequence
  Description of Artificial Sequence: Synthetic peptide
QQYFSVPLT

SEQ ID NO: 20091 - DNA, 27 bp, Artificial Sequence
  Description of Artificial Sequence: Synthetic oligonucleotide
cagcaatattatagtattcctctgacg

SEQ ID NO: 20092 - protein, 9 aa, Artificial Sequence
  Description of Artificial Sequence: Synthetic peptide
QQYYSIPLT

SEQ ID NO: 20093 - DNA, 27 bp, Artificial Sequence
  Description of Artificial Sequence: Synthetic oligonucleotide
cagcaatatcatagtattcctccgacg

SEQ ID NO: 20094 - protein, 9 aa, Artificial Sequence
  Description of Artificial Sequence: Synthetic peptide
QQYHSIPPT

SEQ ID NO: 20095 - DNA, 27 bp, Artificial Sequence
  Description of Artificial Sequence: Synthetic oligonucleotide
cagcaatattatagtactccgtgcagt

SEQ ID NO: 20096 - protein, 9 aa, Artificial Sequence
  Description of Artificial Sequence: Synthetic peptide
QQYYSTPCS

SEQ ID NO: 20097 - DNA, 27 bp, Artificial Sequence
  Description of Artificial Sequence: Synthetic oligonucleotide
cagcaatatcatagttctcctctgacg

SEQ ID NO: 20098 - protein, 9 aa, Artificial Sequence
  Description of Artificial Sequence: Synthetic peptide
QQYHSSPLT

SEQ ID NO: 20099 - DNA, 27 bp, Artificial Sequence
  Description of Artificial Sequence: Synthetic oligonucleotide
ttacagcataatgattacccattcact

SEQ ID NO: 20100 - protein, 9 aa, Artificial Sequence
  Description of Artificial Sequence: Synthetic peptide
LQHNDYPFT

SEQ ID NO: 20101 - DNA, 27 bp, Artificial Sequence
  Description of Artificial Sequence: Synthetic oligonucleotide
ctacagcataatgattacccattcact

SEQ ID NO: 20102 - protein, 9 aa, Artificial Sequence
  Description of Artificial Sequence: Synthetic peptide
LQHNDYPFT

SEQ ID NO: 20103 - DNA, 27 bp, Artificial Sequence
  Description of Artificial Sequence: Synthetic oligonucleotide
caacaggctaacagtttcccgtggacg

SEQ ID NO: 20104 - protein, 9 aa, Artificial Sequence
  Description of Artificial Sequence: Synthetic peptide
QQANSFPWT

SEQ ID NO: 20105 - DNA, 27 bp, Artificial Sequence
  Description of Artificial Sequence: Synthetic oligonucleotide
ctacagcataatgattacccattcact

SEQ ID NO: 20106 - protein, 9 aa, Artificial Sequence
  Description of Artificial Sequence: Synthetic peptide
LQHNDYPFT

SEQ ID NO: 20107 - DNA, 27 bp, Artificial Sequence
  Description of Artificial Sequence: Synthetic oligonucleotide
ctacagcataatgattacccattcact

SEQ ID NO: 20108 - protein, 9 aa, Artificial Sequence
  Description of Artificial Sequence: Synthetic peptide
LQHNDYPFT

SEQ ID NO: 20109 - DNA, 27 bp, Artificial Sequence
  Description of Artificial Sequence: Synthetic oligonucleotide
caacaggctaacagtttcccgtggacg

SEQ ID NO: 20110 - protein, 9 aa, Artificial Sequence
  Description of Artificial Sequence: Synthetic peptide
QQANSFPWT

SEQ ID NO: 20111 - DNA, 36 bp, Artificial Sequence
  Description of Artificial Sequence: Synthetic oligonucleotide
agaggagcagtggctccgtactacggtatggacgtc

SEQ ID NO: 20112 - protein, 12 aa, Artificial Sequence
  Description of Artificial Sequence: Synthetic peptide
RGAVAPYYGMDV

SEQ ID NO: 20113 - DNA, 27 bp, Artificial Sequence
  Description of Artificial Sequence: Synthetic oligonucleotide
agcagtggctggtacatgtttgactac

SEQ ID NO: 20114 - protein, 9 aa, Artificial Sequence
  Description of Artificial Sequence: Synthetic peptide
SSGWYMFDY

SEQ ID NO: 20115 - DNA, 27 bp, Artificial Sequence
  Description of Artificial Sequence: Synthetic oligonucleotide
tccagtggctggaactggttcgacccc

SEQ ID NO: 20116 - protein, 9 aa, Artificial Sequence
  Description of Artificial Sequence: Synthetic peptide
SSGWNWFDP

SEQ ID NO: 20117 - DNA, 36 bp, Artificial Sequence
  Description of Artificial Sequence: Synthetic oligonucleotide
gatcacagatatggggttcggggaggctttgactac

SEQ ID NO: 20118 - protein, 12 aa, Artificial Sequence
  Description of Artificial Sequence: Synthetic peptide
DHRYGVRGGFDY

SEQ ID NO: 20119 - DNA, 27 bp, Artificial Sequence
  Description of Artificial Sequence: Synthetic oligonucleotide
ggggaagcagtggctgtcttcgacccc

SEQ ID NO: 20120 - protein, 9 aa, Artificial Sequence
  Description of Artificial Sequence: Synthetic peptide
GEAVAVFDP

SEQ ID NO: 20121 - DNA, 51 bp, Artificial Sequence
  Description of Artificial Sequence: Synthetic oligonucleotide
gatcgggtggagggttcggggactccctactactactacggtatggacgtc

SEQ ID NO: 20122 - protein, 17 aa, Artificial Sequence
  Description of Artificial Sequence: Synthetic peptide
DRVEGSGTPYYYYGMDV

SEQ ID NO: 20123 - DNA, 24 bp, Artificial Sequence
  Description of Artificial Sequence: Synthetic oligonucleotide
gatagtaggtcgtcctgggactac

SEQ ID NO: 20124 - protein, 8 aa, Artificial Sequence
  Description of Artificial Sequence: Synthetic peptide
DSRSSWDY

SEQ ID NO: 20125 - DNA, 21 bp, Artificial Sequence
  Description of Artificial Sequence: Synthetic oligonucleotide
gggttcggtgactgggactac

SEQ ID NO: 20126 - protein, 7 aa, Artificial Sequence
  Description of Artificial Sequence: Synthetic peptide
GFGDWDY

SEQ ID NO: 20127 - DNA, 24 bp, Artificial Sequence
  Description of Artificial Sequence: Synthetic oligonucleotide
gacggtaccagcagctttgactac

SEQ ID NO: 20128 - protein, 8 aa, Artificial Sequence
  Description of Artificial Sequence: Synthetic peptide
DGTSSFDY

SEQ ID NO: 20129 - DNA, 24 bp, Artificial Sequence
  Description of Artificial Sequence: Synthetic oligonucleotide
gacggtaccagtagctttgactac

SEQ ID NO: 20130 - protein, 8 aa, Artificial Sequence
  Description of Artificial Sequence: Synthetic peptide
DGTSSFDY

SEQ ID NO: 20131 - DNA, 21 bp, Artificial Sequence
  Description of Artificial Sequence: Synthetic oligonucleotide
gactacggcggtatggacgtc

SEQ ID NO: 20132 - protein, 7 aa, Artificial Sequence
  Description of Artificial Sequence: Synthetic peptide
DYGGMDV

SEQ ID NO: 20133 - DNA, 42 bp, Artificial Sequence
  Description of Artificial Sequence: Synthetic oligonucleotide
gaaaactatagcagtggctggtacgggtacggtatggacgtc

SEQ ID NO: 20134 - protein, 14 aa, Artificial Sequence
  Description of Artificial Sequence: Synthetic peptide
ENYSSGWYGYGMDV

SEQ ID NO: 20135 - DNA, 36 bp, Artificial Sequence
  Description of Artificial Sequence: Synthetic oligonucleotide
aggtatagcagcagctggtcgggcggtatggacgtc

SEQ ID NO: 20136 - protein, 12 aa, Artificial Sequence
  Description of Artificial Sequence: Synthetic peptide
RYSSSWSGGMDV

SEQ ID NO: 20137 - DNA, 33 bp, Artificial Sequence
  Description of Artificial Sequence: Synthetic oligonucleotide
gatcgggggatcgggtacaacgatatggacgtc

SEQ ID NO: 20138 - protein, 11 aa, Artificial Sequence
  Description of Artificial Sequence: Synthetic peptide
DRGIGYNDMDV

SEQ ID NO: 20139 - DNA, 36 bp, Artificial Sequence
  Description of Artificial Sequence: Synthetic oligonucleotide
gatcattacgatttttggagtggtcactttgactac

SEQ ID NO: 20140 - protein, 12 aa, Artificial Sequence
  Description of Artificial Sequence: Synthetic peptide
DHYDFWSGHFDY

SEQ ID NO: 20141 - DNA, 24 bp, Artificial Sequence
  Description of Artificial Sequence: Synthetic oligonucleotide
gaagtggggatgacttctgactac

SEQ ID NO: 20142 - protein, 8 aa, Artificial Sequence
  Description of Artificial Sequence: Synthetic peptide
EVGMTSDY

SEQ ID NO: 20143 - DNA, 39 bp, Artificial Sequence
  Description of Artificial Sequence: Synthetic oligonucleotide
ggagacccgtataactggaactcctacgctatggacgtc

SEQ ID NO: 20144 - protein, 13 aa, Artificial Sequence
  Description of Artificial Sequence: Synthetic peptide
GDPYNWNSYAMDV

SEQ ID NO: 20145 - DNA, 42 bp, Artificial Sequence
  Description of Artificial Sequence: Synthetic oligonucleotide
gaacggtatagcagtggcttgtacgactacggtatggacgtc

SEQ ID NO: 20146 - protein, 14 aa, Artificial Sequence
  Description of Artificial Sequence: Synthetic peptide
ERYSSGLYDYGMDV

SEQ ID NO: 20147 - DNA, 36 bp, Artificial Sequence
  Description of Artificial Sequence: Synthetic oligonucleotide
gacaaaaatataatgggagatacttggtttgacttc

SEQ ID NO: 20148 - protein, 12 aa, Artificial Sequence
  Description of Artificial Sequence: Synthetic peptide
DKNIMGDTWFDF

SEQ ID NO: 20149 - DNA, 30 bp, Artificial Sequence
  Description of Artificial Sequence: Synthetic oligonucleotide
ggaaagaactatggctcctactttgactac

SEQ ID NO: 20150 - protein, 10 aa, Artificial Sequence
  Description of Artificial Sequence: Synthetic peptide
GKNYGSYFDY

SEQ ID NO: 20151 - DNA, 21 bp, Artificial Sequence
  Description of Artificial Sequence: Synthetic oligonucleotide
gactacggcggtatggacgtc

SEQ ID NO: 20152 - protein, 7 aa, Artificial Sequence
  Description of Artificial Sequence: Synthetic peptide
DYGGMDV

SEQ ID NO: 20153 - DNA, 21 bp, Artificial Sequence
  Description of Artificial Sequence: Synthetic oligonucleotide
gactacggcggtatggacgtc

SEQ ID NO: 20154 - protein, 7 aa, Artificial Sequence
  Description of Artificial Sequence: Synthetic peptide
DYGGMDV

SEQ ID NO: 20155 - DNA, 33 bp, Artificial Sequence
  Description of Artificial Sequence: Synthetic oligonucleotide
ggtacccacgggtactactacggtgtggacgtc

SEQ ID NO: 20156 - protein, 11 aa, Artificial Sequence
  Description of Artificial Sequence: Synthetic peptide
GTHGYYYGVDV

SEQ ID NO: 20157 - DNA, 21 bp, Artificial Sequence
  Description of Artificial Sequence: Synthetic oligonucleotide
gactacggcggtatggacgtc

SEQ ID NO: 20158 - protein, 7 aa, Artificial Sequence
  Description of Artificial Sequence: Synthetic peptide
DYGGMDV

SEQ ID NO: 20159 - DNA, 36 bp, Artificial Sequence
  Description of Artificial Sequence: Synthetic oligonucleotide
atggactacagtaactactactacggtatggacgtc

SEQ ID NO: 20160 - protein, 12 aa, Artificial Sequence
  Description of Artificial Sequence: Synthetic peptide
MDYSNYYYGMDV

SEQ ID NO: 20161 - DNA, 21 bp, Artificial Sequence
  Description of Artificial Sequence: Synthetic oligonucleotide
gactacggcggtatggacgtc

SEQ ID NO: 20162 - protein, 7 aa, Artificial Sequence
  Description of Artificial Sequence: Synthetic peptide
DYGGMDV

SEQ ID NO: 20163 - DNA, 42 bp, Artificial Sequence
  Description of Artificial Sequence: Synthetic oligonucleotide
gagttgtatagcagcaactggtacgactacggtatggacgtc

SEQ ID NO: 20164 - protein, 14 aa, Artificial Sequence
  Description of Artificial Sequence: Synthetic peptide
ELYSSNWYDYGMDV

SEQ ID NO: 20165 - DNA, 12 bp, Artificial Sequence
  Description of Artificial Sequence: Synthetic oligonucleotide
agcctcgacctc

SEQ ID NO: 20166 - protein, 4 aa, Artificial Sequence
  Description of Artificial Sequence: Synthetic peptide
SLDL

SEQ ID NO: 20167 - DNA, 18 bp, Artificial Sequence
  Description of Artificial Sequence: Synthetic oligonucleotide
gtcaactcttttgactcc

SEQ ID NO: 20168 - protein, 6 aa, Artificial Sequence
  Description of Artificial Sequence: Synthetic peptide
VNSFDS

SEQ ID NO: 20169 - DNA, 39 bp, Artificial Sequence
  Description of Artificial Sequence: Synthetic oligonucleotide
agaggccgtgaatatagtggctacgattactttgactac

SEQ ID NO: 20170 - protein, 13 aa, Artificial Sequence
  Description of Artificial Sequence: Synthetic peptide
RGREYSGYDYFDY

SEQ ID NO: 20171 - DNA, 27 bp, Artificial Sequence
  Description of Artificial Sequence: Synthetic oligonucleotide
agcagtggctggtacgtttttgactac

SEQ ID NO: 20172 - protein, 9 aa, Artificial Sequence
  Description of Artificial Sequence: Synthetic peptide
SSGWYVFDY

SEQ ID NO: 20173 - DNA, 27 bp, Artificial Sequence
  Description of Artificial Sequence: Synthetic oligonucleotide
agcagtggctggtacgtttttgactcc

SEQ ID NO: 20174 - protein, 9 aa, Artificial Sequence
  Description of Artificial Sequence: Synthetic peptide
SSGWYVFDS

SEQ ID NO: 20175 - DNA, 27 bp, Artificial Sequence
  Description of Artificial Sequence: Synthetic oligonucleotide
agcagtggctggtacctctttgactac

SEQ ID NO: 20176 - protein, 9 aa, Artificial Sequence
  Description of Artificial Sequence: Synthetic peptide
SSGWYLFDY

SEQ ID NO: 20177 - DNA, 27 bp, Artificial Sequence
  Description of Artificial Sequence: Synthetic oligonucleotide
cttgactctaactggggtcttgactac

SEQ ID NO: 20178 - protein, 9 aa, Artificial Sequence
  Description of Artificial Sequence: Synthetic peptide
LDSNWGLDY

SEQ ID NO: 20179 - DNA, 42 bp, Artificial Sequence
  Description of Artificial Sequence: Synthetic oligonucleotide
gagaggtatagcagtggctggtacgactacggtttggacgtc

SEQ ID NO: 20180 - protein, 14 aa, Artificial Sequence
  Description of Artificial Sequence: Synthetic peptide
ERYSSGWYDYGLDV

SEQ ID NO: 20181 - DNA, 42 bp, Artificial Sequence
  Description of Artificial Sequence: Synthetic oligonucleotide
gaacagtatagcagcagctggtacgacttcggtctggacgtc

SEQ ID NO: 20182 - protein, 14 aa, Artificial Sequence
  Description of Artificial Sequence: Synthetic peptide
EQYSSSWYDFGLDV

SEQ ID NO: 20183 - DNA, 45 bp, Artificial Sequence
  Description of Artificial Sequence: Synthetic oligonucleotide
gaggaggatcgcagtggctggtactactactacggtatggacgtc

SEQ ID NO: 20184 - protein, 15 aa, Artificial Sequence
  Description of Artificial Sequence: Synthetic peptide
EEDRSGWYYYYGMDV

SEQ ID NO: 20185 - DNA, 24 bp, Artificial Sequence
  Description of Artificial Sequence: Synthetic oligonucleotide
gcagtggctgtctcctttgactac

SEQ ID NO: 20186 - protein, 8 aa, Artificial Sequence
  Description of Artificial Sequence: Synthetic peptide
AVAVSFDY

SEQ ID NO: 20187 - DNA, 45 bp, Artificial Sequence
  Description of Artificial Sequence: Synthetic oligonucleotide
gatagagcagtggctggaaactacttctactacggtatggacgtc

SEQ ID NO: 20188 - protein, 15 aa, Artificial Sequence
  Description of Artificial Sequence: Synthetic peptide
DRAVAGNYFYYGMDV

SEQ ID NO: 20189 - DNA, 27 bp, Artificial Sequence
  Description of Artificial Sequence: Synthetic oligonucleotide
catgatttactttggtcccttgacttc

SEQ ID NO: 20190 - protein, 9 aa, Artificial Sequence
  Description of Artificial Sequence: Synthetic peptide
HDLLWSLDF

SEQ ID NO: 20191 - DNA, 27 bp, Artificial Sequence
  Description of Artificial Sequence: Synthetic oligonucleotide
agtagtggctggtacaaatttgactac

SEQ ID NO: 20192 - protein, 9 aa, Artificial Sequence
  Description of Artificial Sequence: Synthetic peptide
SSGWYKFDY

SEQ ID NO: 20193 - DNA, 15 bp, Artificial Sequence
  Description of Artificial Sequence: Synthetic oligonucleotide
gatagaggcagcagc

SEQ ID NO: 20194 - protein, 5 aa, Artificial Sequence
  Description of Artificial Sequence: Synthetic peptide
DRGSS

SEQ ID NO: 20195 - DNA, 15 bp, Artificial Sequence
  Description of Artificial Sequence: Synthetic oligonucleotide
gatagaggcagcagc

SEQ ID NO: 20196 - protein, 5 aa, Artificial Sequence
  Description of Artificial Sequence: Synthetic peptide
DRGSS

SEQ ID NO: 20197 - DNA, 42 bp, Artificial Sequence
  Description of Artificial Sequence: Synthetic oligonucleotide
gagagatataccagtggctggtatgactacggtatggacgtc

SEQ ID NO: 20198 - protein, 14 aa, Artificial Sequence
  Description of Artificial Sequence: Synthetic peptide
ERYTSGWYDYGMDV

SEQ ID NO: 20199 - DNA, 42 bp, Artificial Sequence; identical to SEQ ID NO: 20197
  Description of Artificial Sequence: Synthetic oligonucleotide

SEQ ID NO: 20200 - protein, 14 aa, Artificial Sequence
  Description of Artificial Sequence: Synthetic peptide
ERYTSGWYDYGMDV

SEQ ID NO: 20201 - DNA, 24 bp, Artificial Sequence
  Description of Artificial Sequence: Synthetic oligonucleotide
gatggtaccagctcgtttgactac

SEQ ID NO: 20202 - protein, 8 aa, Artificial Sequence
  Description of Artificial Sequence: Synthetic peptide
DGTSSFDY

SEQ ID NO: 20203 - DNA, 24 bp, Artificial Sequence
  Description of Artificial Sequence: Synthetic oligonucleotide
gatggtaccagctcgtttgactac

SEQ ID NO: 20204 - protein, 8 aa, Artificial Sequence
  Description of Artificial Sequence: Synthetic peptide
DGTSSFDY

SEQ ID NO: 20205 - DNA, 24 bp, Artificial Sequence
  Description of Artificial Sequence: Synthetic oligonucleotide
gatggtaccagctcgtttgactac

SEQ ID NO: 20206 - protein, 8 aa, Artificial Sequence
  Description of Artificial Sequence: Synthetic peptide
DGTSSFDY

SEQ ID NO: 20207 - DNA, 24 bp, Artificial Sequence
  Description of Artificial Sequence: Synthetic oligonucleotide
gatggtaccagctcgtttgactac

SEQ ID NO: 20208 - protein, 8 aa, Artificial Sequence
  Description of Artificial Sequence: Synthetic peptide
DGTSSFDY

SEQ ID NO: 20209 - DNA, 45 bp, Artificial Sequence
  Description of Artificial Sequence: Synthetic oligonucleotide
gtgtattactatggttcggggagttattataacgagtttgacaac

SEQ ID NO: 20210 - protein, 15 aa, Artificial Sequence
  Description of Artificial Sequence: Synthetic peptide
VYYYGSGSYYNEFDN

SEQ ID NO: 20211 - DNA, 45 bp, Artificial Sequence; identical to SEQ ID NO: 20209
  Description of Artificial Sequence: Synthetic oligonucleotide

SEQ ID NO: 20212 - protein, 15 aa, Artificial Sequence
  Description of Artificial Sequence: Synthetic peptide
VYYYGSGSYYNEFDN

SEQ ID NO: 20213 - DNA, 45 bp, Artificial Sequence
  Description of Artificial Sequence: Synthetic oligonucleotide
gccttttactatggttcggggacttattataacgaatttgactac

SEQ ID NO: 20214 - protein, 15 aa, Artificial Sequence
  Description of Artificial Sequence: Synthetic peptide
AFYYGSGTYYNEFDY

SEQ ID NO: 20215 - DNA, 30 bp, Artificial Sequence
  Description of Artificial Sequence: Synthetic oligonucleotide
accggtgtcagctgctgctattttcactat

SEQ ID NO: 20216 - protein, 10 aa, Artificial Sequence
  Description of Artificial Sequence: Synthetic peptide
TGVSCCYFHY

SEQ ID NO: 20217 - DNA, 24 bp, Artificial Sequence
  Description of Artificial Sequence: Synthetic oligonucleotide
atagcagcagttgcctttgactac

SEQ ID NO: 20218 - protein, 8 aa, Artificial Sequence
  Description of Artificial Sequence: Synthetic peptide
IAAVAFDY

SEQ ID NO: 20219 - DNA, 57 bp, Artificial Sequence
  Description of Artificial Sequence: Synthetic oligonucleotide
ggatattgtagtagttccagctgctatttgcaaccgggttattacggtatggacgtc

SEQ ID NO: 20220 - protein, 19 aa, Artificial Sequence
  Description of Artificial Sequence: Synthetic peptide
GYCSSSSCYLQPGYYGMDV

SEQ ID NO: 20221 - DNA, 27 bp, Artificial Sequence
  Description of Artificial Sequence: Synthetic oligonucleotide
aggggacagcagctggccctcgactac

SEQ ID NO: 20222 - protein, 9 aa, Artificial Sequence
  Description of Artificial Sequence: Synthetic peptide
RGQQLALDY

SEQ ID NO: 20223 - DNA, 63 bp, Artificial Sequence
  Description of Artificial Sequence: Synthetic oligonucleotide
gatagggtatattgtagtagtaccagctgctccccttactactactactacggtatggacgtc

SEQ ID NO: 20224 - protein, 21 aa, Artificial Sequence
  Description of Artificial Sequence: Synthetic peptide
DRVYCSSTSCSPYYYYYGMDV

SEQ ID NO: 20225 - DNA, 24 bp, Artificial Sequence
  Description of Artificial Sequence: Synthetic oligonucleotide
cttatagaagtggcctttgactat

SEQ ID NO: 20226 - protein, 8 aa, Artificial Sequence
  Description of Artificial Sequence: Synthetic peptide
LIEVAFDY

SEQ ID NO: 20227 - DNA, 45 bp, Artificial Sequence
  Description of Artificial Sequence: Synthetic oligonucleotide
tggggacgtggatacagctatgaatactactacggtatggacgtc

SEQ ID NO: 20228 - protein, 15 aa, Artificial Sequence
  Description of Artificial Sequence: Synthetic peptide
WGRGYSYEYYYGMDV

SEQ ID NO: 20229 - DNA, 45 bp, Artificial Sequence
  Description of Artificial Sequence: Synthetic oligonucleotide
tcgtactactatggttcggggagttattataacgagtttgactac

SEQ ID NO: 20230 - protein, 15 aa, Artificial Sequence
  Description of Artificial Sequence: Synthetic peptide
SYYYGSGSYYNEFDY

SEQ ID NO: 20231 - DNA, 24 bp, Artificial Sequence
  Description of Artificial Sequence: Synthetic oligonucleotide
gagcttgcctggtacgaggactac

SEQ ID NO: 20232 - protein, 8 aa, Artificial Sequence
  Description of Artificial Sequence: Synthetic peptide
ELAWYEDY

SEQ ID NO: 20233 - DNA, 18 bp, Artificial Sequence
  Description of Artificial Sequence: Synthetic oligonucleotide
gtggcttcatttgactac

SEQ ID NO: 20234 - protein, 6 aa, Artificial Sequence
  Description of Artificial Sequence: Synthetic peptide
VASFDY

SEQ ID NO: 20235 - DNA, 27 bp, Artificial Sequence
  Description of Artificial Sequence: Synthetic oligonucleotide
catggaaaagactggggccttgactac

SEQ ID NO: 20236 - protein, 9 aa, Artificial Sequence
  Description of Artificial Sequence: Synthetic peptide
HGKDWGLDY

SEQ ID NO: 20237 - DNA, 15 bp, Artificial Sequence
  Description of Artificial Sequence: Synthetic oligonucleotide
gatcgaggctccatc

SEQ ID NO: 20238 - protein, 5 aa, Artificial Sequence
  Description of Artificial Sequence: Synthetic peptide
DRGSI

SEQ ID NO: 20239 - DNA, 24 bp, Artificial Sequence
  Description of Artificial Sequence: Synthetic oligonucleotide
gatcttggctggacggaagagtac

SEQ ID NO: 20240 - protein, 8 aa, Artificial Sequence
  Description of Artificial Sequence: Synthetic peptide
DLGWTEEY

SEQ ID NO: 20241 - DNA, 27 bp, Artificial Sequence
  Description of Artificial Sequence: Synthetic oligonucleotide
catagtagcagctggtcccttgacaac

SEQ ID NO: 20242 - protein, 9 aa, Artificial Sequence
  Description of Artificial Sequence: Synthetic peptide
HSSSWSLDN

SEQ ID NO: 20243 - DNA, 24 bp, Artificial Sequence
  Description of Artificial Sequence: Synthetic oligonucleotide
gaactggggttccggtctgactac

SEQ ID NO: 20244 - protein, 8 aa, Artificial Sequence
  Description of Artificial Sequence: Synthetic peptide
ELGFRSDY

SEQ ID NO: 20245 - DNA, 18 bp, Artificial Sequence
  Description of Artificial Sequence: Synthetic oligonucleotide
gtagcagcctttgactac

SEQ ID NO: 20246 - protein, 6 aa, Artificial Sequence
  Description of Artificial Sequence: Synthetic peptide
VAAFDY

SEQ ID NO: 20247 - DNA, 42 bp, Artificial Sequence
  Description of Artificial Sequence: Synthetic oligonucleotide
gaaaagtatagcagcagctggtacgactacggtatggacgtc

SEQ ID NO: 20248 - protein, 14 aa, Artificial Sequence
  Description of Artificial Sequence: Synthetic peptide
EKYSSSWYDYGMDV

SEQ ID NO: 20249 - DNA, 48 bp, Artificial Sequence
  Description of Artificial Sequence: Synthetic oligonucleotide
gtaagcagtggctggtcccatcactactactactacggtatggacgtc

SEQ ID NO: 20250 - protein, 16 aa, Artificial Sequence
  Description of Artificial Sequence: Synthetic peptide
VSSGWSHHYYYYGMDV

SEQ ID NO: 20251 - DNA, 27 bp, Artificial Sequence
  Description of Artificial Sequence: Synthetic oligonucleotide
catggaaaagactggggccttgactac

SEQ ID NO: 20252 - protein, 9 aa, Artificial Sequence
  Description of Artificial Sequence: Synthetic peptide
HGKDWGLDY

SEQ ID NO: 20253 - DNA, 24 bp, Artificial Sequence
  Description of Artificial Sequence: Synthetic oligonucleotide
gagctaggcttccagtctgactac

SEQ ID NO: 20254 - protein, 8 aa, Artificial Sequence
  Description of Artificial Sequence: Synthetic peptide
ELGFQSDY

SEQ ID NO: 20255 - DNA, 27 bp, Artificial Sequence
  Description of Artificial Sequence: Synthetic oligonucleotide
catagtagcagttggtcccttgacgac

SEQ ID NO: 20256 - protein, 9 aa, Artificial Sequence
  Description of Artificial Sequence: Synthetic peptide
HSSSWSLDD

SEQ ID NO: 20257 - DNA, 24 bp, Artificial Sequence
  Description of Artificial Sequence: Synthetic oligonucleotide
gaactggggttccggtctgactac

SEQ ID NO: 20258 - protein, 8 aa, Artificial Sequence
  Description of Artificial Sequence: Synthetic peptide
ELGFRSDY

SEQ ID NO: 20259 - DNA, 33 bp, Artificial Sequence
  Description of Artificial Sequence: Synthetic oligonucleotide
gatctgatagcagcagctggtacggttgactac

SEQ ID NO: 20260 - protein, 11 aa, Artificial Sequence
  Description of Artificial Sequence: Synthetic peptide
DLIAAAGTVDY

SEQ ID NO: 20261 - DNA, 48 bp, Artificial Sequence
  Description of Artificial Sequence: Synthetic oligonucleotide
gtaaacagtggctggtcccatcactactactactacggtatggacgtc

SEQ ID NO: 20262 - protein, 16 aa, Artificial Sequence
  Description of Artificial Sequence: Synthetic peptide
VNSGWSHHYYYYGMDV

SEQ ID NO: 20263 - DNA, 30 bp, Artificial Sequence
  Description of Artificial Sequence: Synthetic oligonucleotide
tatcggaataaccggggatacttcgatctc

SEQ ID NO: 20264 - protein, 10 aa, Artificial Sequence
  Description of Artificial Sequence: Synthetic peptide
YRNNRGYFDL

SEQ ID NO: 20265 - DNA, 36 bp, Artificial Sequence
  Description of Artificial Sequence: Synthetic oligonucleotide
cgtttggcagtggctggctcggaggcttttgatatc

SEQ ID NO: 20266 - protein, 12 aa, Artificial Sequence
  Description of Artificial Sequence: Synthetic peptide
RLAVAGSEAFDI

SEQ ID NO: 20267 - DNA, 24 bp, Artificial Sequence
  Description of Artificial Sequence: Synthetic oligonucleotide
gaactggggttccggtctgactac

SEQ ID NO: 20268 - protein, 8 aa, Artificial Sequence
  Description of Artificial Sequence: Synthetic peptide
ELGFRSDY

SEQ ID NO: 20269 - DNA, 27 bp, Artificial Sequence
  Description of Artificial Sequence: Synthetic oligonucleotide
catggaaaagactggggccttgactac

SEQ ID NO: 20270 - protein, 9 aa, Artificial Sequence
  Description of Artificial Sequence: Synthetic peptide
HGKDWGLDY

SEQ ID NO: 20271 - DNA, 24 bp, Artificial Sequence
  Description of Artificial Sequence: Synthetic oligonucleotide
gaactggggttccggtctgactac

SEQ ID NO: 20272 - protein, 8 aa, Artificial Sequence
  Description of Artificial Sequence: Synthetic peptide
ELGFRSDY

SEQ ID NO: 20273 - DNA, 30 bp, Artificial Sequence
  Description of Artificial Sequence: Synthetic oligonucleotide
gatcgggcctatagcagctcgtctgactac

SEQ ID NO: 20274 - protein, 10 aa, Artificial Sequence
  Description of Artificial Sequence: Synthetic peptide
DRAYSSSSDY

SEQ ID NO: 20275 - DNA, 27 bp, Artificial Sequence
  Description of Artificial Sequence: Synthetic oligonucleotide
gatctgagtatgggcggaatggacgtc

SEQ ID NO: 20276 - protein, 9 aa, Artificial Sequence
  Description of Artificial Sequence: Synthetic peptide
DLSMGGMDV

SEQ ID NO: 20277 - DNA, 24 bp, Artificial Sequence
  Description of Artificial Sequence: Synthetic oligonucleotide
gaactaggcttccagtctgactac

SEQ ID NO: 20278 - protein, 8 aa, Artificial Sequence
  Description of Artificial Sequence: Synthetic peptide
ELGFQSDY

SEQ ID NO: 20279 - DNA, 36 bp, Artificial Sequence; identical to SEQ ID NO: 20265
  Description of Artificial Sequence: Synthetic oligonucleotide

SEQ ID NO: 20280 - protein, 12 aa, Artificial Sequence
  Description of Artificial Sequence: Synthetic peptide
RLAVAGSEAFDI

SEQ ID NO: 20281 - DNA, 24 bp, Artificial Sequence
  Description of Artificial Sequence: Synthetic oligonucleotide
gagcttggctggtacgaggactac

SEQ ID NO: 20282 - protein, 8 aa, Artificial Sequence
  Description of Artificial Sequence: Synthetic peptide
ELGWYEDY

SEQ ID NO: 20283 - DNA, 27 bp, Artificial Sequence
  Description of Artificial Sequence: Synthetic oligonucleotide
cattccagtagctggtcccttgactac

SEQ ID NO: 20284 - protein, 9 aa, Artificial Sequence
  Description of Artificial Sequence: Synthetic peptide
HSSSWSLDY

SEQ ID NO: 20285 - DNA, 36 bp, Artificial Sequence
  Description of Artificial Sequence: Synthetic oligonucleotide
aggatagcagcagctggtacggagtacttcgatctc

SEQ ID NO: 20286 - protein, 12 aa, Artificial Sequence
  Description of Artificial Sequence: Synthetic peptide
RIAAAGTEYFDL

SEQ ID NO: 20287 - DNA, 24 bp, Artificial Sequence
  Description of Artificial Sequence: Synthetic oligonucleotide
gaactggggttccggtctgactac

SEQ ID NO: 20288 - protein, 8 aa, Artificial Sequence
  Description of Artificial Sequence: Synthetic peptide
ELGFRSDY

SEQ ID NO: 20289 - DNA, 9 bp, Artificial Sequence
  Description of Artificial Sequence: Synthetic oligonucleotide
agggacttc

SEQ ID NO: 20290 - protein, 3 aa, Artificial Sequence
  Description of Artificial Sequence: Synthetic peptide
RDF

SEQ ID NO: 20291 - DNA, 24 bp, Artificial Sequence
  Description of Artificial Sequence: Synthetic oligonucleotide
agtgggagctacttctttgactac

SEQ ID NO: 20292 - protein, 8 aa, Artificial Sequence
  Description of Artificial Sequence: Synthetic peptide
SGSYFFDY

SEQ ID NO: 20293 - DNA, 24 bp, Artificial Sequence
  Description of Artificial Sequence: Synthetic oligonucleotide
gatcttggctggacggaagaatac

SEQ ID NO: 20294 - protein, 8 aa, Artificial Sequence
  Description of Artificial Sequence: Synthetic peptide
DLGWTEEY

SEQ ID NO: 20295 - DNA, 24 bp, Artificial Sequence
  Description of Artificial Sequence: Synthetic oligonucleotide
gatcttggctggacggaagagtac

SEQ ID NO: 20296 - protein, 8 aa, Artificial Sequence
  Description of Artificial Sequence: Synthetic peptide
DLGWTEEY

SEQ ID NO: 20297 - DNA, 24 bp, Artificial Sequence
  Description of Artificial Sequence: Synthetic oligonucleotide
ggaggtgggagcccttttgactac

SEQ ID NO: 20298 - protein, 8 aa, Artificial Sequence
  Description of Artificial Sequence: Synthetic peptide
GGGSPFDY

SEQ ID NO: 20299 - DNA, 30 bp, Artificial Sequence
  Description of Artificial Sequence: Synthetic oligonucleotide
gatcgggcctatagtagctcgtctgactac

SEQ ID NO: 20300 - protein, 10 aa, Artificial Sequence
  Description of Artificial Sequence: Synthetic peptide
DRAYSSSSDY

SEQ ID NO: 20301 - DNA, 36 bp, Artificial Sequence
  Description of Artificial Sequence: Synthetic oligonucleotide
cgtatagcagtggctggctcggaggcttttgatatc

SEQ ID NO: 20302 - protein, 12 aa, Artificial Sequence
  Description of Artificial Sequence: Synthetic peptide
RIAVAGSEAFDI

SEQ ID NO: 20303 - DNA, 24 bp, Artificial Sequence
  Description of Artificial Sequence: Synthetic oligonucleotide
gagctaggcttccagtctgatcac

SEQ ID NO: 20304 - protein, 8 aa, Artificial Sequence
  Description of Artificial Sequence: Synthetic peptide
ELGFQSDH

SEQ ID NO: 20305 - DNA, 36 bp, Artificial Sequence; identical to SEQ ID NO: 20265
  Description of Artificial Sequence: Synthetic oligonucleotide

SEQ ID NO: 20306 - protein, 12 aa, Artificial Sequence
  Description of Artificial Sequence: Synthetic peptide
RLAVAGSEAFDI

SEQ ID NO: 20307 - DNA, 36 bp, Artificial Sequence
  Description of Artificial Sequence: Synthetic oligonucleotide
cgtttagcagtggctggctcggaggcttttcatatc

SEQ ID NO: 20308 - protein, 12 aa, Artificial Sequence
  Description of Artificial Sequence: Synthetic peptide
RLAVAGSEAFHI

SEQ ID NO: 20309 - DNA, 27 bp, Artificial Sequence
  Description of Artificial Sequence: Synthetic oligonucleotide
catagcaccagctggtcccttgactac

SEQ ID NO: 20310 - protein, 9 aa, Artificial Sequence
  Description of Artificial Sequence: Synthetic peptide
HSTSWSLDY

SEQ ID NO: 20311 - DNA, 24 bp, Artificial Sequence
  Description of Artificial Sequence: Synthetic oligonucleotide
ggaggtgggagcccttttgactac

SEQ ID NO: 20312 - protein, 8 aa, Artificial Sequence
  Description of Artificial Sequence: Synthetic peptide
GGGSPFDY

SEQ ID NO: 20313 - DNA, 24 bp, Artificial Sequence
  Description of Artificial Sequence: Synthetic oligonucleotide
gagcttgcctggtacgaggactcc

SEQ ID NO: 20314 - protein, 8 aa, Artificial Sequence
  Description of Artificial Sequence: Synthetic peptide
ELAWYEDS

SEQ ID NO: 20315 - DNA, 9 bp, Artificial Sequence
  Description of Artificial Sequence: Synthetic oligonucleotide
caggactgc

SEQ ID NO: 20316 - protein, 3 aa, Artificial Sequence
  Description of Artificial Sequence: Synthetic peptide
QDC

SEQ ID NO: 20317 - DNA, 24 bp, Artificial Sequence
  Description of Artificial Sequence: Synthetic oligonucleotide
gaactggggttccggtttgactac

SEQ ID NO: 20318 - protein, 8 aa, Artificial Sequence
  Description of Artificial Sequence: Synthetic peptide
ELGFRFDY

SEQ ID NO: 20319 - DNA, 18 bp, Artificial Sequence
  Description of Artificial Sequence: Synthetic oligonucleotide
aaggctgggtttgactac

SEQ ID NO: 20320 - protein, 6 aa, Artificial Sequence
  Description of Artificial Sequence: Synthetic peptide
KAGFDY

SEQ ID NO: 20321 - DNA, 36 bp, Artificial Sequence; identical to SEQ ID NO: 20301
  Description of Artificial Sequence: Synthetic oligonucleotide

SEQ ID NO: 20322 - protein, 12 aa, Artificial Sequence
  Description of Artificial Sequence: Synthetic peptide
RIAVAGSEAFDI

SEQ ID NO: 20323 - DNA, 36 bp, Artificial Sequence
  Description of Artificial Sequence: Synthetic oligonucleotide
cgtctggcagtggctggctcggaggcttttgatatc

SEQ ID NO: 20324 - protein, 12 aa, Artificial Sequence
  Description of Artificial Sequence: Synthetic peptide
RLAVAGSEAFDI

SEQ ID NO: 20325 - DNA, 15 bp, Artificial Sequence
  Description of Artificial Sequence: Synthetic oligonucleotide
gatcgtgggagctac

SEQ ID NO: 20326 - protein, 5 aa, Artificial Sequence
  Description of Artificial Sequence: Synthetic peptide
DRGSY

SEQ ID NO: 20327 - DNA, 30 bp, Artificial Sequence
  Description of Artificial Sequence: Synthetic oligonucleotide
tatcggaataaccgggggtacttcgatctc

SEQ ID NO: 20328 - protein, 10 aa, Artificial Sequence
  Description of Artificial Sequence: Synthetic peptide
YRNNRGYFDL

SEQ ID NO: 20329 - DNA, 36 bp, Artificial Sequence
  Description of Artificial Sequence: Synthetic oligonucleotide
agatataccagtgactggcatgatgcttttgatatc

SEQ ID NO: 20330 - protein, 12 aa, Artificial Sequence
  Description of Artificial Sequence: Synthetic peptide
RYTSDWHDAFDI

SEQ ID NO: 20331 - DNA, 24 bp, Artificial Sequence
  Description of Artificial Sequence: Synthetic oligonucleotide
gagcttggctggtacgaggactac

SEQ ID NO: 20332 - protein, 8 aa, Artificial Sequence
  Description of Artificial Sequence: Synthetic peptide
ELGWYEDY

SEQ ID NO: 20333 - DNA, 15 bp, Artificial Sequence
  Description of Artificial Sequence: Synthetic oligonucleotide
gatcggggcagtggc

SEQ ID NO: 20334 - protein, 5 aa, Artificial Sequence
  Description of Artificial Sequence: Synthetic peptide
DRGSG

SEQ ID NO: 20335 - DNA, 36 bp, Artificial Sequence
  Description of Artificial Sequence: Synthetic oligonucleotide
aggtataccagtgactggcatgatgcttttgatatc

SEQ ID NO: 20336 - protein, 12 aa, Artificial Sequence
  Description of Artificial Sequence: Synthetic peptide
RYTSDWHDAFDI

SEQ ID NO: 20337 - DNA, 27 bp, Artificial Sequence
  Description of Artificial Sequence: Synthetic oligonucleotide
gatctgagtatgggcggtatggacgtc

SEQ ID NO: 20338 - protein, 9 aa, Artificial Sequence
  Description of Artificial Sequence: Synthetic peptide
DLSMGGMDV

SEQ ID NO: 20339 - DNA, 24 bp, Artificial Sequence
  Description of Artificial Sequence: Synthetic oligonucleotide
gaggttggctggtacgaggactac

SEQ ID NO: 20340 - protein, 8 aa, Artificial Sequence
  Description of Artificial Sequence: Synthetic peptide
EVGWYEDY

SEQ ID NO: 20341 - DNA, 42 bp, Artificial Sequence
  Description of Artificial Sequence: Synthetic oligonucleotide
gagaagtatagcagcagctggtacgactacggtatggacgtc

SEQ ID NO: 20342 - protein, 14 aa, Artificial Sequence
  Description of Artificial Sequence: Synthetic peptide
EKYSSSWYDYGMDV

SEQ ID NO: 20343 - DNA, 24 bp, Artificial Sequence
  Description of Artificial Sequence: Synthetic oligonucleotide
gaactggggttccggtctgactac

SEQ ID NO: 20344 - protein, 8 aa, Artificial Sequence
  Description of Artificial Sequence: Synthetic peptide
ELGFRSDY

SEQ ID NO: 20345 - DNA, 18 bp, Artificial Sequence
  Description of Artificial Sequence: Synthetic oligonucleotide
gtagcagctcttgactac

SEQ ID NO: 20346 - protein, 6 aa, Artificial Sequence
  Description of Artificial Sequence: Synthetic peptide
VAALDY

SEQ ID NO: 20347 - DNA, 12 bp, Artificial Sequence
  Description of Artificial Sequence: Synthetic oligonucleotide
aactgggactac

SEQ ID NO: 20348 - protein, 4 aa, Artificial Sequence
  Description of Artificial Sequence: Synthetic peptide
NWDY

SEQ ID NO: 20349 - DNA, 33 bp, Artificial Sequence
  Description of Artificial Sequence: Synthetic oligonucleotide
gatctaatagcagcagctggtacggttgactac

SEQ ID NO: 20350 - protein, 11 aa, Artificial Sequence
  Description of Artificial Sequence: Synthetic peptide
DLIAAAGTVDY

SEQ ID NO: 20351 - DNA, 21 bp, Artificial Sequence
  Description of Artificial Sequence: Synthetic oligonucleotide
ggggtatggttcggggacctc

SEQ ID NO: 20352 - protein, 7 aa, Artificial Sequence
  Description of Artificial Sequence: Synthetic peptide
GVWFGDL

SEQ ID NO: 20353 - DNA, 24 bp, Artificial Sequence
  Description of Artificial Sequence: Synthetic oligonucleotide
gagcttggctggtacgaggactac

SEQ ID NO: 20354 - protein, 8 aa, Artificial Sequence
  Description of Artificial Sequence: Synthetic peptide
ELGWYEDY

SEQ ID NO: 20355 - DNA, 36 bp, Artificial Sequence; identical to SEQ ID NO: 20265
  Description of Artificial Sequence: Synthetic oligonucleotide

SEQ ID NO: 20356 - protein, 12 aa, Artificial Sequence
  Description of Artificial Sequence: Synthetic peptide
RLAVAGSEAFDI

SEQ ID NO: 20357 - DNA, 36 bp, Artificial Sequence
  Description of Artificial Sequence: Synthetic oligonucleotide
cgtttagcagtggctggctcggaggcttttgatatc

SEQ ID NO: 20358 - protein, 12 aa, Artificial Sequence
  Description of Artificial Sequence: Synthetic peptide
RLAVAGSEAFDI

SEQ ID NO: 20359 - DNA, 36 bp, Artificial Sequence
  Description of Artificial Sequence: Synthetic oligonucleotide
cgtatggcagtggctggctcggaggcttttgatatc

SEQ ID NO: 20360 - protein, 12 aa, Artificial Sequence
  Description of Artificial Sequence: Synthetic peptide
RMAVAGSEAFDI

SEQ ID NO: 20361 - DNA, 36 bp, Artificial Sequence
  Description of Artificial Sequence: Synthetic oligonucleotide
agaaatagcagtggctggcatgatgtttttgatatc

SEQ ID NO: 20362 - protein, 12 aa, Artificial Sequence
  Description of Artificial Sequence: Synthetic peptide
RNSSGWHDVFDI

SEQ ID NO: 20363 - DNA, 15 bp, Artificial Sequence
  Description of Artificial Sequence: Synthetic oligonucleotide
gatcggggcagtggc

SEQ ID NO: 20364 - protein, 5 aa, Artificial Sequence
  Description of Artificial Sequence: Synthetic peptide
DRGSG

SEQ ID NO: 20365 - DNA, 36 bp, Artificial Sequence; identical to SEQ ID NO: 20335
  Description of Artificial Sequence: Synthetic oligonucleotide

SEQ ID NO: 20366 - protein, 12 aa, Artificial Sequence
  Description of Artificial Sequence: Synthetic peptide
RYTSDWHDAFDI

SEQ ID NO: 20367 - DNA, 24 bp, Artificial Sequence
  Description of Artificial Sequence: Synthetic oligonucleotide
gaactggggttccggtttgactac

SEQ ID NO: 20368 - protein, 8 aa, Artificial Sequence
  Description of Artificial Sequence: Synthetic peptide
ELGFRFDY

SEQ ID NO: 20369 - DNA, 27 bp, Artificial Sequence
  Description of Artificial Sequence: Synthetic oligonucleotide
cttagcagcagctgggacttccagcac

SEQ ID NO: 20370 - protein, 9 aa, Artificial Sequence
  Description of Artificial Sequence: Synthetic peptide
LSSSWDFQH

SEQ ID NO: 20371 - DNA, 18 bp, Artificial Sequence
  Description of Artificial Sequence: Synthetic oligonucleotide
gcggctggctttgactac

SEQ ID NO: 20372 - protein, 6 aa, Artificial Sequence
  Description of Artificial Sequence: Synthetic peptide
AAGFDY

SEQ ID NO: 20373 - DNA, 15 bp, Artificial Sequence
  Description of Artificial Sequence: Synthetic oligonucleotide
gataggggcagcctc

SEQ ID NO: 20374 - protein, 5 aa, Artificial Sequence
  Description of Artificial Sequence: Synthetic peptide
DRGSL

SEQ ID NO: 20375 - DNA, 24 bp, Artificial Sequence
  Description of Artificial Sequence: Synthetic oligonucleotide
gaagtggggttccggtctgactac

SEQ ID NO: 20376 - protein, 8 aa, Artificial Sequence
  Description of Artificial Sequence: Synthetic peptide
EVGFRSDY

SEQ ID NO: 20377 - DNA, 18 bp, Artificial Sequence
  Description of Artificial Sequence: Synthetic oligonucleotide
gtagcagcccttgactcc

SEQ ID NO: 20378 - protein, 6 aa, Artificial Sequence
  Description of Artificial Sequence: Synthetic peptide
VAALDS

SEQ ID NO: 20379 - DNA, 18 bp, Artificial Sequence
  Description of Artificial Sequence: Synthetic oligonucleotide
actggggtctttgactac

SEQ ID NO: 20380 - protein, 6 aa, Artificial Sequence
  Description of Artificial Sequence: Synthetic peptide
TGVFDY

SEQ ID NO: 20381 - DNA, 27 bp, Artificial Sequence
  Description of Artificial Sequence: Synthetic oligonucleotide
agcagtggctgggaggtctttgactac

SEQ ID NO: 20382 - protein, 9 aa, Artificial Sequence
  Description of Artificial Sequence: Synthetic peptide
SSGWEVFDY

SEQ ID NO: 20383 - DNA, 15 bp, Artificial Sequence
  Description of Artificial Sequence: Synthetic oligonucleotide
gacagaggcagtctc

SEQ ID NO: 20384 - protein, 5 aa, Artificial Sequence
  Description of Artificial Sequence: Synthetic peptide
DRGSL

SEQ ID NO: 20385 - DNA, 24 bp, Artificial Sequence
  Description of Artificial Sequence: Synthetic oligonucleotide
gatcttggctggacggaagagtac

SEQ ID NO: 20386 - protein, 8 aa, Artificial Sequence
  Description of Artificial Sequence: Synthetic peptide
DLGWTEEY

SEQ ID NO: 20387 - DNA, 15 bp, Artificial Sequence
  Description of Artificial Sequence: Synthetic oligonucleotide
gatcgtgggagctac

SEQ ID NO: 20388 - protein, 5 aa, Artificial Sequence
  Description of Artificial Sequence: Synthetic peptide
DRGSY

SEQ ID NO: 20389 - DNA, 27 bp, Artificial Sequence
  Description of Artificial Sequence: Synthetic oligonucleotide
catggaaaagactggggccttgactac

SEQ ID NO: 20390 - protein, 9 aa, Artificial Sequence
  Description of Artificial Sequence: Synthetic peptide
HGKDWGLDY

SEQ ID NO: 20391 - DNA, 24 bp, Artificial Sequence
  Description of Artificial Sequence: Synthetic oligonucleotide
gatcttggctggacggaagagtac

SEQ ID NO: 20392 - protein, 8 aa, Artificial Sequence
  Description of Artificial Sequence: Synthetic peptide
DLGWTEEY

SEQ ID NO: 20393 - DNA, 27 bp, Artificial Sequence
  Description of Artificial Sequence: Synthetic oligonucleotide
gatctgagtatgggcggtatggacgtc

SEQ ID NO: 20394 - protein, 9 aa, Artificial Sequence
  Description of Artificial Sequence: Synthetic peptide
DLSMGGMDV

SEQ ID NO: 20395 - DNA, 27 bp, Artificial Sequence
  Description of Artificial Sequence: Synthetic oligonucleotide
ctcagcagcagctggtccgttgactac

SEQ ID NO: 20396 - protein, 9 aa, Artificial Sequence
  Description of Artificial Sequence: Synthetic peptide
LSSSWSVDY

SEQ ID NO: 20397 - DNA, 18 bp, Artificial Sequence
  Description of Artificial Sequence: Synthetic oligonucleotide
accagtggctttgactac

SEQ ID NO: 20398 - protein, 6 aa, Artificial Sequence
  Description of Artificial Sequence: Synthetic peptide
TSGFDY

SEQ ID NO: 20399 - DNA, 27 bp, Artificial Sequence
  Description of Artificial Sequence: Synthetic oligonucleotide
gtagcagtggcaggcggtatggacgtc

SEQ ID NO: 20400 - protein, 9 aa, Artificial Sequence
  Description of Artificial Sequence: Synthetic peptide
VAVAGGMDV

SEQ ID NO: 20401 - DNA, 36 bp, Artificial Sequence
  Description of Artificial Sequence: Synthetic oligonucleotide
aggtataacagtggctggcatgatgtttttgatatc

SEQ ID NO: 20402 - protein, 12 aa, Artificial Sequence
  Description of Artificial Sequence: Synthetic peptide
RYNSGWHDVFDI

SEQ ID NO: 20403 - DNA, 24 bp, Artificial Sequence
  Description of Artificial Sequence: Synthetic oligonucleotide
gagttggggttccggtctgactac

SEQ ID NO: 20404 - protein, 8 aa, Artificial Sequence
  Description of Artificial Sequence: Synthetic peptide
ELGFRSDY

SEQ ID NO: 20405 - DNA, 36 bp, Artificial Sequence
  Description of Artificial Sequence: Synthetic oligonucleotide
cgtttggcagtggctggctcggaggcttgtgatatc

SEQ ID NO: 20406 - protein, 12 aa, Artificial Sequence
  Description of Artificial Sequence: Synthetic peptide
RLAVAGSEACDI

SEQ ID NO: 20407 - DNA, 30 bp, Artificial Sequence
  Description of Artificial Sequence: Synthetic oligonucleotide
gatgggggatttttggagtggttagactac

SEQ ID NO: 20408 - protein, 10 aa, Artificial Sequence
  Description of Artificial Sequence: Synthetic peptide
DGGFLEWLDY

SEQ ID NO: 20409 - DNA, 36 bp, Artificial Sequence; identical to SEQ ID NO: 20301
  Description of Artificial Sequence: Synthetic oligonucleotide

SEQ ID NO: 20410 - protein, 12 aa, Artificial Sequence
  Description of Artificial Sequence: Synthetic peptide
RIAVAGSEAFDI

SEQ ID NO: 20411 - DNA, 21 bp, Artificial Sequence
  Description of Artificial Sequence: Synthetic oligonucleotide
ggggtttggttcggggacttc

SEQ ID NO: 20412 - protein, 7 aa, Artificial Sequence
  Description of Artificial Sequence: Synthetic peptide
GVWFGDF

SEQ ID NO: 20413 - DNA, 27 bp, Artificial Sequence
  Description of Artificial Sequence: Synthetic oligonucleotide
ctgagcagcagctggtcttttgactac

SEQ ID NO: 20414 - protein, 9 aa, Artificial Sequence
  Description of Artificial Sequence: Synthetic peptide
LSSSWSFDY

SEQ ID NO: 20415 - DNA, 27 bp, Artificial Sequence
  Description of Artificial Sequence: Synthetic oligonucleotide
catggaaaagactggggccttgactac

SEQ ID NO: 20416 - protein, 9 aa, Artificial Sequence
  Description of Artificial Sequence: Synthetic peptide
HGKDWGLDY

SEQ ID NO: 20417 - DNA, 27 bp, Artificial Sequence
  Description of Artificial Sequence: Synthetic oligonucleotide
ctcagcagcagctggtccattgacaac

SEQ ID NO: 20418 - protein, 9 aa, Artificial Sequence
  Description of Artificial Sequence: Synthetic peptide
LSSSWSIDN

SEQ ID NO: 20419 - DNA, 24 bp, Artificial Sequence
  Description of Artificial Sequence: Synthetic oligonucleotide
tcactatggtccccctttgactac

SEQ ID NO: 20420 - protein, 8 aa, Artificial Sequence
  Description of Artificial Sequence: Synthetic peptide
SLWSPFDY

SEQ ID NO: 20421 - DNA, 27 bp, Artificial Sequence
  Description of Artificial Sequence: Synthetic oligonucleotide
ggcccgacttcggggtggttcgacccc

SEQ ID NO: 20422 - protein, 9 aa, Artificial Sequence
  Description of Artificial Sequence: Synthetic peptide
GPTSGWFDP

SEQ ID NO: 20423 - DNA, 24 bp, Artificial Sequence
  Description of Artificial Sequence: Synthetic oligonucleotide
gatcttggctggacggaagagtac

SEQ ID NO: 20424 - protein, 8 aa, Artificial Sequence
  Description of Artificial Sequence: Synthetic peptide
DLGWTEEY

SEQ ID NO: 20425 - DNA, 27 bp, Artificial Sequence
  Description of Artificial Sequence: Synthetic oligonucleotide
catagcggcagctggtcccttgactac

SEQ ID NO: 20426 - protein, 9 aa, Artificial Sequence
  Description of Artificial Sequence: Synthetic peptide
HSGSWSLDY

SEQ ID NO: 20427 - DNA, 42 bp, Artificial Sequence; identical to SEQ ID NO: 20247
  Description of Artificial Sequence: Synthetic oligonucleotide

SEQ ID NO: 20428 - protein, 14 aa, Artificial Sequence
  Description of Artificial Sequence: Synthetic peptide
EKYSSSWYDYGMDV

SEQ ID NO: 20429 - DNA, 27 bp, Artificial Sequence
  Description of Artificial Sequence: Synthetic oligonucleotide
catggaaaagactggggccttgactac

SEQ ID NO: 20430 - protein, 9 aa, Artificial Sequence
  Description of Artificial Sequence: Synthetic peptide
HGKDWGLDY

SEQ ID NO: 20431 - DNA, 18 bp, Artificial Sequence
  Description of Artificial Sequence: Synthetic oligonucleotide
agctccttgtttgactac

SEQ ID NO: 20432 - protein, 6 aa, Artificial Sequence
  Description of Artificial Sequence: Synthetic peptide
SSLFDY

SEQ ID NO: 20433 - DNA, 18 bp, Artificial Sequence
  Description of Artificial Sequence: Synthetic oligonucleotide
agcagtggctggttcgcc

SEQ ID NO: 20434 - protein, 6 aa, Artificial Sequence
  Description of Artificial Sequence: Synthetic peptide
SSGWFA

SEQ ID NO: 20435 - DNA, 15 bp, Artificial Sequence
  Description of Artificial Sequence: Synthetic oligonucleotide
gatcggggcagtctc

SEQ ID NO: 20436 - protein, 5 aa, Artificial Sequence
  Description of Artificial Sequence: Synthetic peptide
DRGSL

SEQ ID NO: 20437 - DNA, 42 bp, Artificial Sequence
  Description of Artificial Sequence: Synthetic oligonucleotide
gaggaatatagtagtggctggtacgactacggtatggacgtc

SEQ ID NO: 20438 - protein, 14 aa, Artificial Sequence
  Description of Artificial Sequence: Synthetic peptide
EEYSSGWYDYGMDV

SEQ ID NO: 20439 - DNA, 15 bp, Artificial Sequence
  Description of Artificial Sequence: Synthetic oligonucleotide
gatcgtgggagctgc

SEQ ID NO: 20440 - protein, 5 aa, Artificial Sequence
  Description of Artificial Sequence: Synthetic peptide
DRGSC

SEQ ID NO: 20441 - DNA, 15 bp, Artificial Sequence
  Description of Artificial Sequence: Synthetic oligonucleotide
gatcgtgggagcctc

SEQ ID NO: 20442 - protein, 5 aa, Artificial Sequence
  Description of Artificial Sequence: Synthetic peptide
DRGSL

SEQ ID NO: 20443 - DNA, 36 bp, Artificial Sequence; identical to SEQ ID NO: 20265
  Description of Artificial Sequence: Synthetic oligonucleotide

SEQ ID NO: 20444 - protein, 12 aa, Artificial Sequence
  Description of Artificial Sequence: Synthetic peptide
RLAVAGSEAFDI

SEQ ID NO: 20445 - DNA, 24 bp, Artificial Sequence
  Description of Artificial Sequence: Synthetic oligonucleotide
gaactggggttccggtctgactat

SEQ ID NO: 20446 - protein, 8 aa, Artificial Sequence
  Description of Artificial Sequence: Synthetic peptide
ELGFRSDY

SEQ ID NO: 20447 - DNA, 18 bp, Artificial Sequence
  Description of Artificial Sequence: Synthetic oligonucleotide
gtagtgggagctgtccac

SEQ ID NO: 20448 - protein, 6 aa, Artificial Sequence
  Description of Artificial Sequence: Synthetic peptide
VVGAVH

SEQ ID NO: 20449 - DNA, 27 bp, Artificial Sequence
  Description of Artificial Sequence: Synthetic oligonucleotide
catggaaaagactggggccttgactac

SEQ ID NO: 20450 - protein, 9 aa, Artificial Sequence
  Description of Artificial Sequence: Synthetic peptide
HGKDWGLDY

SEQ ID NO: 20451 - DNA, 24 bp, Artificial Sequence
  Description of Artificial Sequence: Synthetic oligonucleotide
gagcttgcctggtacgaagactac

SEQ ID NO: 20452 - protein, 8 aa, Artificial Sequence
  Description of Artificial Sequence: Synthetic peptide
ELAWYEDY

SEQ ID NO: 20453 - DNA, 36 bp, Artificial Sequence
  Description of Artificial Sequence: Synthetic oligonucleotide
gaggacggtgccttcggctactacggtatggacgtc

SEQ ID NO: 20454 - protein, 12 aa, Artificial Sequence
  Description of Artificial Sequence: Synthetic peptide
EDGAFGYYGMDV

SEQ ID NO: 20455 - DNA, 24 bp, Artificial Sequence
  Description of Artificial Sequence: Synthetic oligonucleotide
gaattggggttccggtctgactac

SEQ ID NO: 20456 - protein, 8 aa, Artificial Sequence
  Description of Artificial Sequence: Synthetic peptide
ELGFRSDY

SEQ ID NO: 20457 - DNA, 36 bp, Artificial Sequence
  Description of Artificial Sequence: Synthetic oligonucleotide
cggggatacagctatggcgggtacggtatggacgtc

SEQ ID NO: 20458 - protein, 12 aa, Artificial Sequence
  Description of Artificial Sequence: Synthetic peptide
RGYSYGGYGMDV

SEQ ID NO: 20459 - DNA, 27 bp, Artificial Sequence
  Description of Artificial Sequence: Synthetic oligonucleotide
ctgagcagcagctggtcttttgactac

SEQ ID NO: 20460 - protein, 9 aa, Artificial Sequence
  Description of Artificial Sequence: Synthetic peptide
LSSSWSFDY

SEQ ID NO: 20461 - DNA, 42 bp, Artificial Sequence; identical to SEQ ID NO: 20197
  Description of Artificial Sequence: Synthetic oligonucleotide

SEQ ID NO: 20462 - protein, 14 aa, Artificial Sequence
  Description of Artificial Sequence: Synthetic peptide
ERYTSGWYDYGMDV

SEQ ID NO: 20463 - DNA, 42 bp, Artificial Sequence
  Description of Artificial Sequence: Synthetic oligonucleotide
tattgtagtagtgccaggtgcccttatgatgcctttgatatc

SEQ ID NO: 20464 - protein, 14 aa, Artificial Sequence
  Description of Artificial Sequence: Synthetic peptide
YCSSARCPYDAFDI

SEQ ID NO: 20465 - DNA, 24 bp, Artificial Sequence
  Description of Artificial Sequence: Synthetic oligonucleotide
gatcttggctggacggaagagtac

SEQ ID NO: 20466 - protein, 8 aa, Artificial Sequence
  Description of Artificial Sequence: Synthetic peptide
DLGWTEEY

SEQ ID NO: 20467 - DNA, 36 bp, Artificial Sequence; identical to SEQ ID NO: 20301
  Description of Artificial Sequence: Synthetic oligonucleotide

SEQ ID NO: 20468 - protein, 12 aa, Artificial Sequence
  Description of Artificial Sequence: Synthetic peptide
RIAVAGSEAFDI

SEQ ID NO: 20469 - DNA, 24 bp, Artificial Sequence
  Description of Artificial Sequence: Synthetic oligonucleotide
gagttaggcttccagtctgactac

SEQ ID NO: 20470 - protein, 8 aa, Artificial Sequence
  Description of Artificial Sequence: Synthetic peptide
ELGFQSDY

SEQ ID NO: 20471 - DNA, 27 bp, Artificial Sequence
  Description of Artificial Sequence: Synthetic oligonucleotide
catggaaaagactggggccttgacttc

SEQ ID NO: 20472 - protein, 9 aa, Artificial Sequence
  Description of Artificial Sequence: Synthetic peptide
HGKDWGLDF

SEQ ID NO: 20473 - DNA, 42 bp, Artificial Sequence
  Description of Artificial Sequence: Synthetic oligonucleotide
gaaaggtatagcagtggctggcacgactacggtatggacgtc

SEQ ID NO: 20474 - protein, 14 aa, Artificial Sequence
  Description of Artificial Sequence: Synthetic peptide
ERYSSGWHDYGMDV

SEQ ID NO: 20475 - DNA, 27 bp, Artificial Sequence
  Description of Artificial Sequence: Synthetic oligonucleotide
agcagtggctggtactactttgactac

SEQ ID NO: 20476 - protein, 9 aa, Artificial Sequence
  Description of Artificial Sequence: Synthetic peptide
SSGWYYFDY

SEQ ID NO: 20477 - DNA, 36 bp, Artificial Sequence
  Description of Artificial Sequence: Synthetic oligonucleotide
aggtatagcagcagctggtcagggggtatggacgtc

SEQ ID NO: 20478 - protein, 12 aa, Artificial Sequence
  Description of Artificial Sequence: Synthetic peptide
RYSSSWSGGMDV

SEQ ID NO: 20479 - DNA, 18 bp, Artificial Sequence
  Description of Artificial Sequence: Synthetic oligonucleotide
ggggggtccctcttctac

SEQ ID NO: 20480 - protein, 6 aa, Artificial Sequence
  Description of Artificial Sequence: Synthetic peptide
GGSLFY

SEQ ID NO: 20481 - DNA, 9 bp, Artificial Sequence
  Description of Artificial Sequence: Synthetic oligonucleotide
caggactgc

SEQ ID NO: 20482 - protein, 3 aa, Artificial Sequence
  Description of Artificial Sequence: Synthetic peptide
QDC

SEQ ID NO: 20483 - DNA, 24 bp, Artificial Sequence
  Description of Artificial Sequence: Synthetic oligonucleotide
gagcttggctggtacgaggactac

SEQ ID NO: 20484 - protein, 8 aa, Artificial Sequence
  Description of Artificial Sequence: Synthetic peptide
ELGWYEDY

SEQ ID NO: 20485 - DNA, 27 bp, Artificial Sequence
  Description of Artificial Sequence: Synthetic oligonucleotide
catagcaccagctggtcccttgactac

SEQ ID NO: 20486 - protein, 9 aa, Artificial Sequence
  Description of Artificial Sequence: Synthetic peptide
HSTSWSLDY

SEQ ID NO: 20487 - DNA, 21 bp, Artificial Sequence
  Description of Artificial Sequence: Synthetic oligonucleotide
gaaggctggaacacggactac

SEQ ID NO: 20488 - protein, 7 aa, Artificial Sequence
  Description of Artificial Sequence: Synthetic peptide
EGWNTDY

SEQ ID NO: 20489 - DNA, 24 bp, Artificial Sequence
  Description of Artificial Sequence: Synthetic oligonucleotide
gagctaggcttccagtctgactac

SEQ ID NO: 20490 - protein, 8 aa, Artificial Sequence
  Description of Artificial Sequence: Synthetic peptide
ELGFQSDY

SEQ ID NO: 20491 - DNA, 36 bp, Artificial Sequence; identical to SEQ ID NO: 20301
  Description of Artificial Sequence: Synthetic oligonucleotide

SEQ ID NO: 20492 - protein, 12 aa, Artificial Sequence
  Description of Artificial Sequence: Synthetic peptide
RIAVAGSEAFDI

SEQ ID NO: 20493 - DNA, 27 bp, Artificial Sequence
  Description of Artificial Sequence: Synthetic oligonucleotide
catagcagtagctggtcccttgactac

SEQ ID NO: 20494 - protein, 9 aa, Artificial Sequence
  Description of Artificial Sequence: Synthetic peptide
HSSSWSLDY

SEQ ID NO: 20495 - DNA, 24 bp, Artificial Sequence
  Description of Artificial Sequence: Synthetic oligonucleotide
gagcttgcctggtacgaggactac

SEQ ID NO: 20496 - protein, 8 aa, Artificial Sequence
  Description of Artificial Sequence: Synthetic peptide
ELAWYEDY

SEQ ID NO: 20497 - DNA, 24 bp, Artificial Sequence
  Description of Artificial Sequence: Synthetic oligonucleotide
gaaattggctggttagatgactac

SEQ ID NO: 20498 - protein, 8 aa, Artificial Sequence
  Description of Artificial Sequence: Synthetic peptide
EIGWLDDY

SEQ ID NO: 20499 - DNA, 42 bp, Artificial Sequence
  Description of Artificial Sequence: Synthetic oligonucleotide
gagaggtatagcagcagctggtacgactacggtatggacgtc

SEQ ID NO: 20500 - protein, 14 aa, Artificial Sequence
  Description of Artificial Sequence: Synthetic peptide
ERYSSSWYDYGMDV

SEQ ID NO: 20501 - DNA, 18 bp, Artificial Sequence
  Description of Artificial Sequence: Synthetic oligonucleotide
gtggcgtcctttgactgc

SEQ ID NO: 20502 - protein, 6 aa, Artificial Sequence
  Description of Artificial Sequence: Synthetic peptide
VASFDC

SEQ ID NO: 20503 - DNA, 24 bp, Artificial Sequence
  Description of Artificial Sequence: Synthetic oligonucleotide
gaattaggctggtacgacgactac

SEQ ID NO: 20504 - protein, 8 aa, Artificial Sequence
  Description of Artificial Sequence: Synthetic peptide
ELGWYDDY

SEQ ID NO: 20505 - DNA, 24 bp, Artificial Sequence
  Description of Artificial Sequence: Synthetic oligonucleotide
gaactgggaatgacgggtgactac

SEQ ID NO: 20506 - protein, 8 aa, Artificial Sequence
  Description of Artificial Sequence: Synthetic peptide
ELGMTGDY

SEQ ID NO: 20507 - DNA, 30 bp, Artificial Sequence
  Description of Artificial Sequence: Synthetic oligonucleotide
gaaaatagcagctcgtactactttgactac

SEQ ID NO: 20508 - protein, 10 aa, Artificial Sequence
  Description of Artificial Sequence: Synthetic peptide
ENSSSYYFDY

SEQ ID NO: 20509 - DNA, 36 bp, Artificial Sequence
  Description of Artificial Sequence: Synthetic oligonucleotide
agatatagcagcagctggacggggggtatggacgtc

SEQ ID NO: 20510 - protein, 12 aa, Artificial Sequence
  Description of Artificial Sequence: Synthetic peptide
RYSSSWTGGMDV

SEQ ID NO: 20511 - DNA, 27 bp, Artificial Sequence
  Description of Artificial Sequence: Synthetic oligonucleotide
agcagtggctggtactactttgactac

SEQ ID NO: 20512 - protein, 9 aa, Artificial Sequence
  Description of Artificial Sequence: Synthetic peptide
SSGWYYFDY

SEQ ID NO: 20513 - DNA, 36 bp, Artificial Sequence
  Description of Artificial Sequence: Synthetic oligonucleotide
gagggatacgatttttggagtggcttctttgactcc

SEQ ID NO: 20514 - protein, 12 aa, Artificial Sequence
  Description of Artificial Sequence: Synthetic peptide
EGYDFWSGFFDS

SEQ ID NO: 20515 - DNA, 24 bp, Artificial Sequence
  Description of Artificial Sequence: Synthetic oligonucleotide
gaactggggttcctctctgactac

SEQ ID NO: 20516 - protein, 8 aa, Artificial Sequence
  Description of Artificial Sequence: Synthetic peptide
ELGFLSDY

SEQ ID NO: 20517 - DNA, 27 bp, Artificial Sequence
  Description of Artificial Sequence: Synthetic oligonucleotide
agcagtggctggtactactttgactac

SEQ ID NO: 20518 - protein, 9 aa, Artificial Sequence
  Description of Artificial Sequence: Synthetic peptide
SSGWYYFDY

SEQ ID NO: 20519 - DNA, 36 bp, Artificial Sequence; identical to SEQ ID NO: 20477
  Description of Artificial Sequence: Synthetic oligonucleotide

SEQ ID NO: 20520 - protein, 12 aa, Artificial Sequence
  Description of Artificial Sequence: Synthetic peptide
RYSSSWSGGMDV

SEQ ID NO: 20521 - DNA, 24 bp, Artificial Sequence
  Description of Artificial Sequence: Synthetic oligonucleotide
gaaattggctggttagatgactac

SEQ ID NO: 20522 - protein, 8 aa, Artificial Sequence
  Description of Artificial Sequence: Synthetic peptide
EIGWLDDY

SEQ ID NO: 20523 - DNA, 42 bp, Artificial Sequence
  Description of Artificial Sequence: Synthetic oligonucleotide
ggggagctactagaggactactactactacggaatggacgtc

SEQ ID NO: 20524 - protein, 14 aa, Artificial Sequence
  Description of Artificial Sequence: Synthetic peptide
GELLEDYYYYGMDV

SEQ ID NO: 20525 - DNA, 42 bp, Artificial Sequence
  Description of Artificial Sequence: Synthetic oligonucleotide
ggggagctactagaggactactacttctacggtatggacgtc

SEQ ID NO: 20526 - protein, 14 aa, Artificial Sequence
  Description of Artificial Sequence: Synthetic peptide
GELLEDYYFYGMDV

SEQ ID NO: 20527 - DNA, 24 bp, Artificial Sequence
  Description of Artificial Sequence: Synthetic oligonucleotide
gaaattggctggttagatgactac

SEQ ID NO: 20528 - protein, 8 aa, Artificial Sequence
  Description of Artificial Sequence: Synthetic peptide
EIGWLDDY

SEQ ID NO: 20529 - DNA, 18 bp, Artificial Sequence
  Description of Artificial Sequence: Synthetic oligonucleotide
acggctggttttgactac

SEQ ID NO: 20530 - protein, 6 aa, Artificial Sequence
  Description of Artificial Sequence: Synthetic peptide
TAGFDY

SEQ ID NO: 20531 - DNA, 18 bp, Artificial Sequence
  Description of Artificial Sequence: Synthetic oligonucleotide
ctgactacctttgacttc

SEQ ID NO: 20532 - protein, 6 aa, Artificial Sequence
  Description of Artificial Sequence: Synthetic peptide
LTTFDF

SEQ ID NO: 20533 - DNA, 36 bp, Artificial Sequence
  Description of Artificial Sequence: Synthetic oligonucleotide
aagatagcagtggctggtactcactactttgactac

SEQ ID NO: 20534 - protein, 12 aa, Artificial Sequence
  Description of Artificial Sequence: Synthetic peptide
KIAVAGTHYFDY

SEQ ID NO: 20535 - DNA, 27 bp, Artificial Sequence
  Description of Artificial Sequence: Synthetic oligonucleotide
gattcctccccctacggtatggacgtc

SEQ ID NO: 20536 - protein, 9 aa, Artificial Sequence
  Description of Artificial Sequence: Synthetic peptide
DSSPYGMDV

SEQ ID NO: 20537 - DNA, 24 bp, Artificial Sequence
  Description of Artificial Sequence: Synthetic oligonucleotide
gaattaggctggtacgacgactac

SEQ ID NO: 20538 - protein, 8 aa, Artificial Sequence
  Description of Artificial Sequence: Synthetic peptide
ELGWYDDY

SEQ ID NO: 20539 - DNA, 27 bp, Artificial Sequence
  Description of Artificial Sequence: Synthetic oligonucleotide
agcagtggctggtactactttgactac

SEQ ID NO: 20540 - protein, 9 aa, Artificial Sequence
  Description of Artificial Sequence: Synthetic peptide
SSGWYYFDY

SEQ ID NO: 20541 - DNA, 18 bp, Artificial Sequence
  Description of Artificial Sequence: Synthetic oligonucleotide
actggggtctttgactac

SEQ ID NO: 20542 - protein, 6 aa, Artificial Sequence
  Description of Artificial Sequence: Synthetic peptide
TGVFDY

SEQ ID NO: 20543 - DNA, 42 bp, Artificial Sequence; identical to SEQ ID NO: 20525
  Description of Artificial Sequence: Synthetic oligonucleotide

SEQ ID NO: 20544 - protein, 14 aa, Artificial Sequence
  Description of Artificial Sequence: Synthetic peptide
GELLEDYYFYGMDV

SEQ ID NO: 20545 - DNA, 21 bp, Artificial Sequence
  Description of Artificial Sequence: Synthetic oligonucleotide
ggcaatatagcaagggactac

SEQ ID NO: 20546 - protein, 7 aa, Artificial Sequence
  Description of Artificial Sequence: Synthetic peptide
GNIARDY

SEQ ID NO: 20547 - DNA, 24 bp, Artificial Sequence
  Description of Artificial Sequence: Synthetic oligonucleotide
gaactggggttcctctctgactac

SEQ ID NO: 20548 - protein, 8 aa, Artificial Sequence
  Description of Artificial Sequence: Synthetic peptide
ELGFLSDY

SEQ ID NO: 20549 - DNA, 24 bp, Artificial Sequence
  Description of Artificial Sequence: Synthetic oligonucleotide
gaattaggctggtacgacgactac

SEQ ID NO: 20550 - protein, 8 aa, Artificial Sequence
  Description of Artificial Sequence: Synthetic peptide
ELGWYDDY

SEQ ID NO: 20551 - DNA, 42 bp, Artificial Sequence
  Description of Artificial Sequence: Synthetic oligonucleotide
gaggagtatagcagtggctggtacgactacggtatggacgtc

SEQ ID NO: 20552 - protein, 14 aa, Artificial Sequence
  Description of Artificial Sequence: Synthetic peptide
EEYSSGWYDYGMDV

SEQ ID NO: 20553 - DNA, 18 bp, Artificial Sequence
  Description of Artificial Sequence: Synthetic oligonucleotide
gtggcgtcctttgactac

SEQ ID NO: 20554 - protein, 6 aa, Artificial Sequence
  Description of Artificial Sequence: Synthetic peptide
VASFDY

SEQ ID NO: 20555 - DNA, 24 bp, Artificial Sequence
  Description of Artificial Sequence: Synthetic oligonucleotide
gaaattggctggttagatgactac

SEQ ID NO: 20556 - protein, 8 aa, Artificial Sequence
  Description of Artificial Sequence: Synthetic peptide
EIGWLDDY

SEQ ID NO: 20557 - DNA, 24 bp, Artificial Sequence
  Description of Artificial Sequence: Synthetic oligonucleotide
gaactggggatgacgggtgactcc

SEQ ID NO: 20558 - protein, 8 aa, Artificial Sequence
  Description of Artificial Sequence: Synthetic peptide
ELGMTGDS

SEQ ID NO: 20559 - DNA, 42 bp, Artificial Sequence
  Description of Artificial Sequence: Synthetic oligonucleotide
ggggagctactagaggactactacttctacggtttggacgtc

SEQ ID NO: 20560 - protein, 14 aa, Artificial Sequence
  Description of Artificial Sequence: Synthetic peptide
GELLEDYYFYGLDV

SEQ ID NO: 20561 - DNA, 33 bp, Artificial Sequence
  Description of Artificial Sequence: Synthetic oligonucleotide
gatcgggtgaaagctcatgatggttttgatatc

SEQ ID NO: 20562 - protein, 11 aa, Artificial Sequence
  Description of Artificial Sequence: Synthetic peptide
DRVKAHDGFDI

SEQ ID NO: 20563 - DNA, 42 bp, Artificial Sequence; identical to SEQ ID NO: 20525
  Description of Artificial Sequence: Synthetic oligonucleotide

SEQ ID NO: 20564 - protein, 14 aa, Artificial Sequence
  Description of Artificial Sequence: Synthetic peptide
GELLEDYYFYGMDV

SEQ ID NO: 20565 - DNA, 24 bp, Artificial Sequence
  Description of Artificial Sequence: Synthetic oligonucleotide
gaactggggatgacgggtgactcc

SEQ ID NO: 20566 - protein, 8 aa, Artificial Sequence
  Description of Artificial Sequence: Synthetic peptide
ELGMTGDS

SEQ ID NO: 20567 - DNA, 24 bp, Artificial Sequence
  Description of Artificial Sequence: Synthetic oligonucleotide
gaactggggatgacgggtgactac

SEQ ID NO: 20568 - protein, 8 aa, Artificial Sequence
  Description of Artificial Sequence: Synthetic peptide
ELGMTGDY

SEQ ID NO: 20569 - DNA, 27 bp, Artificial Sequence
  Description of Artificial Sequence: Synthetic oligonucleotide
agcagtggctggtactactttgactac

SEQ ID NO: 20570 - protein, 9 aa, Artificial Sequence
  Description of Artificial Sequence: Synthetic peptide
SSGWYYFDY

SEQ ID NO: 20571 - DNA, 36 bp, Artificial Sequence
  Description of Artificial Sequence: Synthetic oligonucleotide
aggtatagcaacagctggtcagggggtatggacgtc

SEQ ID NO: 20572 - protein, 12 aa, Artificial Sequence
  Description of Artificial Sequence: Synthetic peptide
RYSNSWSGGMDV

SEQ ID NO: 20573 - DNA, 39 bp, Artificial Sequence
  Description of Artificial Sequence: Synthetic oligonucleotide
ttggggcgtatagcagtgactggtccttactttgactac

SEQ ID NO: 20574 - protein, 13 aa, Artificial Sequence
  Description of Artificial Sequence: Synthetic peptide
LGRIAVTGPYFDY

SEQ ID NO: 20575 - DNA, 24 bp, Artificial Sequence
  Description of Artificial Sequence: Synthetic oligonucleotide
gaaattggctggttagatgactac

SEQ ID NO: 20576 - protein, 8 aa, Artificial Sequence
  Description of Artificial Sequence: Synthetic peptide
EIGWLDDY

SEQ ID NO: 20577 - DNA, 24 bp, Artificial Sequence
  Description of Artificial Sequence: Synthetic oligonucleotide
gaactggggttcctctctgactac

SEQ ID NO: 20578 - protein, 8 aa, Artificial Sequence
  Description of Artificial Sequence: Synthetic peptide
ELGFLSDY

SEQ ID NO: 20579 - DNA, 30 bp, Artificial Sequence
  Description of Artificial Sequence: Synthetic oligonucleotide
gaaaatagcagttcgtactactttgactac

SEQ ID NO: 20580 - protein, 10 aa, Artificial Sequence
  Description of Artificial Sequence: Synthetic peptide
ENSSSYYFDY

SEQ ID NO: 20581 - DNA, 42 bp, Artificial Sequence; identical to SEQ ID NO: 20525
  Description of Artificial Sequence: Synthetic oligonucleotide

SEQ ID NO: 20582 - protein, 14 aa, Artificial Sequence
  Description of Artificial Sequence: Synthetic peptide
GELLEDYYFYGMDV

SEQ ID NO: 20583 - DNA, 15 bp, Artificial Sequence
  Description of Artificial Sequence: Synthetic oligonucleotide
gatcgaggcagcagc

SEQ ID NO: 20584 - protein, 5 aa, Artificial Sequence
  Description of Artificial Sequence: Synthetic peptide
DRGSS

SEQ ID NO: 20585 - DNA, 42 bp, Artificial Sequence
  Description of Artificial Sequence: Synthetic oligonucleotide
cgtggatatagtggctacgaggacctcctctactttgactgc

SEQ ID NO: 20586 - protein, 14 aa, Artificial Sequence
  Description of Artificial Sequence: Synthetic peptide
RGYSGYEDLLYFDC

SEQ ID NO: 20587 - DNA, 36 bp, Artificial Sequence; identical to SEQ ID NO: 20477
  Description of Artificial Sequence: Synthetic oligonucleotide

SEQ ID NO: 20588 - protein, 12 aa, Artificial Sequence
  Description of Artificial Sequence: Synthetic peptide
RYSSSWSGGMDV

SEQ ID NO: 20589 - DNA, 27 bp, Artificial Sequence
  Description of Artificial Sequence: Synthetic oligonucleotide
gattcctccccctacggtatggacgtc

SEQ ID NO: 20590 - protein, 9 aa, Artificial Sequence
  Description of Artificial Sequence: Synthetic peptide
DSSPYGMDV

SEQ ID NO: 20591 - DNA, 27 bp, Artificial Sequence
  Description of Artificial Sequence: Synthetic oligonucleotide
cggacccagtttgatgattttgatatc

SEQ ID NO: 20592 - protein, 9 aa, Artificial Sequence
  Description of Artificial Sequence: Synthetic peptide
RTQFDDFDI

SEQ ID NO: 20593 - DNA, 24 bp, Artificial Sequence
  Description of Artificial Sequence: Synthetic oligonucleotide
gaactggggatgacgggtgactcc

SEQ ID NO: 20594 - protein, 8 aa, Artificial Sequence
  Description of Artificial Sequence: Synthetic peptide
ELGMTGDS

SEQ ID NO: 20595 - DNA, 36 bp, Artificial Sequence
  Description of Artificial Sequence: Synthetic oligonucleotide
agggggtatagcagtggaggctacggtatggacgtc

SEQ ID NO: 20596 - protein, 12 aa, Artificial Sequence
  Description of Artificial Sequence: Synthetic peptide
RGYSSGGYGMDV

SEQ ID NO: 20597 - DNA, 15 bp, Artificial Sequence
  Description of Artificial Sequence: Synthetic oligonucleotide
gatagggggagcctc

SEQ ID NO: 20598 - protein, 5 aa, Artificial Sequence
  Description of Artificial Sequence: Synthetic peptide
DRGSL

SEQ ID NO: 20599 - DNA, 27 bp, Artificial Sequence
  Description of Artificial Sequence: Synthetic oligonucleotide
cggactccctatgatgtctttgatatc

SEQ ID NO: 20600 - protein, 9 aa, Artificial Sequence
  Description of Artificial Sequence: Synthetic peptide
RTPYDVFDI

SEQ ID NO: 20601 - DNA, 15 bp, Artificial Sequence
  Description of Artificial Sequence: Synthetic oligonucleotide
gagtggggggactac

SEQ ID NO: 20602 - protein, 5 aa, Artificial Sequence
  Description of Artificial Sequence: Synthetic peptide
EWGDY

SEQ ID NO: 20603 - DNA, 33 bp, Artificial Sequence
  Description of Artificial Sequence: Synthetic oligonucleotide
gacgggtacggtggtaactccttctttgactac

SEQ ID NO: 20604 - protein, 11 aa, Artificial Sequence
  Description of Artificial Sequence: Synthetic peptide
DGYGGNSFFDY

SEQ ID NO: 20605 - DNA, 24 bp, Artificial Sequence
  Description of Artificial Sequence: Synthetic oligonucleotide
gaactggggatgacgggtgactcc

SEQ ID NO: 20606 - protein, 8 aa, Artificial Sequence
  Description of Artificial Sequence: Synthetic peptide
ELGMTGDS

SEQ ID NO: 20607 - DNA, 36 bp, Artificial Sequence
  Description of Artificial Sequence: Synthetic oligonucleotide
gagaggtacgatttttggagtggttgtatggacgtc

SEQ ID NO: 20608 - protein, 12 aa, Artificial Sequence
  Description of Artificial Sequence: Synthetic peptide
ERYDFWSGCMDV

SEQ ID NO: 20609 - DNA, 24 bp, Artificial Sequence
  Description of Artificial Sequence: Synthetic oligonucleotide
gaactggggatgacgggtgactcc

SEQ ID NO: 20610 - protein, 8 aa, Artificial Sequence
  Description of Artificial Sequence: Synthetic peptide
ELGMTGDS

SEQ ID NO: 20611 - DNA, 36 bp, Artificial Sequence
  Description of Artificial Sequence: Synthetic oligonucleotide
gatcgatacgatttttggagtggttattttgactac

SEQ ID NO: 20612 - protein, 12 aa, Artificial Sequence
  Description of Artificial Sequence: Synthetic peptide
DRYDFWSGYFDY

SEQ ID NO: 20613 - DNA, 24 bp, Artificial Sequence
  Description of Artificial Sequence: Synthetic oligonucleotide
gaaattggctggttagatgactac

SEQ ID NO: 20614 - protein, 8 aa, Artificial Sequence
  Description of Artificial Sequence: Synthetic peptide
EIGWLDDY

SEQ ID NO: 20615 - DNA, 42 bp, Artificial Sequence
  Description of Artificial Sequence: Synthetic oligonucleotide
ggggagctattagaggactactactactacggaatggacgtc

SEQ ID NO: 20616 - protein, 14 aa, Artificial Sequence
  Description of Artificial Sequence: Synthetic peptide
GELLEDYYYYGMDV

SEQ ID NO: 20617 - DNA, 48 bp, Artificial Sequence
  Description of Artificial Sequence: Synthetic oligonucleotide
gatagtagcaatttcagcaactggtacgattactacggtatggacgtc

SEQ ID NO: 20618 - protein, 16 aa, Artificial Sequence
  Description of Artificial Sequence: Synthetic peptide
DSSNFSNWYDYYGMDV

SEQ ID NO: 20619 - DNA, 36 bp, Artificial Sequence
  Description of Artificial Sequence: Synthetic oligonucleotide
accgctgctgggtatagcagcagctggtttgactac

SEQ ID NO: 20620 - protein, 12 aa, Artificial Sequence
  Description of Artificial Sequence: Synthetic peptide
TAAGYSSSWFDY

SEQ ID NO: 20621 - DNA, 42 bp, Artificial Sequence; identical to SEQ ID NO: 20551
  Description of Artificial Sequence: Synthetic oligonucleotide

SEQ ID NO: 20622 - protein, 14 aa, Artificial Sequence
  Description of Artificial Sequence: Synthetic peptide
EEYSSGWYDYGMDV

SEQ ID NO: 20623 - DNA, 24 bp, Artificial Sequence
  Description of Artificial Sequence: Synthetic oligonucleotide
gaactggggatgacgggtgactcc

SEQ ID NO: 20624 - protein, 8 aa, Artificial Sequence
  Description of Artificial Sequence: Synthetic peptide
ELGMTGDS

SEQ ID NO: 20625 - DNA, 36 bp, Artificial Sequence; identical to SEQ ID NO: 20619
  Description of Artificial Sequence: Synthetic oligonucleotide

SEQ ID NO: 20626 - protein, 12 aa, Artificial Sequence
  Description of Artificial Sequence: Synthetic peptide
TAAGYSSSWFDY

SEQ ID NO: 20627 - DNA, 24 bp, Artificial Sequence
  Description of Artificial Sequence: Synthetic oligonucleotide
gaactggggatgacgagtgactac

SEQ ID NO: 20628 - protein, 8 aa, Artificial Sequence
  Description of Artificial Sequence: Synthetic peptide
ELGMTSDY

SEQ ID NO: 20629 - DNA, 24 bp, Artificial Sequence
  Description of Artificial Sequence: Synthetic oligonucleotide
gaaatgggctggtacgatgactac

SEQ ID NO: 20630 - protein, 8 aa, Artificial Sequence
  Description of Artificial Sequence: Synthetic peptide
EMGWYDDY

SEQ ID NO: 20631 - DNA, 42 bp, Artificial Sequence
  Description of Artificial Sequence: Synthetic oligonucleotide
ggggagttactagaggactactactactacggaatggacgtc

SEQ ID NO: 20632 - protein, 14 aa, Artificial Sequence
  Description of Artificial Sequence: Synthetic peptide
GELLEDYYYYGMDV

SEQ ID NO: 20633 - DNA, 42 bp, Artificial Sequence; identical to SEQ ID NO: 20525
  Description of Artificial Sequence: Synthetic oligonucleotide

SEQ ID NO: 20634 - protein, 14 aa, Artificial Sequence
  Description of Artificial Sequence: Synthetic peptide
GELLEDYYFYGMDV

SEQ ID NO: 20635 - DNA, 36 bp, Artificial Sequence; identical to SEQ ID NO: 20595
  Description of Artificial Sequence: Synthetic oligonucleotide

SEQ ID NO: 20636 - protein, 12 aa, Artificial Sequence
  Description of Artificial Sequence: Synthetic peptide
RGYSSGGYGMDV

SEQ ID NO: 20637 - DNA, 18 bp, Artificial Sequence
  Description of Artificial Sequence: Synthetic oligonucleotide
aagaaggctaacgactac

SEQ ID NO: 20638 - protein, 6 aa, Artificial Sequence
  Description of Artificial Sequence: Synthetic peptide
KKANDY

SEQ ID NO: 20639 - DNA, 30 bp, Artificial Sequence
  Description of Artificial Sequence: Synthetic oligonucleotide
gaaaatagcagttcgttctactttgactac

SEQ ID NO: 20640 - protein, 10 aa, Artificial Sequence
  Description of Artificial Sequence: Synthetic peptide
ENSSSFYFDY

SEQ ID NO: 20641 - DNA, 42 bp, Artificial Sequence; identical to SEQ ID NO: 20525
  Description of Artificial Sequence: Synthetic oligonucleotide

SEQ ID NO: 20642 - protein, 14 aa, Artificial Sequence
  Description of Artificial Sequence: Synthetic peptide
GELLEDYYFYGMDV

SEQ ID NO: 20643 - DNA, 42 bp, Artificial Sequence
  Description of Artificial Sequence: Synthetic oligonucleotide
ggggagctattagaggactactacttctacggtatggacgtc

SEQ ID NO: 20644 - protein, 14 aa, Artificial Sequence
  Description of Artificial Sequence: Synthetic peptide
GELLEDYYFYGMDV

SEQ ID NO: 20645 - DNA, 24 bp, Artificial Sequence
  Description of Artificial Sequence: Synthetic oligonucleotide
gaaatgggctggtacgatgactac

SEQ ID NO: 20646 - protein, 8 aa, Artificial Sequence
  Description of Artificial Sequence: Synthetic peptide
EMGWYDDY

SEQ ID NO: 20647 - DNA, 42 bp, Artificial Sequence
  Description of Artificial Sequence: Synthetic oligonucleotide
ggggaactactagaggactactcctactacggtatcgacgtc

SEQ ID NO: 20648 - protein, 14 aa, Artificial Sequence
  Description of Artificial Sequence: Synthetic peptide
GELLEDYSYYGIDV

SEQ ID NO: 20649 - DNA, 18 bp, Artificial Sequence
  Description of Artificial Sequence: Synthetic oligonucleotide
acaaacggtatggacgtc

SEQ ID NO: 20650 - protein, 6 aa, Artificial Sequence
  Description of Artificial Sequence: Synthetic peptide
TNGMDV

SEQ ID NO: 20651 - DNA, 24 bp, Artificial Sequence
  Description of Artificial Sequence: Synthetic oligonucleotide
gacggtaccagctcctttgactac

SEQ ID NO: 20652 - protein, 8 aa, Artificial Sequence
  Description of Artificial Sequence: Synthetic peptide
DGTSSFDY

SEQ ID NO: 20653 - DNA, 18 bp, Artificial Sequence
  Description of Artificial Sequence: Synthetic oligonucleotide
ttaactggttttgactac

SEQ ID NO: 20654 - protein, 6 aa, Artificial Sequence
  Description of Artificial Sequence: Synthetic peptide
LTGFDY

SEQ ID NO: 20655 - DNA, 24 bp, Artificial Sequence
  Description of Artificial Sequence: Synthetic oligonucleotide
gatggaactgggtcctttgactac

SEQ ID NO: 20656 - protein, 8 aa, Artificial Sequence
  Description of Artificial Sequence: Synthetic peptide
DGTGSFDY

SEQ ID NO: 20657 - DNA, 24 bp, Artificial Sequence
  Description of Artificial Sequence: Synthetic oligonucleotide
gatggaactgggtcctttgactac

SEQ ID NO: 20658 - protein, 8 aa, Artificial Sequence
  Description of Artificial Sequence: Synthetic peptide
DGTGSFDY

SEQ ID NO: 20659 - DNA, 27 bp, Artificial Sequence
  Description of Artificial Sequence: Synthetic oligonucleotide
agcagtggctggtacttttttgactac

SEQ ID NO: 20660 - protein, 9 aa, Artificial Sequence
  Description of Artificial Sequence: Synthetic peptide
SSGWYFFDY

SEQ ID NO: 20661 - DNA, 18 bp, Artificial Sequence
  Description of Artificial Sequence: Synthetic oligonucleotide
acttccctctttgactac

SEQ ID NO: 20662 - protein, 6 aa, Artificial Sequence
  Description of Artificial Sequence: Synthetic peptide
TSLFDY

SEQ ID NO: 20663 - DNA, 30 bp, Artificial Sequence; identical to SEQ ID NO: 20507
  Description of Artificial Sequence: Synthetic oligonucleotide

SEQ ID NO: 20664 - protein, 10 aa, Artificial Sequence
  Description of Artificial Sequence: Synthetic peptide
ENSSSYYFDY

SEQ ID NO: 20665 - DNA, 27 bp, Artificial Sequence
  Description of Artificial Sequence: Synthetic oligonucleotide
ctgagcagcagctggtcttttgactac

SEQ ID NO: 20666 - protein, 9 aa, Artificial Sequence
  Description of Artificial Sequence: Synthetic peptide
LSSSWSFDY

SEQ ID NO: 20667 - DNA, 42 bp, Artificial Sequence
  Description of Artificial Sequence: Synthetic oligonucleotide
ggggagttagtagaggactactacttctacggtatggacgtc

SEQ ID NO: 20668 - protein, 14 aa, Artificial Sequence
  Description of Artificial Sequence: Synthetic peptide
GELVEDYYFYGMDV

SEQ ID NO: 20669 - DNA, 24 bp, Artificial Sequence
  Description of Artificial Sequence: Synthetic oligonucleotide
gatggaactgggtcctttgactac

SEQ ID NO: 20670 - protein, 8 aa, Artificial Sequence
  Description of Artificial Sequence: Synthetic peptide
DGTGSFDY

SEQ ID NO: 20671 - DNA, 30 bp, Artificial Sequence; identical to SEQ ID NO: 20507
  Description of Artificial Sequence: Synthetic oligonucleotide

SEQ ID NO: 20672 - protein, 10 aa, Artificial Sequence
  Description of Artificial Sequence: Synthetic peptide
ENSSSYYFDY

SEQ ID NO: 20673 - DNA, 42 bp, Artificial Sequence
  Description of Artificial Sequence: Synthetic oligonucleotide
ggggagctacttgaggactactacttctacggtatggacgtc

SEQ ID NO: 20674 - protein, 14 aa, Artificial Sequence
  Description of Artificial Sequence: Synthetic peptide
GELLEDYYFYGMDV

SEQ ID NO: 20675 - DNA, 42 bp, Artificial Sequence
  Description of Artificial Sequence: Synthetic oligonucleotide
ggggaactactagaggactactacttctacggtatggacgtc

SEQ ID NO: 20676 - protein, 14 aa, Artificial Sequence
  Description of Artificial Sequence: Synthetic peptide
GELLEDYYFYGMDV

SEQ ID NO: 20677 - DNA, 42 bp, Artificial Sequence
  Description of Artificial Sequence: Synthetic oligonucleotide
ggggagctactagaggactactactacttcgctatggacgtc

SEQ ID NO: 20678 - protein, 14 aa, Artificial Sequence
  Description of Artificial Sequence: Synthetic peptide
GELLEDYYYFAMDV

SEQ ID NO: 20679 - DNA, 48 bp, Artificial Sequence
  Description of Artificial Sequence: Synthetic oligonucleotide
gatattagtaatttcagcagctggtacgattactacgctatggacgtc

SEQ ID NO: 20680 - protein, 16 aa, Artificial Sequence
  Description of Artificial Sequence: Synthetic peptide
DISNFSSWYDYYAMDV

SEQ ID NO: 20681 - DNA, 42 bp, Artificial Sequence; identical to SEQ ID NO: 20525
  Description of Artificial Sequence: Synthetic oligonucleotide

SEQ ID NO: 20682 - protein, 14 aa, Artificial Sequence
  Description of Artificial Sequence: Synthetic peptide
GELLEDYYFYGMDV

SEQ ID NO: 20683 - DNA, 24 bp, Artificial Sequence
  Description of Artificial Sequence: Synthetic oligonucleotide
gatggaactgggtcctttgactac

SEQ ID NO: 20684 - protein, 8 aa, Artificial Sequence
  Description of Artificial Sequence: Synthetic peptide
DGTGSFDY

SEQ ID NO: 20685 - DNA, 33 bp, Artificial Sequence
  Description of Artificial Sequence: Synthetic oligonucleotide
gatcgggtgagagctcatgatggttttgatatc

SEQ ID NO: 20686 - protein, 11 aa, Artificial Sequence
  Description of Artificial Sequence: Synthetic peptide
DRVRAHDGFDI

SEQ ID NO: 20687 - DNA, 24 bp, Artificial Sequence
  Description of Artificial Sequence: Synthetic oligonucleotide
gatggaactgggtcctttgactac

SEQ ID NO: 20688 - protein, 8 aa, Artificial Sequence
  Description of Artificial Sequence: Synthetic peptide
DGTGSFDY

SEQ ID NO: 20689 - DNA, 42 bp, Artificial Sequence
  Description of Artificial Sequence: Synthetic oligonucleotide
ggggagctactagaggactactactactacggtatggacgtc

SEQ ID NO: 20690 - protein, 14 aa, Artificial Sequence
  Description of Artificial Sequence: Synthetic peptide
GELLEDYYYYGMDV

SEQ ID NO: 20691 - DNA, 18 bp, Artificial Sequence
  Description of Artificial Sequence: Synthetic oligonucleotide
gtctctggctttgactac

SEQ ID NO: 20692 - protein, 6 aa, Artificial Sequence
  Description of Artificial Sequence: Synthetic peptide
VSGFDY

SEQ ID NO: 20693 - DNA, 30 bp, Artificial Sequence; identical to SEQ ID NO: 20507
  Description of Artificial Sequence: Synthetic oligonucleotide

SEQ ID NO: 20694 - protein, 10 aa, Artificial Sequence
  Description of Artificial Sequence: Synthetic peptide
ENSSSYYFDY

SEQ ID NO: 20695 - DNA, 42 bp, Artificial Sequence
  Description of Artificial Sequence: Synthetic oligonucleotide
ggggagctactagaggactactcctactacggtatggacgtc

SEQ ID NO: 20696 - protein, 14 aa, Artificial Sequence
  Description of Artificial Sequence: Synthetic peptide
GELLEDYSYYGMDV

SEQ ID NO: 20697 - DNA, 42 bp, Artificial Sequence
  Description of Artificial Sequence: Synthetic oligonucleotide
ggggagttactagaggactactacttctacggtatggacgtc

SEQ ID NO: 20698 - protein, 14 aa, Artificial Sequence
  Description of Artificial Sequence: Synthetic peptide
GELLEDYYFYGMDV

SEQ ID NO: 20699 - DNA, 42 bp, Artificial Sequence; identical to SEQ ID NO: 20525
  Description of Artificial Sequence: Synthetic oligonucleotide

SEQ ID NO: 20700 - protein, 14 aa, Artificial Sequence
  Description of Artificial Sequence: Synthetic peptide
GELLEDYYFYGMDV

SEQ ID NO: 20701 - DNA, 15 bp, Artificial Sequence
  Description of Artificial Sequence: Synthetic oligonucleotide
gatcggggggggacc

SEQ ID NO: 20702 - protein, 5 aa, Artificial Sequence
  Description of Artificial Sequence: Synthetic peptide
DRGGT

SEQ ID NO: 20703 - DNA, 24 bp, Artificial Sequence
  Description of Artificial Sequence: Synthetic oligonucleotide
gatggaactgggtcctttgactac

SEQ ID NO: 20704 - protein, 8 aa, Artificial Sequence
  Description of Artificial Sequence: Synthetic peptide
DGTGSFDY

SEQ ID NO: 20705 - DNA, 30 bp, Artificial Sequence; identical to SEQ ID NO: 20507
  Description of Artificial Sequence: Synthetic oligonucleotide

SEQ ID NO: 20706 - protein, 10 aa, Artificial Sequence
  Description of Artificial Sequence: Synthetic peptide
ENSSSYYFDY

SEQ ID NO: 20707 - DNA, 30 bp, Artificial Sequence; identical to SEQ ID NO: 20507
  Description of Artificial Sequence: Synthetic oligonucleotide

SEQ ID NO: 20708 - protein, 10 aa, Artificial Sequence
  Description of Artificial Sequence: Synthetic peptide
ENSSSYYFDY

SEQ ID NO: 20709 - DNA, 36 bp, Artificial Sequence; identical to SEQ ID NO: 20595
  Description of Artificial Sequence: Synthetic oligonucleotide

SEQ ID NO: 20710 - protein, 12 aa, Artificial Sequence
  Description of Artificial Sequence: Synthetic peptide
RGYSSGGYGMDV

SEQ ID NO: 20711 - DNA, 24 bp, Artificial Sequence
  Description of Artificial Sequence: Synthetic oligonucleotide
gatggaactgggtcctttgactac

SEQ ID NO: 20712 - protein, 8 aa, Artificial Sequence
  Description of Artificial Sequence: Synthetic peptide
DGTGSFDY

SEQ ID NO: 20713 - DNA, 18 bp, Artificial Sequence
  Description of Artificial Sequence: Synthetic oligonucleotide
acaaacggtatggacgtc

SEQ ID NO: 20714 - protein, 6 aa, Artificial Sequence
  Description of Artificial Sequence: Synthetic peptide
TNGMDV

SEQ ID NO: 20715 - DNA, 27 bp, Artificial Sequence
  Description of Artificial Sequence: Synthetic oligonucleotide
agcagtggctggtacttttttgactac

SEQ ID NO: 20716 - protein, 9 aa, Artificial Sequence
  Description of Artificial Sequence: Synthetic peptide
SSGWYFFDY

SEQ ID NO: 20717 - DNA, 42 bp, Artificial Sequence; identical to SEQ ID NO: 20525
  Description of Artificial Sequence: Synthetic oligonucleotide

SEQ ID NO: 20718 - protein, 14 aa, Artificial Sequence
  Description of Artificial Sequence: Synthetic peptide
GELLEDYYFYGMDV

SEQ ID NO: 20719 - DNA, 18 bp, Artificial Sequence
  Description of Artificial Sequence: Synthetic oligonucleotide
aagaagtctaacgactac

SEQ ID NO: 20720 - protein, 6 aa, Artificial Sequence
  Description of Artificial Sequence: Synthetic peptide
KKSNDY

SEQ ID NO: 20721 - DNA, 42 bp, Artificial Sequence
  Description of Artificial Sequence: Synthetic oligonucleotide
ggggagctactagaggactactactactacgctatggacgtc

SEQ ID NO: 20722 - protein, 14 aa, Artificial Sequence
  Description of Artificial Sequence: Synthetic peptide
GELLEDYYYYAMDV

SEQ ID NO: 20723 - DNA, 27 bp, Artificial Sequence
  Description of Artificial Sequence: Synthetic oligonucleotide
gattcctccccctacggtatggacgtc

SEQ ID NO: 20724 - protein, 9 aa, Artificial Sequence
  Description of Artificial Sequence: Synthetic peptide
DSSPYGMDV

SEQ ID NO: 20725 - DNA, 63 bp, Artificial Sequence; identical to SEQ ID NO: 20223
  Description of Artificial Sequence: Synthetic oligonucleotide

SEQ ID NO: 20726 - protein, 21 aa, Artificial Sequence
  Description of Artificial Sequence: Synthetic peptide
DRVYCSSTSCSPYYYYYGMDV

SEQ ID NO: 20727 - DNA, 45 bp, Artificial Sequence
  Description of Artificial Sequence: Synthetic oligonucleotide
gggttttactatggttcggggagttattataacgacctcgacccc

SEQ ID NO: 20728 - protein, 15 aa, Artificial Sequence
  Description of Artificial Sequence: Synthetic peptide
GFYYGSGSYYNDLDP

SEQ ID NO: 20729 - DNA, 42 bp, Artificial Sequence
  Description of Artificial Sequence: Synthetic oligonucleotide
gatcggagggggggctatggagtccccgatgcttttgatatc

SEQ ID NO: 20730 - protein, 14 aa, Artificial Sequence
  Description of Artificial Sequence: Synthetic peptide
DRRGGYGVPDAFDI

SEQ ID NO: 20731 - DNA, 63 bp, Artificial Sequence
  Description of Artificial Sequence: Synthetic oligonucleotide
gatcgggtctattgtagtagtaccagctgcgtcccttactacgactactacggtatggacgtc

SEQ ID NO: 20732 - protein, 21 aa, Artificial Sequence
  Description of Artificial Sequence: Synthetic peptide
DRVYCSSTSCVPYYDYYGMDV

SEQ ID NO: 20733 - DNA, 60 bp, Artificial Sequence
  Description of Artificial Sequence: Synthetic oligonucleotide
gaggattcctattgtagtagtaccagctgcccttactactactactacggtatggacgtc

SEQ ID NO: 20734 - protein, 20 aa, Artificial Sequence
  Description of Artificial Sequence: Synthetic peptide
EDSYCSSTSCPYYYYYGMDV

SEQ ID NO: 20735 - DNA, 45 bp, Artificial Sequence
  Description of Artificial Sequence: Synthetic oligonucleotide
gggtattactatggttcggggagttattataacgacctcgacccc

SEQ ID NO: 20736 - protein, 15 aa, Artificial Sequence
  Description of Artificial Sequence: Synthetic peptide
GYYYGSGSYYNDLDP

SEQ ID NO: 20737 - DNA, 45 bp, Artificial Sequence
  Description of Artificial Sequence: Synthetic oligonucleotide
tggggacgtggatacagctatgagtactactacggtatggacgtc

SEQ ID NO: 20738 - protein, 15 aa, Artificial Sequence
  Description of Artificial Sequence: Synthetic peptide
WGRGYSYEYYYGMDV

SEQ ID NO: 20739 - DNA, 45 bp, Artificial Sequence
  Description of Artificial Sequence: Synthetic oligonucleotide
tcctattactatggttcggggagttattataacgagtttgactac

SEQ ID NO: 20740 - protein, 15 aa, Artificial Sequence
  Description of Artificial Sequence: Synthetic peptide
SYYYGSGSYYNEFDY

SEQ ID NO: 20741 - DNA, 24 bp, Artificial Sequence
  Description of Artificial Sequence: Synthetic oligonucleotide
atagtagcagttgcctttgactac

SEQ ID NO: 20742 - protein, 8 aa, Artificial Sequence
  Description of Artificial Sequence: Synthetic peptide
IVAVAFDY

SEQ ID NO: 20743 - DNA, 60 bp, Artificial Sequence
  Description of Artificial Sequence: Synthetic oligonucleotide
gagaggtgtagtactaccagttgctatttaggaattacgggctactacggtatggacgtc

SEQ ID NO: 20744 - protein, 20 aa, Artificial Sequence
  Description of Artificial Sequence: Synthetic peptide
ERCSTTSCYLGITGYYGMDV

SEQ ID NO: 20745 - DNA, 24 bp, Artificial Sequence
  Description of Artificial Sequence: Synthetic oligonucleotide
ttaatagcagtgacttttgactcc

SEQ ID NO: 20746 - protein, 8 aa, Artificial Sequence
  Description of Artificial Sequence: Synthetic peptide
LIAVTFDS

SEQ ID NO: 20747 - DNA, 51 bp, Artificial Sequence
  Description of Artificial Sequence: Synthetic oligonucleotide
gatcgggtagcagcagctggtaccccctactactactacggtatggacgtc

SEQ ID NO: 20748 - protein, 17 aa, Artificial Sequence
  Description of Artificial Sequence: Synthetic peptide
DRVAAAGTPYYYYGMDV

SEQ ID NO: 20749 - DNA, 57 bp, Artificial Sequence
  Description of Artificial Sequence: Synthetic oligonucleotide
gatacgggtcctatagcagctcgtctcgcttactactactactacgctatggacgtc

SEQ ID NO: 20750 - protein, 19 aa, Artificial Sequence
  Description of Artificial Sequence: Synthetic peptide
DTGPIAARLAYYYYYAMDV

SEQ ID NO: 20751 - DNA, 57 bp, Artificial Sequence
  Description of Artificial Sequence: Synthetic oligonucleotide
gaatattgtggtggtgactgctattccccttactactactactacggtatggacgtc

SEQ ID NO: 20752 - protein, 19 aa, Artificial Sequence
  Description of Artificial Sequence: Synthetic peptide
EYCGGDCYSPYYYYYGMDV

SEQ ID NO: 20753 - DNA, 63 bp, Artificial Sequence; identical to SEQ ID NO: 20223
  Description of Artificial Sequence: Synthetic oligonucleotide

SEQ ID NO: 20754 - protein, 21 aa, Artificial Sequence
  Description of Artificial Sequence: Synthetic peptide
DRVYCSSTSCSPYYYYYGMDV

SEQ ID NO: 20755 - DNA, 45 bp, Artificial Sequence
  Description of Artificial Sequence: Synthetic oligonucleotide
gtgtattaccatggttcggggagttattataacgagtttgattat

SEQ ID NO: 20756 - protein, 15 aa, Artificial Sequence
  Description of Artificial Sequence: Synthetic peptide
VYYHGSGSYYNEFDY

SEQ ID NO: 20757 - DNA, 57 bp, Artificial Sequence; identical to SEQ ID NO: 20751
  Description of Artificial Sequence: Synthetic oligonucleotide

SEQ ID NO: 20758 - protein, 19 aa, Artificial Sequence
  Description of Artificial Sequence: Synthetic peptide
EYCGGDCYSPYYYYYGMDV

SEQ ID NO: 20759 - DNA, 63 bp, Artificial Sequence
  Description of Artificial Sequence: Synthetic oligonucleotide
gatcgggtatcttgtagtagttccagctgctatccttactactactactacggtatggacgtc

SEQ ID NO: 20760 - protein, 21 aa, Artificial Sequence
  Description of Artificial Sequence: Synthetic peptide
DRVSCSSSSCYPYYYYYGMDV

SEQ ID NO: 20761 - DNA, 45 bp, Artificial Sequence
  Description of Artificial Sequence: Synthetic oligonucleotide
tcgttttactatggttcggggacttattataacgagtttgactac

SEQ ID NO: 20762 - protein, 15 aa, Artificial Sequence
  Description of Artificial Sequence: Synthetic peptide
SFYYGSGTYYNEFDY

SEQ ID NO: 20763 - DNA, 45 bp, Artificial Sequence
  Description of Artificial Sequence: Synthetic oligonucleotide
tcgtattactatggttcggggacttattataacgagtttgactac

SEQ ID NO: 20764 - protein, 15 aa, Artificial Sequence
  Description of Artificial Sequence: Synthetic peptide
SYYYGSGTYYNEFDY

SEQ ID NO: 20765 - DNA, 45 bp, Artificial Sequence
  Description of Artificial Sequence: Synthetic oligonucleotide
gcgaattactatggttcggggagttattataacgactttgactac

SEQ ID NO: 20766 - protein, 15 aa, Artificial Sequence
  Description of Artificial Sequence: Synthetic peptide
ANYYGSGSYYNDFDY

SEQ ID NO: 20767 - DNA, 24 bp, Artificial Sequence
  Description of Artificial Sequence: Synthetic oligonucleotide
ttaatagcagtggcttttgactat

SEQ ID NO: 20768 - protein, 8 aa, Artificial Sequence
  Description of Artificial Sequence: Synthetic peptide
LIAVAFDY

SEQ ID NO: 20769 - DNA, 45 bp, Artificial Sequence
  Description of Artificial Sequence: Synthetic oligonucleotide
ggatattattatgcttcggggagttattataacgacctcgacccc

SEQ ID NO: 20770 - protein, 15 aa, Artificial Sequence
  Description of Artificial Sequence: Synthetic peptide
GYYYASGSYYNDLDP

SEQ ID NO: 20771 - DNA, 45 bp, Artificial Sequence
  Description of Artificial Sequence: Synthetic oligonucleotide
tcgtatttttatggttcggggagttattataacgagtttgactac

SEQ ID NO: 20772 - protein, 15 aa, Artificial Sequence
  Description of Artificial Sequence: Synthetic peptide
SYFYGSGSYYNEFDY

SEQ ID NO: 20773 - DNA, 24 bp, Artificial Sequence
  Description of Artificial Sequence: Synthetic oligonucleotide
attatagcagtggcttttgactac

SEQ ID NO: 20774 - protein, 8 aa, Artificial Sequence
  Description of Artificial Sequence: Synthetic peptide
IIAVAFDY

SEQ ID NO: 20775 - DNA, 24 bp, Artificial Sequence
  Description of Artificial Sequence: Synthetic oligonucleotide
ttaatagcagtttcctttgactac

SEQ ID NO: 20776 - protein, 8 aa, Artificial Sequence
  Description of Artificial Sequence: Synthetic peptide
LIAVSFDY

SEQ ID NO: 20777 - DNA, 45 bp, Artificial Sequence
  Description of Artificial Sequence: Synthetic oligonucleotide
gtgtattactatggttcggggagttattataacgagtttgactac

SEQ ID NO: 20778 - protein, 15 aa, Artificial Sequence
  Description of Artificial Sequence: Synthetic peptide
VYYYGSGSYYNEFDY

SEQ ID NO: 20779 - DNA, 45 bp, Artificial Sequence; identical to SEQ ID NO: 20763
  Description of Artificial Sequence: Synthetic oligonucleotide

SEQ ID NO: 20780 - protein, 15 aa, Artificial Sequence
  Description of Artificial Sequence: Synthetic peptide
SYYYGSGTYYNEFDY

SEQ ID NO: 20781 - DNA, 45 bp, Artificial Sequence
  Description of Artificial Sequence: Synthetic oligonucleotide
tggggacgtggatacaactatgagtactactacggtatggacgtc

SEQ ID NO: 20782 - protein, 15 aa, Artificial Sequence
  Description of Artificial Sequence: Synthetic peptide
WGRGYNYEYYYGMDV

SEQ ID NO: 20783 - DNA, 60 bp, Artificial Sequence
  Description of Artificial Sequence: Synthetic oligonucleotide
gagaggtgtagtactaccagctgctatttaggaattacgggctactacggtatggacgtc

SEQ ID NO: 20784 - protein, 20 aa, Artificial Sequence
  Description of Artificial Sequence: Synthetic peptide
ERCSTTSCYLGITGYYGMDV

SEQ ID NO: 20785 - DNA, 57 bp, Artificial Sequence; identical to SEQ ID NO: 20751
  Description of Artificial Sequence: Synthetic oligonucleotide

SEQ ID NO: 20786 - protein, 19 aa, Artificial Sequence
  Description of Artificial Sequence: Synthetic peptide
EYCGGDCYSPYYYYYGMDV

SEQ ID NO: 20787 - DNA, 27 bp, Artificial Sequence
  Description of Artificial Sequence: Synthetic oligonucleotide
agcagtggctggtactactttgactac

SEQ ID NO: 20788 - protein, 9 aa, Artificial Sequence
  Description of Artificial Sequence: Synthetic peptide
SSGWYYFDY

SEQ ID NO: 20789 - DNA, 45 bp, Artificial Sequence
  Description of Artificial Sequence: Synthetic oligonucleotide
gtgtatttctatggttcggggagttattataacgagtttgactac

SEQ ID NO: 20790 - protein, 15 aa, Artificial Sequence
  Description of Artificial Sequence: Synthetic peptide
VYFYGSGSYYNEFDY

SEQ ID NO: 20791 - DNA, 21 bp, Artificial Sequence
  Description of Artificial Sequence: Synthetic oligonucleotide
gaaggctggaacacggactac

SEQ ID NO: 20792 - protein, 7 aa, Artificial Sequence
  Description of Artificial Sequence: Synthetic peptide
EGWNTDY

SEQ ID NO: 20793 - DNA, 27 bp, Artificial Sequence
  Description of Artificial Sequence: Synthetic oligonucleotide
catggaaaagactggggccttgactac

SEQ ID NO: 20794 - protein, 9 aa, Artificial Sequence
  Description of Artificial Sequence: Synthetic peptide
HGKDWGLDY

SEQ ID NO: 20795 - DNA, 27 bp, Artificial Sequence
  Description of Artificial Sequence: Synthetic oligonucleotide
cacagcagcagctggtctcttgactac

SEQ ID NO: 20796 - protein, 9 aa, Artificial Sequence
  Description of Artificial Sequence: Synthetic peptide
HSSSWSLDY

SEQ ID NO: 20797 - DNA, 27 bp, Artificial Sequence
  Description of Artificial Sequence: Synthetic oligonucleotide
gggagcagctcgtccgggtttgactac

SEQ ID NO: 20798 - protein, 9 aa, Artificial Sequence
  Description of Artificial Sequence: Synthetic peptide
GSSSSGFDY

SEQ ID NO: 20799 - DNA, 36 bp, Artificial Sequence
  Description of Artificial Sequence: Synthetic oligonucleotide
ctggggaaagactactactactacggtatggacgtc

SEQ ID NO: 20800 - protein, 12 aa, Artificial Sequence
  Description of Artificial Sequence: Synthetic peptide
LGKDYYYYGMDV

SEQ ID NO: 20801 - DNA, 24 bp, Artificial Sequence
  Description of Artificial Sequence: Synthetic oligonucleotide
gatcttggctggacggaagagtac

SEQ ID NO: 20802 - protein, 8 aa, Artificial Sequence
  Description of Artificial Sequence: Synthetic peptide
DLGWTEEY

SEQ ID NO: 20803 - DNA, 27 bp, Artificial Sequence
  Description of Artificial Sequence: Synthetic oligonucleotide
catagcggcagctggtcccttgactac

SEQ ID NO: 20804 - protein, 9 aa, Artificial Sequence
  Description of Artificial Sequence: Synthetic peptide
HSGSWSLDY

SEQ ID NO: 20805 - DNA, 27 bp, Artificial Sequence
  Description of Artificial Sequence: Synthetic oligonucleotide
cacagcagcagctggtctcttgactgc

SEQ ID NO: 20806 - protein, 9 aa, Artificial Sequence
  Description of Artificial Sequence: Synthetic peptide
HSSSWSLDC

SEQ ID NO: 20807 - DNA, 24 bp, Artificial Sequence
  Description of Artificial Sequence: Synthetic oligonucleotide
gaactggggttccggtctgactac

SEQ ID NO: 20808 - protein, 8 aa, Artificial Sequence
  Description of Artificial Sequence: Synthetic peptide
ELGFRSDY

SEQ ID NO: 20809 - DNA, 24 bp, Artificial Sequence
  Description of Artificial Sequence: Synthetic oligonucleotide
gagctggggttccggtctgactac

SEQ ID NO: 20810 - protein, 8 aa, Artificial Sequence
  Description of Artificial Sequence: Synthetic peptide
ELGFRSDY

SEQ ID NO: 20811 - DNA, 24 bp, Artificial Sequence
  Description of Artificial Sequence: Synthetic oligonucleotide
gaagtgggattcactgaggactac

SEQ ID NO: 20812 - protein, 8 aa, Artificial Sequence
  Description of Artificial Sequence: Synthetic peptide
EVGFTEDY

SEQ ID NO: 20813 - DNA, 36 bp, Artificial Sequence
  Description of Artificial Sequence: Synthetic oligonucleotide
cgtgtagcagtggctggctcggaggcttttgctatc

SEQ ID NO: 20814 - protein, 12 aa, Artificial Sequence
  Description of Artificial Sequence: Synthetic peptide
RVAVAGSEAFAI

SEQ ID NO: 20815 - DNA, 24 bp, Artificial Sequence
  Description of Artificial Sequence: Synthetic oligonucleotide
gaactggggttccggtctgactac

SEQ ID NO: 20816 - protein, 8 aa, Artificial Sequence
  Description of Artificial Sequence: Synthetic peptide
ELGFRSDY

SEQ ID NO: 20817 - DNA, 24 bp, Artificial Sequence
  Description of Artificial Sequence: Synthetic oligonucleotide
gaactggggttccggtctgactac

SEQ ID NO: 20818 - protein, 8 aa, Artificial Sequence
  Description of Artificial Sequence: Synthetic peptide
ELGFRSDY

SEQ ID NO: 20819 - DNA, 24 bp, Artificial Sequence
  Description of Artificial Sequence: Synthetic oligonucleotide
gaactggggttccggtctgactac

SEQ ID NO: 20820 - protein, 8 aa, Artificial Sequence
  Description of Artificial Sequence: Synthetic peptide
ELGFRSDY

SEQ ID NO: 20821 - DNA, 27 bp, Artificial Sequence
  Description of Artificial Sequence: Synthetic oligonucleotide
catggaaaagactggggccttgactac

SEQ ID NO: 20822 - protein, 9 aa, Artificial Sequence
  Description of Artificial Sequence: Synthetic peptide
HGKDWGLDY

SEQ ID NO: 20823 - DNA, 18 bp, Artificial Sequence
  Description of Artificial Sequence: Synthetic oligonucleotide
gtggcttcatttgactac

SEQ ID NO: 20824 - protein, 6 aa, Artificial Sequence
  Description of Artificial Sequence: Synthetic peptide
VASFDY

SEQ ID NO: 20825 - DNA, 24 bp, Artificial Sequence
  Description of Artificial Sequence: Synthetic oligonucleotide
gatcttggctggacggaagagtac

SEQ ID NO: 20826 - protein, 8 aa, Artificial Sequence
  Description of Artificial Sequence: Synthetic peptide
DLGWTEEY

SEQ ID NO: 20827 - DNA, 27 bp, Artificial Sequence
  Description of Artificial Sequence: Synthetic oligonucleotide
gatctgagtatgggcggtatggacgtc

SEQ ID NO: 20828 - protein, 9 aa, Artificial Sequence
  Description of Artificial Sequence: Synthetic peptide
DLSMGGMDV

SEQ ID NO: 20829 - DNA, 27 bp, Artificial Sequence
  Description of Artificial Sequence: Synthetic oligonucleotide
gatgagaggctggggatttttgactac

SEQ ID NO: 20830 - protein, 9 aa, Artificial Sequence
  Description of Artificial Sequence: Synthetic peptide
DERLGIFDY

SEQ ID NO: 20831 - DNA, 36 bp, Artificial Sequence; identical to SEQ ID NO: 20357
  Description of Artificial Sequence: Synthetic oligonucleotide

SEQ ID NO: 20832 - protein, 12 aa, Artificial Sequence
  Description of Artificial Sequence: Synthetic peptide
RLAVAGSEAFDI

SEQ ID NO: 20833 - DNA, 27 bp, Artificial Sequence
  Description of Artificial Sequence: Synthetic oligonucleotide
gacgagaggctggggatttttgactac

SEQ ID NO: 20834 - protein, 9 aa, Artificial Sequence
  Description of Artificial Sequence: Synthetic peptide
DERLGIFDY

SEQ ID NO: 20835 - DNA, 24 bp, Artificial Sequence
  Description of Artificial Sequence: Synthetic oligonucleotide
gaactggggttccggtctgactac

SEQ ID NO: 20836 - protein, 8 aa, Artificial Sequence
  Description of Artificial Sequence: Synthetic peptide
ELGFRSDY

SEQ ID NO: 20837 - DNA, 24 bp, Artificial Sequence
  Description of Artificial Sequence: Synthetic oligonucleotide
gaagtgggattccggtctgactac

SEQ ID NO: 20838 - protein, 8 aa, Artificial Sequence
  Description of Artificial Sequence: Synthetic peptide
EVGFRSDY

SEQ ID NO: 20839 - DNA, 36 bp, Artificial Sequence; identical to SEQ ID NO: 20301
  Description of Artificial Sequence: Synthetic oligonucleotide

SEQ ID NO: 20840 - protein, 12 aa, Artificial Sequence
  Description of Artificial Sequence: Synthetic peptide
RIAVAGSEAFDI

SEQ ID NO: 20841 - DNA, 42 bp, Artificial Sequence
  Description of Artificial Sequence: Synthetic oligonucleotide
gaaaagtataccagcagctggtacgactacggtatggacgtc

SEQ ID NO: 20842 - protein, 14 aa, Artificial Sequence
  Description of Artificial Sequence: Synthetic peptide
EKYTSSWYDYGMDV

SEQ ID NO: 20843 - DNA, 24 bp, Artificial Sequence
  Description of Artificial Sequence: Synthetic oligonucleotide
gagctggggttccggtctgactac

SEQ ID NO: 20844 - protein, 8 aa, Artificial Sequence
  Description of Artificial Sequence: Synthetic peptide
ELGFRSDY

SEQ ID NO: 20845 - DNA, 27 bp, Artificial Sequence
  Description of Artificial Sequence: Synthetic oligonucleotide
gacgagaggctggggatttttgactac

SEQ ID NO: 20846 - protein, 9 aa, Artificial Sequence
  Description of Artificial Sequence: Synthetic peptide
DERLGIFDY

SEQ ID NO: 20847 - DNA, 15 bp, Artificial Sequence
  Description of Artificial Sequence: Synthetic oligonucleotide
gatcggggcagcgtc

SEQ ID NO: 20848 - protein, 5 aa, Artificial Sequence
  Description of Artificial Sequence: Synthetic peptide
DRGSV

SEQ ID NO: 20849 - DNA, 27 bp, Artificial Sequence
  Description of Artificial Sequence: Synthetic oligonucleotide
catggaaaagactggggccttgaagac

SEQ ID NO: 20850 - protein, 9 aa, Artificial Sequence
  Description of Artificial Sequence: Synthetic peptide
HGKDWGLED

SEQ ID NO: 20851 - DNA, 24 bp, Artificial Sequence
  Description of Artificial Sequence: Synthetic oligonucleotide
gaaatggggttcctgtctgactac

SEQ ID NO: 20852 - protein, 8 aa, Artificial Sequence
  Description of Artificial Sequence: Synthetic peptide
EMGFLSDY

SEQ ID NO: 20853 - DNA, 24 bp, Artificial Sequence
  Description of Artificial Sequence: Synthetic oligonucleotide
gatcttggctggacggaagagtac

SEQ ID NO: 20854 - protein, 8 aa, Artificial Sequence
  Description of Artificial Sequence: Synthetic peptide
DLGWTEEY

SEQ ID NO: 20855 - DNA, 36 bp, Artificial Sequence; identical to SEQ ID NO: 20335
  Description of Artificial Sequence: Synthetic oligonucleotide

SEQ ID NO: 20856 - protein, 12 aa, Artificial Sequence
  Description of Artificial Sequence: Synthetic peptide
RYTSDWHDAFDI

SEQ ID NO: 20857 - DNA, 27 bp, Artificial Sequence
  Description of Artificial Sequence: Synthetic oligonucleotide
ctgagcagcagctggtcttttgactac

SEQ ID NO: 20858 - protein, 9 aa, Artificial Sequence
  Description of Artificial Sequence: Synthetic peptide
LSSSWSFDY

SEQ ID NO: 20859 - DNA, 24 bp, Artificial Sequence
  Description of Artificial Sequence: Synthetic oligonucleotide
gagctggggttcctctctgactac

SEQ ID NO: 20860 - protein, 8 aa, Artificial Sequence
  Description of Artificial Sequence: Synthetic peptide
ELGFLSDY

SEQ ID NO: 20861 - DNA, 24 bp, Artificial Sequence
  Description of Artificial Sequence: Synthetic oligonucleotide
gagctggggttcctctctgactac

SEQ ID NO: 20862 - protein, 8 aa, Artificial Sequence
  Description of Artificial Sequence: Synthetic peptide
ELGFLSDY

SEQ ID NO: 20863 - DNA, 27 bp, Artificial Sequence
  Description of Artificial Sequence: Synthetic oligonucleotide
ctaagcagcaactgggactttgacaac

SEQ ID NO: 20864 - protein, 9 aa, Artificial Sequence
  Description of Artificial Sequence: Synthetic peptide
LSSNWDFDN

SEQ ID NO: 20865 - DNA, 36 bp, Artificial Sequence; identical to SEQ ID NO: 20357
  Description of Artificial Sequence: Synthetic oligonucleotide

SEQ ID NO: 20866 - protein, 12 aa, Artificial Sequence
  Description of Artificial Sequence: Synthetic peptide
RLAVAGSEAFDI

SEQ ID NO: 20867 - DNA, 36 bp, Artificial Sequence
  Description of Artificial Sequence: Synthetic oligonucleotide
gatttgaagagcagtggctgccttttctttgactac

SEQ ID NO: 20868 - protein, 12 aa, Artificial Sequence
  Description of Artificial Sequence: Synthetic peptide
DLKSSGCLFFDY

SEQ ID NO: 20869 - DNA, 36 bp, Artificial Sequence
  Description of Artificial Sequence: Synthetic oligonucleotide
cggggaaacagctatggcgggtacggtatggacgtc

SEQ ID NO: 20870 - protein, 12 aa, Artificial Sequence
  Description of Artificial Sequence: Synthetic peptide
RGNSYGGYGMDV

SEQ ID NO: 20871 - DNA, 18 bp, Artificial Sequence
  Description of Artificial Sequence: Synthetic oligonucleotide
gtggcttcatttgactac

SEQ ID NO: 20872 - protein, 6 aa, Artificial Sequence
  Description of Artificial Sequence: Synthetic peptide
VASFDY

SEQ ID NO: 20873 - DNA, 18 bp, Artificial Sequence
  Description of Artificial Sequence: Synthetic oligonucleotide
gtggcttcatttgactac

SEQ ID NO: 20874 - protein, 6 aa, Artificial Sequence
  Description of Artificial Sequence: Synthetic peptide
VASFDY

SEQ ID NO: 20875 - DNA, 36 bp, Artificial Sequence
  Description of Artificial Sequence: Synthetic oligonucleotide
cgtatagcagtggctggctcggaggcttttgctatc

SEQ ID NO: 20876 - protein, 12 aa, Artificial Sequence
  Description of Artificial Sequence: Synthetic peptide
RIAVAGSEAFAI

SEQ ID NO: 20877 - DNA, 27 bp, Artificial Sequence
  Description of Artificial Sequence: Synthetic oligonucleotide
gatgagaggctggggatttttgactac

SEQ ID NO: 20878 - protein, 9 aa, Artificial Sequence
  Description of Artificial Sequence: Synthetic peptide
DERLGIFDY

SEQ ID NO: 20879 - DNA, 42 bp, Artificial Sequence; identical to SEQ ID NO: 20341
  Description of Artificial Sequence: Synthetic oligonucleotide

SEQ ID NO: 20880 - protein, 14 aa, Artificial Sequence
  Description of Artificial Sequence: Synthetic peptide
EKYSSSWYDYGMDV

SEQ ID NO: 20881 - DNA, 30 bp, Artificial Sequence
  Description of Artificial Sequence: Synthetic oligonucleotide
gatcgggcctatagcagctcgtctgacttc

SEQ ID NO: 20882 - protein, 10 aa, Artificial Sequence
  Description of Artificial Sequence: Synthetic peptide
DRAYSSSSDF

SEQ ID NO: 20883 - DNA, 15 bp, Artificial Sequence
  Description of Artificial Sequence: Synthetic oligonucleotide
gatcggggcagtggc

SEQ ID NO: 20884 - protein, 5 aa, Artificial Sequence
  Description of Artificial Sequence: Synthetic peptide
DRGSG

SEQ ID NO: 20885 - DNA, 42 bp, Artificial Sequence; identical to SEQ ID NO: 20247
  Description of Artificial Sequence: Synthetic oligonucleotide

SEQ ID NO: 20886 - protein, 14 aa, Artificial Sequence
  Description of Artificial Sequence: Synthetic peptide
EKYSSSWYDYGMDV

SEQ ID NO: 20887 - DNA, 36 bp, Artificial Sequence; identical to SEQ ID NO: 20457
  Description of Artificial Sequence: Synthetic oligonucleotide

SEQ ID NO: 20888 - protein, 12 aa, Artificial Sequence
  Description of Artificial Sequence: Synthetic peptide
RGYSYGGYGMDV

SEQ ID NO: 20889 - DNA, 24 bp, Artificial Sequence
  Description of Artificial Sequence: Synthetic oligonucleotide
gagctggggttcctctctgattac

SEQ ID NO: 20890 - protein, 8 aa, Artificial Sequence
  Description of Artificial Sequence: Synthetic peptide
ELGFLSDY

SEQ ID NO: 20891 - DNA, 18 bp, Artificial Sequence
  Description of Artificial Sequence: Synthetic oligonucleotide
gtggcttcattcgactac

SEQ ID NO: 20892 - protein, 6 aa, Artificial Sequence
  Description of Artificial Sequence: Synthetic peptide
VASFDY

SEQ ID NO: 20893 - DNA, 42 bp, Artificial Sequence; identical to SEQ ID NO: 20341
  Description of Artificial Sequence: Synthetic oligonucleotide

SEQ ID NO: 20894 - protein, 14 aa, Artificial Sequence
  Description of Artificial Sequence: Synthetic peptide
EKYSSSWYDYGMDV

SEQ ID NO: 20895 - DNA, 27 bp, Artificial Sequence
  Description of Artificial Sequence: Synthetic oligonucleotide
gatgagaggctggggatttttgactac

SEQ ID NO: 20896 - protein, 9 aa, Artificial Sequence
  Description of Artificial Sequence: Synthetic peptide
DERLGIFDY

SEQ ID NO: 20897 - DNA, 24 bp, Artificial Sequence
  Description of Artificial Sequence: Synthetic oligonucleotide
gaactaggcttccagtctgactac

SEQ ID NO: 20898 - protein, 8 aa, Artificial Sequence
  Description of Artificial Sequence: Synthetic peptide
ELGFQSDY

SEQ ID NO: 20899 - DNA, 27 bp, Artificial Sequence
  Description of Artificial Sequence: Synthetic oligonucleotide
gatctgagaatgggcggtatggacgtc

SEQ ID NO: 20900 - protein, 9 aa, Artificial Sequence
  Description of Artificial Sequence: Synthetic peptide
DLRMGGMDV

SEQ ID NO: 20901 - DNA, 27 bp, Artificial Sequence
  Description of Artificial Sequence: Synthetic oligonucleotide
ctaagcagcaactgggactttgactac

SEQ ID NO: 20902 - protein, 9 aa, Artificial Sequence
  Description of Artificial Sequence: Synthetic peptide
LSSNWDFDY

SEQ ID NO: 20903 - DNA, 27 bp, Artificial Sequence
  Description of Artificial Sequence: Synthetic oligonucleotide
gatctgagtatgggcggtatggacgtc

SEQ ID NO: 20904 - protein, 9 aa, Artificial Sequence
  Description of Artificial Sequence: Synthetic peptide
DLSMGGMDV

SEQ ID NO: 20905 - DNA, 27 bp, Artificial Sequence
  Description of Artificial Sequence: Synthetic oligonucleotide
gatgagaggctggggatttttgactac

SEQ ID NO: 20906 - protein, 9 aa, Artificial Sequence
  Description of Artificial Sequence: Synthetic peptide
DERLGIFDY

SEQ ID NO: 20907 - DNA, 24 bp, Artificial Sequence
  Description of Artificial Sequence: Synthetic oligonucleotide
gaattggggttccggtctgactac

SEQ ID NO: 20908 - protein, 8 aa, Artificial Sequence
  Description of Artificial Sequence: Synthetic peptide
ELGFRSDY

SEQ ID NO: 20909 - DNA, 33 bp, Artificial Sequence
  Description of Artificial Sequence: Synthetic oligonucleotide
aggatagcagctggtatggagtacttcgatctc

SEQ ID NO: 20910 - protein, 11 aa, Artificial Sequence
  Description of Artificial Sequence: Synthetic peptide
RIAAGMEYFDL

SEQ ID NO: 20911 - DNA, 42 bp, Artificial Sequence
  Description of Artificial Sequence: Synthetic oligonucleotide
tattgtagtagtaccaggtgcccttatgatgcctttgatatc

SEQ ID NO: 20912 - protein, 14 aa, Artificial Sequence
  Description of Artificial Sequence: Synthetic peptide
YCSSTRCPYDAFDI

SEQ ID NO: 20913 - DNA, 27 bp, Artificial Sequence
  Description of Artificial Sequence: Synthetic oligonucleotide
agcagtggctgggaggtctttgactac

SEQ ID NO: 20914 - protein, 9 aa, Artificial Sequence
  Description of Artificial Sequence: Synthetic peptide
SSGWEVFDY

SEQ ID NO: 20915 - DNA, 18 bp, Artificial Sequence
  Description of Artificial Sequence: Synthetic oligonucleotide
gtagcagcctttgactcc

SEQ ID NO: 20916 - protein, 6 aa, Artificial Sequence
  Description of Artificial Sequence: Synthetic peptide
VAAFDS

SEQ ID NO: 20917 - DNA, 15 bp, Artificial Sequence
  Description of Artificial Sequence: Synthetic oligonucleotide
gatcgtgggagctac

SEQ ID NO: 20918 - protein, 5 aa, Artificial Sequence
  Description of Artificial Sequence: Synthetic peptide
DRGSY

SEQ ID NO: 20919 - DNA, 24 bp, Artificial Sequence
  Description of Artificial Sequence: Synthetic oligonucleotide
gatcttggctggacggaagagtac

SEQ ID NO: 20920 - protein, 8 aa, Artificial Sequence
  Description of Artificial Sequence: Synthetic peptide
DLGWTEEY

SEQ ID NO: 20921 - DNA, 42 bp, Artificial Sequence
  Description of Artificial Sequence: Synthetic oligonucleotide
gagagatatagcagtggctggtatgactacggtttggacgtc

SEQ ID NO: 20922 - protein, 14 aa, Artificial Sequence
  Description of Artificial Sequence: Synthetic peptide
ERYSSGWYDYGLDV

SEQ ID NO: 20923 - DNA, 18 bp, Artificial Sequence
  Description of Artificial Sequence: Synthetic oligonucleotide
gttaacctctttgactac

SEQ ID NO: 20924 - protein, 6 aa, Artificial Sequence
  Description of Artificial Sequence: Synthetic peptide
VNLFDY

SEQ ID NO: 20925 - DNA, 24 bp, Artificial Sequence
  Description of Artificial Sequence: Synthetic oligonucleotide
gatggtaccagctcgtttgactac

SEQ ID NO: 20926 - protein, 8 aa, Artificial Sequence
  Description of Artificial Sequence: Synthetic peptide
DGTSSFDY

SEQ ID NO: 20927 - DNA, 42 bp, Artificial Sequence; identical to SEQ ID NO: 20463
  Description of Artificial Sequence: Synthetic oligonucleotide

SEQ ID NO: 20928 - protein, 14 aa, Artificial Sequence
  Description of Artificial Sequence: Synthetic peptide
YCSSARCPYDAFDI

SEQ ID NO: 20929 - DNA, 27 bp, Artificial Sequence
  Description of Artificial Sequence: Synthetic oligonucleotide
gggagcagctcgtccggctttgactac

SEQ ID NO: 20930 - protein, 9 aa, Artificial Sequence
  Description of Artificial Sequence: Synthetic peptide
GSSSSGFDY

SEQ ID NO: 20931 - DNA, 24 bp, Artificial Sequence
  Description of Artificial Sequence: Synthetic oligonucleotide
gaacttggctggtacgaggactac

SEQ ID NO: 20932 - protein, 8 aa, Artificial Sequence
  Description of Artificial Sequence: Synthetic peptide
ELGWYEDY

SEQ ID NO: 20933 - DNA, 27 bp, Artificial Sequence
  Description of Artificial Sequence: Synthetic oligonucleotide
cacagtaccagctggtctcttgaccac

SEQ ID NO: 20934 - protein, 9 aa, Artificial Sequence
  Description of Artificial Sequence: Synthetic peptide
HSTSWSLDH

SEQ ID NO: 20935 - DNA, 27 bp, Artificial Sequence
  Description of Artificial Sequence: Synthetic oligonucleotide
gatctgagtatgggcggtatggacgtc

SEQ ID NO: 20936 - protein, 9 aa, Artificial Sequence
  Description of Artificial Sequence: Synthetic peptide
DLSMGGMDV

SEQ ID NO: 20937 - DNA, 42 bp, Artificial Sequence
  Description of Artificial Sequence: Synthetic oligonucleotide
gaaaggtataccagtggctggcacgactacggtatggacgtc

SEQ ID NO: 20938 - protein, 14 aa, Artificial Sequence
  Description of Artificial Sequence: Synthetic peptide
ERYTSGWHDYGMDV

SEQ ID NO: 20939 - DNA, 18 bp, Artificial Sequence
  Description of Artificial Sequence: Synthetic oligonucleotide
ggggggtccctcttctac

SEQ ID NO: 20940 - protein, 6 aa, Artificial Sequence
  Description of Artificial Sequence: Synthetic peptide
GGSLFY

SEQ ID NO: 20941 - DNA, 42 bp, Artificial Sequence; identical to SEQ ID NO: 20341
  Description of Artificial Sequence: Synthetic oligonucleotide

SEQ ID NO: 20942 - protein, 14 aa, Artificial Sequence
  Description of Artificial Sequence: Synthetic peptide
EKYSSSWYDYGMDV

SEQ ID NO: 20943 - DNA, 24 bp, Artificial Sequence
  Description of Artificial Sequence: Synthetic oligonucleotide
gaactggggttccggtctgactac

SEQ ID NO: 20944 - protein, 8 aa, Artificial Sequence
  Description of Artificial Sequence: Synthetic peptide
ELGFRSDY

SEQ ID NO: 20945 - DNA, 24 bp, Artificial Sequence
  Description of Artificial Sequence: Synthetic oligonucleotide
gaattggggttccggtctgactac

SEQ ID NO: 20946 - protein, 8 aa, Artificial Sequence
  Description of Artificial Sequence: Synthetic peptide
ELGFRSDY

SEQ ID NO: 20947 - DNA, 42 bp, Artificial Sequence; identical to SEQ ID NO: 20341
  Description of Artificial Sequence: Synthetic oligonucleotide

SEQ ID NO: 20948 - protein, 14 aa, Artificial Sequence
  Description of Artificial Sequence: Synthetic peptide
EKYSSSWYDYGMDV

SEQ ID NO: 20949 - DNA, 36 bp, Artificial Sequence; identical to SEQ ID NO: 20265
  Description of Artificial Sequence: Synthetic oligonucleotide

SEQ ID NO: 20950 - protein, 12 aa, Artificial Sequence
  Description of Artificial Sequence: Synthetic peptide
RLAVAGSEAFDI

SEQ ID NO: 20951 - DNA, 15 bp, Artificial Sequence
  Description of Artificial Sequence: Synthetic oligonucleotide
gatcgtgggagcctc

SEQ ID NO: 20952 - protein, 5 aa, Artificial Sequence
  Description of Artificial Sequence: Synthetic peptide
DRGSL

SEQ ID NO: 20953 - DNA, 24 bp, Artificial Sequence
  Description of Artificial Sequence: Synthetic oligonucleotide
gaaaaggggggtctatttgactac

SEQ ID NO: 20954 - protein, 8 aa, Artificial Sequence
  Description of Artificial Sequence: Synthetic peptide
EKGGLFDY

SEQ ID NO: 20955 - DNA, 42 bp, Artificial Sequence
  Description of Artificial Sequence: Synthetic oligonucleotide
gagaagtatagcagcaactggtacgactacggtatggacgtc

SEQ ID NO: 20956 - protein, 14 aa, Artificial Sequence
  Description of Artificial Sequence: Synthetic peptide
EKYSSNWYDYGMDV

SEQ ID NO: 20957 - DNA, 18 bp, Artificial Sequence
  Description of Artificial Sequence: Synthetic oligonucleotide
gctaacctctttgactac

SEQ ID NO: 20958 - protein, 6 aa, Artificial Sequence
  Description of Artificial Sequence: Synthetic peptide
ANLFDY

SEQ ID NO: 20959 - DNA, 27 bp, Artificial Sequence
  Description of Artificial Sequence: Synthetic oligonucleotide
ctgaacagcagctggtcttttgactac

SEQ ID NO: 20960 - protein, 9 aa, Artificial Sequence
  Description of Artificial Sequence: Synthetic peptide
LNSSWSFDY

SEQ ID NO: 20961 - DNA, 24 bp, Artificial Sequence
  Description of Artificial Sequence: Synthetic oligonucleotide
ggaggtgggagcccttttgactac

SEQ ID NO: 20962 - protein, 8 aa, Artificial Sequence
  Description of Artificial Sequence: Synthetic peptide
GGGSPFDY

SEQ ID NO: 20963 - DNA, 24 bp, Artificial Sequence
  Description of Artificial Sequence: Synthetic oligonucleotide
gaattggggttccggtctgactac

SEQ ID NO: 20964 - protein, 8 aa, Artificial Sequence
  Description of Artificial Sequence: Synthetic peptide
ELGFRSDY

SEQ ID NO: 20965 - DNA, 42 bp, Artificial Sequence
  Description of Artificial Sequence: Synthetic oligonucleotide
gagaagtatagcagcagctggtacgactacggtttggacgtc

SEQ ID NO: 20966 - protein, 14 aa, Artificial Sequence
  Description of Artificial Sequence: Synthetic peptide
EKYSSSWYDYGLDV

SEQ ID NO: 20967 - DNA, 24 bp, Artificial Sequence
  Description of Artificial Sequence: Synthetic oligonucleotide
gagcttggctggtacgaggactac

SEQ ID NO: 20968 - protein, 8 aa, Artificial Sequence
  Description of Artificial Sequence: Synthetic peptide
ELGWYEDY

SEQ ID NO: 20969 - DNA, 36 bp, Artificial Sequence; identical to SEQ ID NO: 20457
  Description of Artificial Sequence: Synthetic oligonucleotide

SEQ ID NO: 20970 - protein, 12 aa, Artificial Sequence
  Description of Artificial Sequence: Synthetic peptide
RGYSYGGYGMDV

SEQ ID NO: 20971 - DNA, 27 bp, Artificial Sequence
  Description of Artificial Sequence: Synthetic oligonucleotide
ctgagcagcagttggtcttttgacttc

SEQ ID NO: 20972 - protein, 9 aa, Artificial Sequence
  Description of Artificial Sequence: Synthetic peptide
LSSSWSFDF

SEQ ID NO: 20973 - DNA, 36 bp, Artificial Sequence; identical to SEQ ID NO: 20457
  Description of Artificial Sequence: Synthetic oligonucleotide

SEQ ID NO: 20974 - protein, 12 aa, Artificial Sequence
  Description of Artificial Sequence: Synthetic peptide
RGYSYGGYGMDV

SEQ ID NO: 20975 - DNA, 36 bp, Artificial Sequence; identical to SEQ ID NO: 20457
  Description of Artificial Sequence: Synthetic oligonucleotide

SEQ ID NO: 20976 - protein, 12 aa, Artificial Sequence
  Description of Artificial Sequence: Synthetic peptide
RGYSYGGYGMDV

SEQ ID NO: 20977 - DNA, 15 bp, Artificial Sequence
  Description of Artificial Sequence: Synthetic oligonucleotide
gatcgaggctccatc

SEQ ID NO: 20978 - protein, 5 aa, Artificial Sequence
  Description of Artificial Sequence: Synthetic peptide
DRGSI

SEQ ID NO: 20979 - DNA, 45 bp, Artificial Sequence
  Description of Artificial Sequence: Synthetic oligonucleotide
gatcggggagcagtggctgcttactactactacggtatagacgtc

SEQ ID NO: 20980 - protein, 15 aa, Artificial Sequence
  Description of Artificial Sequence: Synthetic peptide
DRGAVAAYYYYGIDV

SEQ ID NO: 20981 - DNA, 27 bp, Artificial Sequence
  Description of Artificial Sequence: Synthetic oligonucleotide
gatctgagtatgggcggtatggacgtc

SEQ ID NO: 20982 - protein, 9 aa, Artificial Sequence
  Description of Artificial Sequence: Synthetic peptide
DLSMGGMDV

SEQ ID NO: 20983 - DNA, 36 bp, Artificial Sequence; identical to SEQ ID NO: 20265
  Description of Artificial Sequence: Synthetic oligonucleotide

SEQ ID NO: 20984 - protein, 12 aa, Artificial Sequence
  Description of Artificial Sequence: Synthetic peptide
RLAVAGSEAFDI

SEQ ID NO: 20985 - DNA, 27 bp, Artificial Sequence
  Description of Artificial Sequence: Synthetic oligonucleotide
gatctgagtatgggcggtatggacgtc

SEQ ID NO: 20986 - protein, 9 aa, Artificial Sequence
  Description of Artificial Sequence: Synthetic peptide
DLSMGGMDV

SEQ ID NO: 20987 - DNA, 18 bp, Artificial Sequence
  Description of Artificial Sequence: Synthetic oligonucleotide
agctccttgtttgactac

SEQ ID NO: 20988 - protein, 6 aa, Artificial Sequence
  Description of Artificial Sequence: Synthetic peptide
SSLFDY

SEQ ID NO: 20989 - DNA, 24 bp, Artificial Sequence
  Description of Artificial Sequence: Synthetic oligonucleotide
gaagtggggtttctttctgactac

SEQ ID NO: 20990 - protein, 8 aa, Artificial Sequence
  Description of Artificial Sequence: Synthetic peptide
EVGFLSDY

SEQ ID NO: 20991 - DNA, 36 bp, Artificial Sequence; identical to SEQ ID NO: 20357
  Description of Artificial Sequence: Synthetic oligonucleotide

SEQ ID NO: 20992 - protein, 12 aa, Artificial Sequence
  Description of Artificial Sequence: Synthetic peptide
RLAVAGSEAFDI

SEQ ID NO: 20993 - DNA, 24 bp, Artificial Sequence
  Description of Artificial Sequence: Synthetic oligonucleotide
gaactggggtttctctctgactac

SEQ ID NO: 20994 - protein, 8 aa, Artificial Sequence
  Description of Artificial Sequence: Synthetic peptide
ELGFLSDY

SEQ ID NO: 20995 - DNA, 18 bp, Artificial Sequence
  Description of Artificial Sequence: Synthetic oligonucleotide
agctccttgtttgactat

SEQ ID NO: 20996 - protein, 6 aa, Artificial Sequence
  Description of Artificial Sequence: Synthetic peptide
SSLFDY

SEQ ID NO: 20997 - DNA, 36 bp, Artificial Sequence; identical to SEQ ID NO: 20457
  Description of Artificial Sequence: Synthetic oligonucleotide

SEQ ID NO: 20998 - protein, 12 aa, Artificial Sequence
  Description of Artificial Sequence: Synthetic peptide
RGYSYGGYGMDV

SEQ ID NO: 20999 - DNA, 18 bp, Artificial Sequence
  Description of Artificial Sequence: Synthetic oligonucleotide
gttaacaactttgactac

SEQ ID NO: 21000 - protein, 6 aa, Artificial Sequence
  Description of Artificial Sequence: Synthetic peptide
VNNFDY

SEQ ID NO: 21001 - DNA, 36 bp, Artificial Sequence
  Description of Artificial Sequence: Synthetic oligonucleotide
cgtataacagctcgtctctactacggtatggacgtc

SEQ ID NO: 21002 - protein, 12 aa, Artificial Sequence
  Description of Artificial Sequence: Synthetic peptide
RITARLYYGMDV

SEQ ID NO: 21003 - DNA, 27 bp, Artificial Sequence
  Description of Artificial Sequence: Synthetic oligonucleotide
catggaaaagactggggccttgactac

SEQ ID NO: 21004 - protein, 9 aa, Artificial Sequence
  Description of Artificial Sequence: Synthetic peptide
HGKDWGLDY

SEQ ID NO: 21005 - DNA, 42 bp, Artificial Sequence
  Description of Artificial Sequence: Synthetic oligonucleotide
gaggtatatagcagtggctggtacgactacggtatggacgtc

SEQ ID NO: 21006 - protein, 14 aa, Artificial Sequence
  Description of Artificial Sequence: Synthetic peptide
EVYSSGWYDYGMDV

SEQ ID NO: 21007 - DNA, 36 bp, Artificial Sequence; identical to SEQ ID NO: 20357
  Description of Artificial Sequence: Synthetic oligonucleotide

SEQ ID NO: 21008 - protein, 12 aa, Artificial Sequence
  Description of Artificial Sequence: Synthetic peptide
RLAVAGSEAFDI

SEQ ID NO: 21009 - DNA, 27 bp, Artificial Sequence
  Description of Artificial Sequence: Synthetic oligonucleotide
catggaaaagactggggccttgactac

SEQ ID NO: 21010 - protein, 9 aa, Artificial Sequence
  Description of Artificial Sequence: Synthetic peptide
HGKDWGLDY

SEQ ID NO: 21011 - DNA, 36 bp, Artificial Sequence; identical to SEQ ID NO: 20457
  Description of Artificial Sequence: Synthetic oligonucleotide

SEQ ID NO: 21012 - protein, 12 aa, Artificial Sequence
  Description of Artificial Sequence: Synthetic peptide
RGYSYGGYGMDV

SEQ ID NO: 21013 - DNA, 27 bp, Artificial Sequence
  Description of Artificial Sequence: Synthetic oligonucleotide
cttagcagcagctgggacttccagcac

SEQ ID NO: 21014 - protein, 9 aa, Artificial Sequence
  Description of Artificial Sequence: Synthetic peptide
LSSSWDFQH

SEQ ID NO: 21015 - DNA, 36 bp, Artificial Sequence; identical to SEQ ID NO: 20875
  Description of Artificial Sequence: Synthetic oligonucleotide

SEQ ID NO: 21016 - protein, 12 aa, Artificial Sequence
  Description of Artificial Sequence: Synthetic peptide
RIAVAGSEAFAI

SEQ ID NO: 21017 - DNA, 27 bp, Artificial Sequence
  Description of Artificial Sequence: Synthetic oligonucleotide
ctgagcagcagctggtcttttgactac

SEQ ID NO: 21018 - protein, 9 aa, Artificial Sequence
  Description of Artificial Sequence: Synthetic peptide
LSSSWSFDY

SEQ ID NO: 21019 - DNA, 24 bp, Artificial Sequence
  Description of Artificial Sequence: Synthetic oligonucleotide
ggaggtgggagcccttttgactcc

SEQ ID NO: 21020 - protein, 8 aa, Artificial Sequence
  Description of Artificial Sequence: Synthetic peptide
GGGSPFDS

SEQ ID NO: 21021 - DNA, 27 bp, Artificial Sequence
  Description of Artificial Sequence: Synthetic oligonucleotide
catagcaccagctggtcccttgactac

SEQ ID NO: 21022 - protein, 9 aa, Artificial Sequence
  Description of Artificial Sequence: Synthetic peptide
HSTSWSLDY

SEQ ID NO: 21023 - DNA, 24 bp, Artificial Sequence
  Description of Artificial Sequence: Synthetic oligonucleotide
gaactggggttccggtctgactac

SEQ ID NO: 21024 - protein, 8 aa, Artificial Sequence
  Description of Artificial Sequence: Synthetic peptide
ELGFRSDY

SEQ ID NO: 21025 - DNA, 12 bp, Artificial Sequence
  Description of Artificial Sequence: Synthetic oligonucleotide
ttaggggactac

SEQ ID NO: 21026 - protein, 4 aa, Artificial Sequence
  Description of Artificial Sequence: Synthetic peptide
LGDY

SEQ ID NO: 21027 - DNA, 27 bp, Artificial Sequence
  Description of Artificial Sequence: Synthetic oligonucleotide
ctgagcagcagctggtcctttgactac

SEQ ID NO: 21028 - protein, 9 aa, Artificial Sequence
  Description of Artificial Sequence: Synthetic peptide
LSSSWSFDY

SEQ ID NO: 21029 - DNA, 27 bp, Artificial Sequence
  Description of Artificial Sequence: Synthetic oligonucleotide
agtcatggctggttcctctttgactac

SEQ ID NO: 21030 - protein, 9 aa, Artificial Sequence
  Description of Artificial Sequence: Synthetic peptide
SHGWFLFDY

SEQ ID NO: 21031 - DNA, 24 bp, Artificial Sequence
  Description of Artificial Sequence: Synthetic oligonucleotide
gagcttgcctggtccgaggactac

SEQ ID NO: 21032 - protein, 8 aa, Artificial Sequence
  Description of Artificial Sequence: Synthetic peptide
ELAWSEDY

SEQ ID NO: 21033 - DNA, 18 bp, Artificial Sequence
  Description of Artificial Sequence: Synthetic oligonucleotide
gtagcagcctttgactac

SEQ ID NO: 21034 - protein, 6 aa, Artificial Sequence
  Description of Artificial Sequence: Synthetic peptide
VAAFDY

SEQ ID NO: 21035 - DNA, 12 bp, Artificial Sequence
  Description of Artificial Sequence: Synthetic oligonucleotide
ttaggggtctac

SEQ ID NO: 21036 - protein, 4 aa, Artificial Sequence
  Description of Artificial Sequence: Synthetic peptide
LGVY

SEQ ID NO: 21037 - DNA, 27 bp, Artificial Sequence
  Description of Artificial Sequence: Synthetic oligonucleotide
cagggcagtggctgggaggttgactac

SEQ ID NO: 21038 - protein, 9 aa, Artificial Sequence
  Description of Artificial Sequence: Synthetic peptide
QGSGWEVDY

SEQ ID NO: 21039 - DNA, 27 bp, Artificial Sequence
  Description of Artificial Sequence: Synthetic oligonucleotide
catagcaccagctggtcccttgactac

SEQ ID NO: 21040 - protein, 9 aa, Artificial Sequence
  Description of Artificial Sequence: Synthetic peptide
HSTSWSLDY

SEQ ID NO: 21041 - DNA, 36 bp, Artificial Sequence; identical to SEQ ID NO: 20359
  Description of Artificial Sequence: Synthetic oligonucleotide

SEQ ID NO: 21042 - protein, 12 aa, Artificial Sequence
  Description of Artificial Sequence: Synthetic peptide
RMAVAGSEAFDI

SEQ ID NO: 21043 - DNA, 27 bp, Artificial Sequence
  Description of Artificial Sequence: Synthetic oligonucleotide
catggaaaagactggggccttgacaac

SEQ ID NO: 21044 - protein, 9 aa, Artificial Sequence
  Description of Artificial Sequence: Synthetic peptide
HGKDWGLDN

SEQ ID NO: 21045 - DNA, 36 bp, Artificial Sequence
  Description of Artificial Sequence: Synthetic oligonucleotide
cggggatacagctatggcgggtatggtatggacgtc

SEQ ID NO: 21046 - protein, 12 aa, Artificial Sequence
  Description of Artificial Sequence: Synthetic peptide
RGYSYGGYGMDV

SEQ ID NO: 21047 - DNA, 27 bp, Artificial Sequence
  Description of Artificial Sequence: Synthetic oligonucleotide
gatctgagtatgggcggtatggacgtc

SEQ ID NO: 21048 - protein, 9 aa, Artificial Sequence
  Description of Artificial Sequence: Synthetic peptide
DLSMGGMDV

SEQ ID NO: 21049 - DNA, 27 bp, Artificial Sequence
  Description of Artificial Sequence: Synthetic oligonucleotide
agcagtggctggtacttctttgactac

SEQ ID NO: 21050 - protein, 9 aa, Artificial Sequence
  Description of Artificial Sequence: Synthetic peptide
SSGWYFFDY

SEQ ID NO: 21051 - DNA, 36 bp, Artificial Sequence
  Description of Artificial Sequence: Synthetic oligonucleotide
cgtatcgcagtggctggctcggaggcttttgatatc

SEQ ID NO: 21052 - protein, 12 aa, Artificial Sequence
  Description of Artificial Sequence: Synthetic peptide
RIAVAGSEAFDI

SEQ ID NO: 21053 - DNA, 24 bp, Artificial Sequence
  Description of Artificial Sequence: Synthetic oligonucleotide
gagcttgcctggtacgaggactac

SEQ ID NO: 21054 - protein, 8 aa, Artificial Sequence
  Description of Artificial Sequence: Synthetic peptide
ELAWYEDY

SEQ ID NO: 21055 - DNA, 24 bp, Artificial Sequence
  Description of Artificial Sequence: Synthetic oligonucleotide
gaactaggcttccagtctgacttc

SEQ ID NO: 21056 - protein, 8 aa, Artificial Sequence
  Description of Artificial Sequence: Synthetic peptide
ELGFQSDF

SEQ ID NO: 21057 - DNA, 24 bp, Artificial Sequence
  Description of Artificial Sequence: Synthetic oligonucleotide
gagcttgcctggtacgaggacttc

SEQ ID NO: 21058 - protein, 8 aa, Artificial Sequence
  Description of Artificial Sequence: Synthetic peptide
ELAWYEDF

SEQ ID NO: 21059 - DNA, 24 bp, Artificial Sequence
  Description of Artificial Sequence: Synthetic oligonucleotide
gaaatgggctggaccgatgactgc

SEQ ID NO: 21060 - protein, 8 aa, Artificial Sequence
  Description of Artificial Sequence: Synthetic peptide
EMGWTDDC

SEQ ID NO: 21061 - DNA, 24 bp, Artificial Sequence
  Description of Artificial Sequence: Synthetic oligonucleotide
gagcttgcctggtacgaggactac

SEQ ID NO: 21062 - protein, 8 aa, Artificial Sequence
  Description of Artificial Sequence: Synthetic peptide
ELAWYEDY

SEQ ID NO: 21063 - DNA, 45 bp, Artificial Sequence
  Description of Artificial Sequence: Synthetic oligonucleotide
tcgtttttctatggttcggggagttattataacgaatttgactac

SEQ ID NO: 21064 - protein, 15 aa, Artificial Sequence
  Description of Artificial Sequence: Synthetic peptide
SFFYGSGSYYNEFDY

SEQ ID NO: 21065 - DNA, 45 bp, Artificial Sequence
  Description of Artificial Sequence: Synthetic oligonucleotide
tggggacgtggcaacagctatgagtactactacggtatggacgtc

SEQ ID NO: 21066 - protein, 15 aa, Artificial Sequence
  Description of Artificial Sequence: Synthetic peptide
WGRGNSYEYYYGMDV

SEQ ID NO: 21067 - DNA, 33 bp, Artificial Sequence
  Description of Artificial Sequence: Synthetic oligonucleotide
aggggtataccagaggctgatgcttttgatatc

SEQ ID NO: 21068 - protein, 11 aa, Artificial Sequence
  Description of Artificial Sequence: Synthetic peptide
RGIPEADAFDI

SEQ ID NO: 21069 - DNA, 42 bp, Artificial Sequence
  Description of Artificial Sequence: Synthetic oligonucleotide
tattgtagtagtaccaggtgtccttatgatgcctttgatatc

SEQ ID NO: 21070 - protein, 14 aa, Artificial Sequence
  Description of Artificial Sequence: Synthetic peptide
YCSSTRCPYDAFDI

SEQ ID NO: 21071 - DNA, 15 bp, Artificial Sequence
  Description of Artificial Sequence: Synthetic oligonucleotide
gatcgtgggagctcc

SEQ ID NO: 21072 - protein, 5 aa, Artificial Sequence
  Description of Artificial Sequence: Synthetic peptide
DRGSS

SEQ ID NO: 21073 - DNA, 33 bp, Artificial Sequence
  Description of Artificial Sequence: Synthetic oligonucleotide
ggatacagctatgggtacaactggttcgacccc

SEQ ID NO: 21074 - protein, 11 aa, Artificial Sequence
  Description of Artificial Sequence: Synthetic peptide
GYSYGYNWFDP

SEQ ID NO: 21075 - DNA, 18 bp, Artificial Sequence
  Description of Artificial Sequence: Synthetic oligonucleotide
gtggcttcatttgactac

SEQ ID NO: 21076 - protein, 6 aa, Artificial Sequence
  Description of Artificial Sequence: Synthetic peptide
VASFDY

SEQ ID NO: 21077 - DNA, 24 bp, Artificial Sequence
  Description of Artificial Sequence: Synthetic oligonucleotide
gatggtaccagctcgcttgactac

SEQ ID NO: 21078 - protein, 8 aa, Artificial Sequence
  Description of Artificial Sequence: Synthetic peptide
DGTSSLDY

SEQ ID NO: 21079 - DNA, 33 bp, Artificial Sequence; identical to SEQ ID NO: 21073
  Description of Artificial Sequence: Synthetic oligonucleotide

SEQ ID NO: 21080 - protein, 11 aa, Artificial Sequence
  Description of Artificial Sequence: Synthetic peptide
GYSYGYNWFDP

SEQ ID NO: 21081 - DNA, 57 bp, Artificial Sequence
  Description of Artificial Sequence: Synthetic oligonucleotide
gatacgggtcctatagcagctcgtctcgcttactactactattacgctatggacgtc

SEQ ID NO: 21082 - protein, 19 aa, Artificial Sequence
  Description of Artificial Sequence: Synthetic peptide
DTGPIAARLAYYYYYAMDV

SEQ ID NO: 21083 - DNA, 45 bp, Artificial Sequence
  Description of Artificial Sequence: Synthetic oligonucleotide
tcgtattactatggttcggggacttattataacgaatttgactac

SEQ ID NO: 21084 - protein, 15 aa, Artificial Sequence
  Description of Artificial Sequence: Synthetic peptide
SYYYGSGTYYNEFDY

SEQ ID NO: 21085 - DNA, 45 bp, Artificial Sequence; identical to SEQ ID NO: 20737
  Description of Artificial Sequence: Synthetic oligonucleotide

SEQ ID NO: 21086 - protein, 15 aa, Artificial Sequence
  Description of Artificial Sequence: Synthetic peptide
WGRGYSYEYYYGMDV

SEQ ID NO: 21087 - DNA, 27 bp, Artificial Sequence
  Description of Artificial Sequence: Synthetic oligonucleotide
agtagtggctggtactactttgactac

SEQ ID NO: 21088 - protein, 9 aa, Artificial Sequence
  Description of Artificial Sequence: Synthetic peptide
SSGWYYFDY

SEQ ID NO: 21089 - DNA, 27 bp, Artificial Sequence
  Description of Artificial Sequence: Synthetic oligonucleotide
actatagcagttcgtggctttgactac

SEQ ID NO: 21090 - protein, 9 aa, Artificial Sequence
  Description of Artificial Sequence: Synthetic peptide
TIAVRGFDY

SEQ ID NO: 21091 - DNA, 18 bp, Artificial Sequence
  Description of Artificial Sequence: Synthetic oligonucleotide
gtggcttcatttgactac

SEQ ID NO: 21092 - protein, 6 aa, Artificial Sequence
  Description of Artificial Sequence: Synthetic peptide
VASFDY

SEQ ID NO: 21093 - DNA, 24 bp, Artificial Sequence
  Description of Artificial Sequence: Synthetic oligonucleotide
gatggtaccagctcgtttgactac

SEQ ID NO: 21094 - protein, 8 aa, Artificial Sequence
  Description of Artificial Sequence: Synthetic peptide
DGTSSFDY

SEQ ID NO: 21095 - DNA, 27 bp, Artificial Sequence
  Description of Artificial Sequence: Synthetic oligonucleotide
aggggacagcagctggccctcgactac

SEQ ID NO: 21096 - protein, 9 aa, Artificial Sequence
  Description of Artificial Sequence: Synthetic peptide
RGQQLALDY

SEQ ID NO: 21097 - DNA, 27 bp, Artificial Sequence
  Description of Artificial Sequence: Synthetic oligonucleotide
agcggtggctggtactactttgactac

SEQ ID NO: 21098 - protein, 9 aa, Artificial Sequence
  Description of Artificial Sequence: Synthetic peptide
SGGWYYFDY

SEQ ID NO: 21099 - DNA, 45 bp, Artificial Sequence; identical to SEQ ID NO: 20737
  Description of Artificial Sequence: Synthetic oligonucleotide

SEQ ID NO: 21100 - protein, 15 aa, Artificial Sequence
  Description of Artificial Sequence: Synthetic peptide
WGRGYSYEYYYGMDV

SEQ ID NO: 21101 - DNA, 27 bp, Artificial Sequence
  Description of Artificial Sequence: Synthetic oligonucleotide
agcagtggctggtattggttcgacccc

SEQ ID NO: 21102 - protein, 9 aa, Artificial Sequence
  Description of Artificial Sequence: Synthetic peptide
SSGWYWFDP

SEQ ID NO: 21103 - DNA, 27 bp, Artificial Sequence
  Description of Artificial Sequence: Synthetic oligonucleotide
agcaatggctggtactactttgactac

SEQ ID NO: 21104 - protein, 9 aa, Artificial Sequence
  Description of Artificial Sequence: Synthetic peptide
SNGWYYFDY

SEQ ID NO: 21105 - DNA, 27 bp, Artificial Sequence
  Description of Artificial Sequence: Synthetic oligonucleotide
agcagtggctggtactggttcgacccc

SEQ ID NO: 21106 - protein, 9 aa, Artificial Sequence
  Description of Artificial Sequence: Synthetic peptide
SSGWYWFDP

SEQ ID NO: 21107 - DNA, 24 bp, Artificial Sequence
  Description of Artificial Sequence: Synthetic oligonucleotide
gatggaactgggtcctttgactac

SEQ ID NO: 21108 - protein, 8 aa, Artificial Sequence
  Description of Artificial Sequence: Synthetic peptide
DGTGSFDY

SEQ ID NO: 21109 - DNA, 27 bp, Artificial Sequence
  Description of Artificial Sequence: Synthetic oligonucleotide
agcagtggctggtacttttttgactac

SEQ ID NO: 21110 - protein, 9 aa, Artificial Sequence
  Description of Artificial Sequence: Synthetic peptide
SSGWYFFDY

SEQ ID NO: 21111 - DNA, 27 bp, Artificial Sequence
  Description of Artificial Sequence: Synthetic oligonucleotide
agcagtggctggtacttttttgactac

SEQ ID NO: 21112 - protein, 9 aa, Artificial Sequence
  Description of Artificial Sequence: Synthetic peptide
SSGWYFFDY

SEQ ID NO: 21113 - DNA, 18 bp, Artificial Sequence
  Description of Artificial Sequence: Synthetic oligonucleotide
gtggctggctttgactac

SEQ ID NO: 21114 - protein, 6 aa, Artificial Sequence
  Description of Artificial Sequence: Synthetic peptide
VAGFDY

SEQ ID NO: 21115 - DNA, 42 bp, Artificial Sequence; identical to SEQ ID NO: 20525
  Description of Artificial Sequence: Synthetic oligonucleotide

SEQ ID NO: 21116 - protein, 14 aa, Artificial Sequence
  Description of Artificial Sequence: Synthetic peptide
GELLEDYYFYGMDV

SEQ ID NO: 21117 - DNA, 18 bp, Artificial Sequence
  Description of Artificial Sequence: Synthetic oligonucleotide
aagaaggctaacgactac

SEQ ID NO: 21118 - protein, 6 aa, Artificial Sequence
  Description of Artificial Sequence: Synthetic peptide
KKANDY

SEQ ID NO: 21119 - DNA, 18 bp, Artificial Sequence
  Description of Artificial Sequence: Synthetic oligonucleotide
ttaaatggttttgactac

SEQ ID NO: 21120 - protein, 6 aa, Artificial Sequence
  Description of Artificial Sequence: Synthetic peptide
LNGFDY

SEQ ID NO: 21121 - DNA, 42 bp, Artificial Sequence; identical to SEQ ID NO: 20525
  Description of Artificial Sequence: Synthetic oligonucleotide

SEQ ID NO: 21122 - protein, 14 aa, Artificial Sequence
  Description of Artificial Sequence: Synthetic peptide
GELLEDYYFYGMDV

SEQ ID NO: 21123 - DNA, 18 bp, Artificial Sequence
  Description of Artificial Sequence: Synthetic oligonucleotide
aagagggctaacgactac

SEQ ID NO: 21124 - protein, 6 aa, Artificial Sequence
  Description of Artificial Sequence: Synthetic peptide
KRANDY

SEQ ID NO: 21125 - DNA, 27 bp, Artificial Sequence
  Description of Artificial Sequence: Synthetic oligonucleotide
agcagtggctggtacttttttgactac

SEQ ID NO: 21126 - protein, 9 aa, Artificial Sequence
  Description of Artificial Sequence: Synthetic peptide
SSGWYFFDY

SEQ ID NO: 21127 - DNA, 42 bp, Artificial Sequence; identical to SEQ ID NO: 20525
  Description of Artificial Sequence: Synthetic oligonucleotide

SEQ ID NO: 21128 - protein, 14 aa, Artificial Sequence
  Description of Artificial Sequence: Synthetic peptide
GELLEDYYFYGMDV

SEQ ID NO: 21129 - DNA, 57 bp, Artificial Sequence; identical to SEQ ID NO: 20749
  Description of Artificial Sequence: Synthetic oligonucleotide

SEQ ID NO: 21130 - protein, 19 aa, Artificial Sequence
  Description of Artificial Sequence: Synthetic peptide
DTGPIAARLAYYYYYAMDV

SEQ ID NO: 21131 - DNA, 30 bp, Artificial Sequence
  Description of Artificial Sequence: Synthetic oligonucleotide
accggttctagctgctgctattttgactac

SEQ ID NO: 21132 - protein, 10 aa, Artificial Sequence
  Description of Artificial Sequence: Synthetic peptide
TGSSCCYFDY

SEQ ID NO: 21133 - DNA, 24 bp, Artificial Sequence
  Description of Artificial Sequence: Synthetic oligonucleotide
gaattggggttccggtctgactac

SEQ ID NO: 21134 - protein, 8 aa, Artificial Sequence
  Description of Artificial Sequence: Synthetic peptide
ELGFRSDY

SEQ ID NO: 21135 - DNA, 18 bp, Artificial Sequence
  Description of Artificial Sequence: Synthetic oligonucleotide
gtgaatctctttgactac

SEQ ID NO: 21136 - protein, 6 aa, Artificial Sequence
  Description of Artificial Sequence: Synthetic peptide
VNLFDY

SEQ ID NO: 21137 - DNA, 24 bp, Artificial Sequence
  Description of Artificial Sequence: Synthetic oligonucleotide
gatggaactgggtcctttgactac

SEQ ID NO: 21138 - protein, 8 aa, Artificial Sequence
  Description of Artificial Sequence: Synthetic peptide
DGTGSFDY

SEQ ID NO: 21139 - DNA, 12 bp, Artificial Sequence
  Description of Artificial Sequence: Synthetic oligonucleotide
ctggggaactac

SEQ ID NO: 21140 - protein, 4 aa, Artificial Sequence
  Description of Artificial Sequence: Synthetic peptide
LGNY

SEQ ID NO: 21141 - DNA, 18 bp, Artificial Sequence
  Description of Artificial Sequence: Synthetic oligonucleotide
gtcaacggtatggacgtc

SEQ ID NO: 21142 - protein, 6 aa, Artificial Sequence
  Description of Artificial Sequence: Synthetic peptide
VNGMDV

SEQ ID NO: 21143 - DNA, 57 bp, Artificial Sequence; identical to SEQ ID NO: 20749
  Description of Artificial Sequence: Synthetic oligonucleotide

SEQ ID NO: 21144 - protein, 19 aa, Artificial Sequence
  Description of Artificial Sequence: Synthetic peptide
DTGPIAARLAYYYYYAMDV

SEQ ID NO: 21145 - DNA, 18 bp, Artificial Sequence
  Description of Artificial Sequence: Synthetic oligonucleotide
actaatgggtttgacttc

SEQ ID NO: 21146 - protein, 6 aa, Artificial Sequence
  Description of Artificial Sequence: Synthetic peptide
TNGFDF

SEQ ID NO: 21147 - DNA, 18 bp, Artificial Sequence
  Description of Artificial Sequence: Synthetic oligonucleotide
aaggctgggcttgatatc

SEQ ID NO: 21148 - protein, 6 aa, Artificial Sequence
  Description of Artificial Sequence: Synthetic peptide
KAGLDI

SEQ ID NO: 21149 - DNA, 18 bp, Artificial Sequence
  Description of Artificial Sequence: Synthetic oligonucleotide
actaacctctttgactac

SEQ ID NO: 21150 - protein, 6 aa, Artificial Sequence
  Description of Artificial Sequence: Synthetic peptide
TNLFDY

SEQ ID NO: 21151 - DNA, 27 bp, Artificial Sequence
  Description of Artificial Sequence: Synthetic oligonucleotide
ctggacaggggctggtcctttgactac

SEQ ID NO: 21152 - protein, 9 aa, Artificial Sequence
  Description of Artificial Sequence: Synthetic peptide
LDRGWSFDY

SEQ ID NO: 21153 - DNA, 36 bp, Artificial Sequence
  Description of Artificial Sequence: Synthetic oligonucleotide
agggggatagtgggagctactgaggcttttgatatc

SEQ ID NO: 21154 - protein, 12 aa, Artificial Sequence
  Description of Artificial Sequence: Synthetic peptide
RGIVGATEAFDI

SEQ ID NO: 21155 - DNA, 27 bp, Artificial Sequence
  Description of Artificial Sequence: Synthetic oligonucleotide
catggacaagactggggccttgactac

SEQ ID NO: 21156 - protein, 9 aa, Artificial Sequence
  Description of Artificial Sequence: Synthetic peptide
HGQDWGLDY

SEQ ID NO: 21157 - DNA, 12 bp, Artificial Sequence
  Description of Artificial Sequence: Synthetic oligonucleotide
ctgggtaactac

SEQ ID NO: 21158 - protein, 4 aa, Artificial Sequence
  Description of Artificial Sequence: Synthetic peptide
LGNY

SEQ ID NO: 21159 - DNA, 27 bp, Artificial Sequence
  Description of Artificial Sequence: Synthetic oligonucleotide
agcagtggctggtactactttgactac

SEQ ID NO: 21160 - protein, 9 aa, Artificial Sequence
  Description of Artificial Sequence: Synthetic peptide
SSGWYYFDY

SEQ ID NO: 21161 - DNA, 27 bp, Artificial Sequence
  Description of Artificial Sequence: Synthetic oligonucleotide
agcagtggctggtactactttgactac

SEQ ID NO: 21162 - protein, 9 aa, Artificial Sequence
  Description of Artificial Sequence: Synthetic peptide
SSGWYYFDY

SEQ ID NO: 21163 - DNA, 45 bp, Artificial Sequence; identical to SEQ ID NO: 20777
  Description of Artificial Sequence: Synthetic oligonucleotide

SEQ ID NO: 21164 - protein, 15 aa, Artificial Sequence
  Description of Artificial Sequence: Synthetic peptide
VYYYGSGSYYNEFDY

SEQ ID NO: 21165 - DNA, 45 bp, Artificial Sequence; identical to SEQ ID NO: 20777
  Description of Artificial Sequence: Synthetic oligonucleotide

SEQ ID NO: 21166 - protein, 15 aa, Artificial Sequence
  Description of Artificial Sequence: Synthetic peptide
VYYYGSGSYYNEFDY

SEQ ID NO: 21167 - DNA, 27 bp, Artificial Sequence
  Description of Artificial Sequence: Synthetic oligonucleotide
agcagtggctggtactactttgactac

SEQ ID NO: 21168 - protein, 9 aa, Artificial Sequence
  Description of Artificial Sequence: Synthetic peptide
SSGWYYFDY

SEQ ID NO: 21169 - DNA, 27 bp, Artificial Sequence
  Description of Artificial Sequence: Synthetic oligonucleotide
agcagtggctggtactactttgactac

SEQ ID NO: 21170 - protein, 9 aa, Artificial Sequence
  Description of Artificial Sequence: Synthetic peptide
SSGWYYFDY

SEQ ID NO: 21171 - DNA, 27 bp, Artificial Sequence
  Description of Artificial Sequence: Synthetic oligonucleotide
gatctgagtatgggcggtatggacgtc

SEQ ID NO: 21172 - protein, 9 aa, Artificial Sequence
  Description of Artificial Sequence: Synthetic peptide
DLSMGGMDV

SEQ ID NO: 21173 - DNA, 24 bp, Artificial Sequence
  Description of Artificial Sequence: Synthetic oligonucleotide
gatgttaccagctcgtttgactat

SEQ ID NO: 21174 - protein, 8 aa, Artificial Sequence
  Description of Artificial Sequence: Synthetic peptide
DVTSSFDY

SEQ ID NO: 21175 - DNA, 24 bp, Artificial Sequence
  Description of Artificial Sequence: Synthetic oligonucleotide
gatggtaccagctcgtttgactac

SEQ ID NO: 21176 - protein, 8 aa, Artificial Sequence
  Description of Artificial Sequence: Synthetic peptide
DGTSSFDY

SEQ ID NO: 21177 - DNA, 27 bp, Artificial Sequence
  Description of Artificial Sequence: Synthetic oligonucleotide
agcagtggctggtactactttgacttc

SEQ ID NO: 21178 - protein, 9 aa, Artificial Sequence
  Description of Artificial Sequence: Synthetic peptide
SSGWYYFDF

SEQ ID NO: 21179 - DNA, 42 bp, Artificial Sequence; identical to SEQ ID NO: 20551
  Description of Artificial Sequence: Synthetic oligonucleotide

SEQ ID NO: 21180 - protein, 14 aa, Artificial Sequence
  Description of Artificial Sequence: Synthetic peptide
EEYSSGWYDYGMDV

SEQ ID NO: 21181 - DNA, 42 bp, Artificial Sequence; identical to SEQ ID NO: 20551
  Description of Artificial Sequence: Synthetic oligonucleotide

SEQ ID NO: 21182 - protein, 14 aa, Artificial Sequence
  Description of Artificial Sequence: Synthetic peptide
EEYSSGWYDYGMDV

SEQ ID NO: 21183 - DNA, 27 bp, Artificial Sequence
  Description of Artificial Sequence: Synthetic oligonucleotide
gatgagaggctggggatttttgactac

SEQ ID NO: 21184 - protein, 9 aa, Artificial Sequence
  Description of Artificial Sequence: Synthetic peptide
DERLGIFDY

SEQ ID NO: 21185 - DNA, 30 bp, Artificial Sequence; identical to SEQ ID NO: 20507
  Description of Artificial Sequence: Synthetic oligonucleotide

SEQ ID NO: 21186 - protein, 10 aa, Artificial Sequence
  Description of Artificial Sequence: Synthetic peptide
ENSSSYYFDY

SEQ ID NO: 21187 - DNA, 27 bp, Artificial Sequence
  Description of Artificial Sequence: Synthetic oligonucleotide
agcagtggctggtactactttgactac

SEQ ID NO: 21188 - protein, 9 aa, Artificial Sequence
  Description of Artificial Sequence: Synthetic peptide
SSGWYYFDY

SEQ ID NO: 21189 - DNA, 15 bp, Artificial Sequence
  Description of Artificial Sequence: Synthetic oligonucleotide
gatcggggcagtgaa

SEQ ID NO: 21190 - protein, 5 aa, Artificial Sequence
  Description of Artificial Sequence: Synthetic peptide
DRGSE

SEQ ID NO: 21191 - DNA, 27 bp, Artificial Sequence
  Description of Artificial Sequence: Synthetic oligonucleotide
gaaaggagtgggagctattttgactac

SEQ ID NO: 21192 - protein, 9 aa, Artificial Sequence
  Description of Artificial Sequence: Synthetic peptide
ERSGSYFDY

SEQ ID NO: 21193 - DNA, 24 bp, Artificial Sequence
  Description of Artificial Sequence: Synthetic oligonucleotide
gagctaggattttccaatgactac

SEQ ID NO: 21194 - protein, 8 aa, Artificial Sequence
  Description of Artificial Sequence: Synthetic peptide
ELGFSNDY

SEQ ID NO: 21195 - DNA, 18 bp, Artificial Sequence
  Description of Artificial Sequence: Synthetic oligonucleotide
gtgacctcttttgactac

SEQ ID NO: 21196 - protein, 6 aa, Artificial Sequence
  Description of Artificial Sequence: Synthetic peptide
VTSFDY

SEQ ID NO: 21197 - DNA, 27 bp, Artificial Sequence
  Description of Artificial Sequence: Synthetic oligonucleotide
gaaaggagtgggagctattttgactac

SEQ ID NO: 21198 - protein, 9 aa, Artificial Sequence
  Description of Artificial Sequence: Synthetic peptide
ERSGSYFDY

SEQ ID NO: 21199 - DNA, 12 bp, Artificial Sequence
  Description of Artificial Sequence: Synthetic oligonucleotide
gatacaatctac

SEQ ID NO: 21200 - protein, 4 aa, Artificial Sequence
  Description of Artificial Sequence: Synthetic peptide
DTIY

SEQ ID NO: 21201 - DNA, 27 bp, Artificial Sequence
  Description of Artificial Sequence: Synthetic oligonucleotide
agcagtggctggaccctctttgactac

SEQ ID NO: 21202 - protein, 9 aa, Artificial Sequence
  Description of Artificial Sequence: Synthetic peptide
SSGWTLFDY

SEQ ID NO: 21203 - DNA, 27 bp, Artificial Sequence
  Description of Artificial Sequence: Synthetic oligonucleotide
gaaaggagtgggagctattttgactac

SEQ ID NO: 21204 - protein, 9 aa, Artificial Sequence
  Description of Artificial Sequence: Synthetic peptide
ERSGSYFDY

SEQ ID NO: 21205 - DNA, 12 bp, Artificial Sequence
  Description of Artificial Sequence: Synthetic oligonucleotide
gatacaatctac

SEQ ID NO: 21206 - protein, 4 aa, Artificial Sequence
  Description of Artificial Sequence: Synthetic peptide
DTIY

SEQ ID NO: 21207 - DNA, 27 bp, Artificial Sequence
  Description of Artificial Sequence: Synthetic oligonucleotide
cgaacgccctctgatgtttttgatatc

SEQ ID NO: 21208 - protein, 9 aa, Artificial Sequence
  Description of Artificial Sequence: Synthetic peptide
RTPSDVFDI

SEQ ID NO: 21209 - DNA, 36 bp, Artificial Sequence
  Description of Artificial Sequence: Synthetic oligonucleotide
cggtatgtcagaagctgggtgggaggtatggacgtc

SEQ ID NO: 21210 - protein, 12 aa, Artificial Sequence
  Description of Artificial Sequence: Synthetic peptide
RYVRSWVGGMDV

SEQ ID NO: 21211 - DNA, 42 bp, Artificial Sequence
  Description of Artificial Sequence: Synthetic oligonucleotide
gagaggtatagcagtggctggtacgactacggtatggacgtc

SEQ ID NO: 21212 - protein, 14 aa, Artificial Sequence
  Description of Artificial Sequence: Synthetic peptide
ERYSSGWYDYGMDV

SEQ ID NO: 21213 - DNA, 24 bp, Artificial Sequence
  Description of Artificial Sequence: Synthetic oligonucleotide
gaactaggattttccaccgactac

SEQ ID NO: 21214 - protein, 8 aa, Artificial Sequence
  Description of Artificial Sequence: Synthetic peptide
ELGFSTDY

SEQ ID NO: 21215 - DNA, 42 bp, Artificial Sequence
  Description of Artificial Sequence: Synthetic oligonucleotide
gaaaggtatagcagtggcttgtacgactacggtatggacgtc

SEQ ID NO: 21216 - protein, 14 aa, Artificial Sequence
  Description of Artificial Sequence: Synthetic peptide
ERYSSGLYDYGMDV

SEQ ID NO: 21217 - DNA, 27 bp, Artificial Sequence
  Description of Artificial Sequence: Synthetic oligonucleotide
cgaacgccctctgatgcttttgatatc

SEQ ID NO: 21218 - protein, 9 aa, Artificial Sequence
  Description of Artificial Sequence: Synthetic peptide
RTPSDAFDI

SEQ ID NO: 21219 - DNA, 42 bp, Artificial Sequence
  Description of Artificial Sequence: Synthetic oligonucleotide
gtcccgtatagcagcagctggtacgactacggtatggacgtc

SEQ ID NO: 21220 - protein, 14 aa, Artificial Sequence
  Description of Artificial Sequence: Synthetic peptide
VPYSSSWYDYGMDV

SEQ ID NO: 21221 - DNA, 21 bp, Artificial Sequence
  Description of Artificial Sequence: Synthetic oligonucleotide
ggggtggctataaagaactac

SEQ ID NO: 21222 - protein, 7 aa, Artificial Sequence
  Description of Artificial Sequence: Synthetic peptide
GVAIKNY

SEQ ID NO: 21223 - DNA, 24 bp, Artificial Sequence
  Description of Artificial Sequence: Synthetic oligonucleotide
gaactggggttcctctctgactac

SEQ ID NO: 21224 - protein, 8 aa, Artificial Sequence
  Description of Artificial Sequence: Synthetic peptide
ELGFLSDY

SEQ ID NO: 21225 - DNA, 42 bp, Artificial Sequence
  Description of Artificial Sequence: Synthetic oligonucleotide
gaaccatatagcagcagctggtacgactacggtatggacgtc

SEQ ID NO: 21226 - protein, 14 aa, Artificial Sequence
  Description of Artificial Sequence: Synthetic peptide
EPYSSSWYDYGMDV

SEQ ID NO: 21227 - DNA, 36 bp, Artificial Sequence
  Description of Artificial Sequence: Synthetic oligonucleotide
cggtatagcagcagctgggtggggggtatggacgtc

SEQ ID NO: 21228 - protein, 12 aa, Artificial Sequence
  Description of Artificial Sequence: Synthetic peptide
RYSSSWVGGMDV

SEQ ID NO: 21229 - DNA, 42 bp, Artificial Sequence; identical to SEQ ID NO: 21215
  Description of Artificial Sequence: Synthetic oligonucleotide

SEQ ID NO: 21230 - protein, 14 aa, Artificial Sequence
  Description of Artificial Sequence: Synthetic peptide
ERYSSGLYDYGMDV

SEQ ID NO: 21231 - DNA, 27 bp, Artificial Sequence
  Description of Artificial Sequence: Synthetic oligonucleotide
gaaaggagtgggagctattttgactac

SEQ ID NO: 21232 - protein, 9 aa, Artificial Sequence
  Description of Artificial Sequence: Synthetic peptide
ERSGSYFDY

SEQ ID NO: 21233 - DNA, 36 bp, Artificial Sequence
  Description of Artificial Sequence: Synthetic oligonucleotide
gatcgggggcagtggctcctaggcggtatggacgtc

SEQ ID NO: 21234 - protein, 12 aa, Artificial Sequence
  Description of Artificial Sequence: Synthetic peptide
DRGQWLLGGMDV

SEQ ID NO: 21235 - DNA, 45 bp, Artificial Sequence
  Description of Artificial Sequence: Synthetic oligonucleotide
agtggatacagctatgcttactactactactacggtatggacgtc

SEQ ID NO: 21236 - protein, 15 aa, Artificial Sequence
  Description of Artificial Sequence: Synthetic peptide
SGYSYAYYYYYGMDV

SEQ ID NO: 21237 - DNA, 33 bp, Artificial Sequence
  Description of Artificial Sequence: Synthetic oligonucleotide
gatctaatagcagcagctgggacgggagactac

SEQ ID NO: 21238 - protein, 11 aa, Artificial Sequence
  Description of Artificial Sequence: Synthetic peptide
DLIAAAGTGDY

SEQ ID NO: 21239 - DNA, 12 bp, Artificial Sequence
  Description of Artificial Sequence: Synthetic oligonucleotide
gatacaatctac

SEQ ID NO: 21240 - protein, 4 aa, Artificial Sequence
  Description of Artificial Sequence: Synthetic peptide
DTIY

SEQ ID NO: 21241 - DNA, 42 bp, Artificial Sequence; identical to SEQ ID NO: 21215
  Description of Artificial Sequence: Synthetic oligonucleotide

SEQ ID NO: 21242 - protein, 14 aa, Artificial Sequence
  Description of Artificial Sequence: Synthetic peptide
ERYSSGLYDYGMDV

SEQ ID NO: 21243 - DNA, 27 bp, Artificial Sequence
  Description of Artificial Sequence: Synthetic oligonucleotide
cgaacgccctctgatgtttttgatatc

SEQ ID NO: 21244 - protein, 9 aa, Artificial Sequence
  Description of Artificial Sequence: Synthetic peptide
RTPSDVFDI

SEQ ID NO: 21245 - DNA, 42 bp, Artificial Sequence; identical to SEQ ID NO: 21215
  Description of Artificial Sequence: Synthetic oligonucleotide

SEQ ID NO: 21246 - protein, 14 aa, Artificial Sequence
  Description of Artificial Sequence: Synthetic peptide
ERYSSGLYDYGMDV

SEQ ID NO: 21247 - DNA, 27 bp, Artificial Sequence
  Description of Artificial Sequence: Synthetic oligonucleotide
gaaaggagtgggagctattttgactac

SEQ ID NO: 21248 - protein, 9 aa, Artificial Sequence
  Description of Artificial Sequence: Synthetic peptide
ERSGSYFDY

SEQ ID NO: 21249 - DNA, 27 bp, Artificial Sequence
  Description of Artificial Sequence: Synthetic oligonucleotide
cgaacgccctctgatgcttttgatatc

SEQ ID NO: 21250 - protein, 9 aa, Artificial Sequence
  Description of Artificial Sequence: Synthetic peptide
RTPSDAFDI

SEQ ID NO: 21251 - DNA, 18 bp, Artificial Sequence
  Description of Artificial Sequence: Synthetic oligonucleotide
gtgacctcttttgactac

SEQ ID NO: 21252 - protein, 6 aa, Artificial Sequence
  Description of Artificial Sequence: Synthetic peptide
VTSFDY

SEQ ID NO: 21253 - DNA, 33 bp, Artificial Sequence
  Description of Artificial Sequence: Synthetic oligonucleotide
gatctaatagcagcaactgggacgggagactac

SEQ ID NO: 21254 - protein, 11 aa, Artificial Sequence
  Description of Artificial Sequence: Synthetic peptide
DLIAATGTGDY

SEQ ID NO: 21255 - DNA, 36 bp, Artificial Sequence
  Description of Artificial Sequence: Synthetic oligonucleotide
gatcgatacgatttttggagtggttactttgactac

SEQ ID NO: 21256 - protein, 12 aa, Artificial Sequence
  Description of Artificial Sequence: Synthetic peptide
DRYDFWSGYFDY

SEQ ID NO: 21257 - DNA, 42 bp, Artificial Sequence; identical to SEQ ID NO: 21215
  Description of Artificial Sequence: Synthetic oligonucleotide

SEQ ID NO: 21258 - protein, 14 aa, Artificial Sequence
  Description of Artificial Sequence: Synthetic peptide
ERYSSGLYDYGMDV

SEQ ID NO: 21259 - DNA, 24 bp, Artificial Sequence
  Description of Artificial Sequence: Synthetic oligonucleotide
gaactaggattttccaatgactac

SEQ ID NO: 21260 - protein, 8 aa, Artificial Sequence
  Description of Artificial Sequence: Synthetic peptide
ELGFSNDY

SEQ ID NO: 21261 - DNA, 42 bp, Artificial Sequence
  Description of Artificial Sequence: Synthetic oligonucleotide
gtcccgtatagcagcagttggtacgactacggtatggacgtc

SEQ ID NO: 21262 - protein, 14 aa, Artificial Sequence
  Description of Artificial Sequence: Synthetic peptide
VPYSSSWYDYGMDV

SEQ ID NO: 21263 - DNA, 27 bp, Artificial Sequence
  Description of Artificial Sequence: Synthetic oligonucleotide
gaaaggagtgggagctattttgactac

SEQ ID NO: 21264 - protein, 9 aa, Artificial Sequence
  Description of Artificial Sequence: Synthetic peptide
ERSGSYFDY

SEQ ID NO: 21265 - DNA, 24 bp, Artificial Sequence
  Description of Artificial Sequence: Synthetic oligonucleotide
gagctaggattttccaatgactac

SEQ ID NO: 21266 - protein, 8 aa, Artificial Sequence
  Description of Artificial Sequence: Synthetic peptide
ELGFSNDY

SEQ ID NO: 21267 - DNA, 24 bp, Artificial Sequence
  Description of Artificial Sequence: Synthetic oligonucleotide
gaactaggattttccaatgactac

SEQ ID NO: 21268 - protein, 8 aa, Artificial Sequence
  Description of Artificial Sequence: Synthetic peptide
ELGFSNDY

SEQ ID NO: 21269 - DNA, 36 bp, Artificial Sequence
  Description of Artificial Sequence: Synthetic oligonucleotide
cggtatagcagcagctggatgggaggtatggacgtc

SEQ ID NO: 21270 - protein, 12 aa, Artificial Sequence
  Description of Artificial Sequence: Synthetic peptide
RYSSSWMGGMDV

SEQ ID NO: 21271 - DNA, 12 bp, Artificial Sequence
  Description of Artificial Sequence: Synthetic oligonucleotide
gatacaatctac

SEQ ID NO: 21272 - protein, 4 aa, Artificial Sequence
  Description of Artificial Sequence: Synthetic peptide
DTIY

SEQ ID NO: 21273 - DNA, 24 bp, Artificial Sequence
  Description of Artificial Sequence: Synthetic oligonucleotide
gaactggggatgctctttgactac

SEQ ID NO: 21274 - protein, 8 aa, Artificial Sequence
  Description of Artificial Sequence: Synthetic peptide
ELGMLFDY

SEQ ID NO: 21275 - DNA, 36 bp, Artificial Sequence
  Description of Artificial Sequence: Synthetic oligonucleotide
cggtatagccgcagctgggtgggaggtatggacgtc

SEQ ID NO: 21276 - protein, 12 aa, Artificial Sequence
  Description of Artificial Sequence: Synthetic peptide
RYSRSWVGGMDV

SEQ ID NO: 21277 - DNA, 33 bp, Artificial Sequence
  Description of Artificial Sequence: Synthetic oligonucleotide
gatcttatagcagcagctggtacagttgactac

SEQ ID NO: 21278 - protein, 11 aa, Artificial Sequence
  Description of Artificial Sequence: Synthetic peptide
DLIAAAGTVDY

SEQ ID NO: 21279 - DNA, 36 bp, Artificial Sequence
  Description of Artificial Sequence: Synthetic oligonucleotide
gatcgggggcagtggctcataggcggtatggacgtc

SEQ ID NO: 21280 - protein, 12 aa, Artificial Sequence
  Description of Artificial Sequence: Synthetic peptide
DRGQWLIGGMDV

SEQ ID NO: 21281 - DNA, 36 bp, Artificial Sequence
  Description of Artificial Sequence: Synthetic oligonucleotide
cggtatagcagaagctgggtgggaggtatggacgtc

SEQ ID NO: 21282 - protein, 12 aa, Artificial Sequence
  Description of Artificial Sequence: Synthetic peptide
RYSRSWVGGMDV

SEQ ID NO: 21283 - DNA, 30 bp, Artificial Sequence
  Description of Artificial Sequence: Synthetic oligonucleotide
attatccgggagcagtgggcctttgactac

SEQ ID NO: 21284 - protein, 10 aa, Artificial Sequence
  Description of Artificial Sequence: Synthetic peptide
IIREQWAFDY

SEQ ID NO: 21285 - DNA, 12 bp, Artificial Sequence
  Description of Artificial Sequence: Synthetic oligonucleotide
gatacagtctac

SEQ ID NO: 21286 - protein, 4 aa, Artificial Sequence
  Description of Artificial Sequence: Synthetic peptide
DTVY

SEQ ID NO: 21287 - DNA, 24 bp, Artificial Sequence
  Description of Artificial Sequence: Synthetic oligonucleotide
gaattagggtgggaggctgactac

SEQ ID NO: 21288 - protein, 8 aa, Artificial Sequence
  Description of Artificial Sequence: Synthetic peptide
ELGWEADY

SEQ ID NO: 21289 - DNA, 36 bp, Artificial Sequence
  Description of Artificial Sequence: Synthetic oligonucleotide
cgtatagcagtggctgggaatgaggcttttgatatc

SEQ ID NO: 21290 - protein, 12 aa, Artificial Sequence
  Description of Artificial Sequence: Synthetic peptide
RIAVAGNEAFDI

SEQ ID NO: 21291 - DNA, 42 bp, Artificial Sequence
  Description of Artificial Sequence: Synthetic oligonucleotide
gagaggtatagcagcagctggtacgactacggtctggacgtc

SEQ ID NO: 21292 - protein, 14 aa, Artificial Sequence
  Description of Artificial Sequence: Synthetic peptide
ERYSSSWYDYGLDV

SEQ ID NO: 21293 - DNA, 36 bp, Artificial Sequence; identical to SEQ ID NO: 21289
  Description of Artificial Sequence: Synthetic oligonucleotide

SEQ ID NO: 21294 - protein, 12 aa, Artificial Sequence
  Description of Artificial Sequence: Synthetic peptide
RIAVAGNEAFDI

SEQ ID NO: 21295 - DNA, 27 bp, Artificial Sequence
  Description of Artificial Sequence: Synthetic oligonucleotide
tgtgggcgggagcagtggcttgactac

SEQ ID NO: 21296 - protein, 9 aa, Artificial Sequence
  Description of Artificial Sequence: Synthetic peptide
CGREQWLDY

SEQ ID NO: 21297 - DNA, 24 bp, Artificial Sequence
  Description of Artificial Sequence: Synthetic oligonucleotide
gaacttgcctggtacgaggactac

SEQ ID NO: 21298 - protein, 8 aa, Artificial Sequence
  Description of Artificial Sequence: Synthetic peptide
ELAWYEDY

SEQ ID NO: 21299 - DNA, 30 bp, Artificial Sequence
  Description of Artificial Sequence: Synthetic oligonucleotide
gcagtggctgcccctggtgtttttgatatc

SEQ ID NO: 21300 - protein, 10 aa, Artificial Sequence
  Description of Artificial Sequence: Synthetic peptide
AVAAPGVFDI

SEQ ID NO: 21301 - DNA, 24 bp, Artificial Sequence
  Description of Artificial Sequence: Synthetic oligonucleotide
gaactggggatgagatctgactac

SEQ ID NO: 21302 - protein, 8 aa, Artificial Sequence
  Description of Artificial Sequence: Synthetic peptide
ELGMRSDY

SEQ ID NO: 21303 - DNA, 30 bp, Artificial Sequence
  Description of Artificial Sequence: Synthetic oligonucleotide
gcagtggctgcccctggtgcttttgatatc

SEQ ID NO: 21304 - protein, 10 aa, Artificial Sequence
  Description of Artificial Sequence: Synthetic peptide
AVAAPGAFDI

SEQ ID NO: 21305 - DNA, 30 bp, Artificial Sequence; identical to SEQ ID NO: 21303
  Description of Artificial Sequence: Synthetic oligonucleotide

SEQ ID NO: 21306 - protein, 10 aa, Artificial Sequence
  Description of Artificial Sequence: Synthetic peptide
AVAAPGAFDI

SEQ ID NO: 21307 - DNA, 24 bp, Artificial Sequence
  Description of Artificial Sequence: Synthetic oligonucleotide
gaactggggttcctctctgactac

SEQ ID NO: 21308 - protein, 8 aa, Artificial Sequence
  Description of Artificial Sequence: Synthetic peptide
ELGFLSDY

SEQ ID NO: 21309 - DNA, 36 bp, Artificial Sequence; identical to SEQ ID NO: 20135
  Description of Artificial Sequence: Synthetic oligonucleotide

SEQ ID NO: 21310 - protein, 12 aa, Artificial Sequence
  Description of Artificial Sequence: Synthetic peptide
RYSSSWSGGMDV

SEQ ID NO: 21311 - DNA, 36 bp, Artificial Sequence
  Description of Artificial Sequence: Synthetic oligonucleotide
gctatagcagcggctggtgcccactattttgactac

SEQ ID NO: 21312 - protein, 12 aa, Artificial Sequence
  Description of Artificial Sequence: Synthetic peptide
AIAAAGAHYFDY

SEQ ID NO: 21313 - DNA, 36 bp, Artificial Sequence
  Description of Artificial Sequence: Synthetic oligonucleotide
aggtatagcagcagctggtcgggcggaatggacgtc

SEQ ID NO: 21314 - protein, 12 aa, Artificial Sequence
  Description of Artificial Sequence: Synthetic peptide
RYSSSWSGGMDV

SEQ ID NO: 21315 - DNA, 36 bp, Artificial Sequence
  Description of Artificial Sequence: Synthetic oligonucleotide
gcaagggcagtggctgggtcacactggttcgacccc

SEQ ID NO: 21316 - protein, 12 aa, Artificial Sequence
  Description of Artificial Sequence: Synthetic peptide
ARAVAGSHWFDP

SEQ ID NO: 21317 - DNA, 24 bp, Artificial Sequence
  Description of Artificial Sequence: Synthetic oligonucleotide
gatctggggatgatcgaggactac

SEQ ID NO: 21318 - protein, 8 aa, Artificial Sequence
  Description of Artificial Sequence: Synthetic peptide
DLGMIEDY

SEQ ID NO: 21319 - DNA, 36 bp, Artificial Sequence; identical to SEQ ID NO: 20135
  Description of Artificial Sequence: Synthetic oligonucleotide

SEQ ID NO: 21320 - protein, 12 aa, Artificial Sequence
  Description of Artificial Sequence: Synthetic peptide
RYSSSWSGGMDV

SEQ ID NO: 21321 - DNA, 36 bp, Artificial Sequence; identical to SEQ ID NO: 20135
  Description of Artificial Sequence: Synthetic oligonucleotide

SEQ ID NO: 21322 - protein, 12 aa, Artificial Sequence
  Description of Artificial Sequence: Synthetic peptide
RYSSSWSGGMDV

SEQ ID NO: 21323 - DNA, 24 bp, Artificial Sequence
  Description of Artificial Sequence: Synthetic oligonucleotide
gacggtaccagcagctttgacttc

SEQ ID NO: 21324 - protein, 8 aa, Artificial Sequence
  Description of Artificial Sequence: Synthetic peptide
DGTSSFDF

SEQ ID NO: 21325 - DNA, 36 bp, Artificial Sequence
  Description of Artificial Sequence: Synthetic oligonucleotide
cgtatagcagtggctgggaatgatgcttttgatatc

SEQ ID NO: 21326 - protein, 12 aa, Artificial Sequence
  Description of Artificial Sequence: Synthetic peptide
RIAVAGNDAFDI

SEQ ID NO: 21327 - DNA, 12 bp, Artificial Sequence
  Description of Artificial Sequence: Synthetic oligonucleotide
gatacaatctac

SEQ ID NO: 21328 - protein, 4 aa, Artificial Sequence
  Description of Artificial Sequence: Synthetic peptide
DTIY

SEQ ID NO: 21329 - DNA, 36 bp, Artificial Sequence; identical to SEQ ID NO: 21289
  Description of Artificial Sequence: Synthetic oligonucleotide

SEQ ID NO: 21330 - protein, 12 aa, Artificial Sequence
  Description of Artificial Sequence: Synthetic peptide
RIAVAGNEAFDI

SEQ ID NO: 21331 - DNA, 18 bp, Artificial Sequence
  Description of Artificial Sequence: Synthetic oligonucleotide
gtagcaacttttgactac

SEQ ID NO: 21332 - protein, 6 aa, Artificial Sequence
  Description of Artificial Sequence: Synthetic peptide
VATFDY

SEQ ID NO: 21333 - DNA, 36 bp, Artificial Sequence; identical to SEQ ID NO: 21289
  Description of Artificial Sequence: Synthetic oligonucleotide

SEQ ID NO: 21334 - protein, 12 aa, Artificial Sequence
  Description of Artificial Sequence: Synthetic peptide
RIAVAGNEAFDI

SEQ ID NO: 21335 - DNA, 48 bp, Artificial Sequence
  Description of Artificial Sequence: Synthetic oligonucleotide
ggagggcagctcggcgggtttaactactactactacggtatggacgtc

SEQ ID NO: 21336 - protein, 16 aa, Artificial Sequence
  Description of Artificial Sequence: Synthetic peptide
GGQLGGFNYYYYGMDV

SEQ ID NO: 21337 - DNA, 51 bp, Artificial Sequence
  Description of Artificial Sequence: Synthetic oligonucleotide
gatcggagcatagtagtggctggtccctgggactactacggtatggacgtc

SEQ ID NO: 21338 - protein, 17 aa, Artificial Sequence
  Description of Artificial Sequence: Synthetic peptide
DRSIVVAGPWDYYGMDV

SEQ ID NO: 21339 - DNA, 36 bp, Artificial Sequence
  Description of Artificial Sequence: Synthetic oligonucleotide
aggtatagcagcagttggtcgggcggtatggacgtc

SEQ ID NO: 21340 - protein, 12 aa, Artificial Sequence
  Description of Artificial Sequence: Synthetic peptide
RYSSSWSGGMDV

SEQ ID NO: 21341 - DNA, 33 bp, Artificial Sequence
  Description of Artificial Sequence: Synthetic oligonucleotide
gggataactggatcacacggtgcttttgatatc

SEQ ID NO: 21342 - protein, 11 aa, Artificial Sequence
  Description of Artificial Sequence: Synthetic peptide
GITGSHGAFDI

SEQ ID NO: 21343 - DNA, 24 bp, Artificial Sequence
  Description of Artificial Sequence: Synthetic oligonucleotide
gaactgggatttctctctgactac

SEQ ID NO: 21344 - protein, 8 aa, Artificial Sequence
  Description of Artificial Sequence: Synthetic peptide
ELGFLSDY

SEQ ID NO: 21345 - DNA, 18 bp, Artificial Sequence
  Description of Artificial Sequence: Synthetic oligonucleotide
gtgactgcttttgactac

SEQ ID NO: 21346 - protein, 6 aa, Artificial Sequence
  Description of Artificial Sequence: Synthetic peptide
VTAFDY

SEQ ID NO: 21347 - DNA, 36 bp, Artificial Sequence; identical to SEQ ID NO: 21315
  Description of Artificial Sequence: Synthetic oligonucleotide

SEQ ID NO: 21348 - protein, 12 aa, Artificial Sequence
  Description of Artificial Sequence: Synthetic peptide
ARAVAGSHWFDP

SEQ ID NO: 21349 - DNA, 15 bp, Artificial Sequence
  Description of Artificial Sequence: Synthetic oligonucleotide
gctcgccttgactac

SEQ ID NO: 21350 - protein, 5 aa, Artificial Sequence
  Description of Artificial Sequence: Synthetic peptide
ARLDY

SEQ ID NO: 21351 - DNA, 24 bp, Artificial Sequence
  Description of Artificial Sequence: Synthetic oligonucleotide
gacggtaccagcagctttgacttc

SEQ ID NO: 21352 - protein, 8 aa, Artificial Sequence
  Description of Artificial Sequence: Synthetic peptide
DGTSSFDF

SEQ ID NO: 21353 - DNA, 48 bp, Artificial Sequence
  Description of Artificial Sequence: Synthetic oligonucleotide
ggagggcagctcggcggctttaacttctactactacggtatggacgtc

SEQ ID NO: 21354 - protein, 16 aa, Artificial Sequence
  Description of Artificial Sequence: Synthetic peptide
GGQLGGFNFYYYGMDV

SEQ ID NO: 21355 - DNA, 24 bp, Artificial Sequence
  Description of Artificial Sequence: Synthetic oligonucleotide
gatggcacctcgtcctttgactac

SEQ ID NO: 21356 - protein, 8 aa, Artificial Sequence
  Description of Artificial Sequence: Synthetic peptide
DGTSSFDY

SEQ ID NO: 21357 - DNA, 24 bp, Artificial Sequence
  Description of Artificial Sequence: Synthetic oligonucleotide
gagctgggatttctctctgactac

SEQ ID NO: 21358 - protein, 8 aa, Artificial Sequence
  Description of Artificial Sequence: Synthetic peptide
ELGFLSDY

SEQ ID NO: 21359 - DNA, 36 bp, Artificial Sequence; identical to SEQ ID NO: 21325
  Description of Artificial Sequence: Synthetic oligonucleotide

SEQ ID NO: 21360 - protein, 12 aa, Artificial Sequence
  Description of Artificial Sequence: Synthetic peptide
RIAVAGNDAFDI

SEQ ID NO: 21361 - DNA, 24 bp, Artificial Sequence
  Description of Artificial Sequence: Synthetic oligonucleotide
gagctgggatttctctctgactac

SEQ ID NO: 21362 - protein, 8 aa, Artificial Sequence
  Description of Artificial Sequence: Synthetic peptide
ELGFLSDY

SEQ ID NO: 21363 - DNA, 24 bp, Artificial Sequence
  Description of Artificial Sequence: Synthetic oligonucleotide
gaactggggttcctctctgacttc

SEQ ID NO: 21364 - protein, 8 aa, Artificial Sequence
  Description of Artificial Sequence: Synthetic peptide
ELGFLSDF

SEQ ID NO: 21365 - DNA, 24 bp, Artificial Sequence
  Description of Artificial Sequence: Synthetic oligonucleotide
gatggcacctcgtcctttgactac

SEQ ID NO: 21366 - protein, 8 aa, Artificial Sequence
  Description of Artificial Sequence: Synthetic peptide
DGTSSFDY

SEQ ID NO: 21367 - DNA, 24 bp, Artificial Sequence
  Description of Artificial Sequence: Synthetic oligonucleotide
gatctggggatgatcgaggacttc

SEQ ID NO: 21368 - protein, 8 aa, Artificial Sequence
  Description of Artificial Sequence: Synthetic peptide
DLGMIEDF

SEQ ID NO: 21369 - DNA, 27 bp, Artificial Sequence
  Description of Artificial Sequence: Synthetic oligonucleotide
aatgggcgagagcagtggcttgactac

SEQ ID NO: 21370 - protein, 9 aa, Artificial Sequence
  Description of Artificial Sequence: Synthetic peptide
NGREQWLDY

SEQ ID NO: 21371 - DNA, 18 bp, Artificial Sequence
  Description of Artificial Sequence: Synthetic oligonucleotide
gttagcagtaatgactac

SEQ ID NO: 21372 - protein, 6 aa, Artificial Sequence
  Description of Artificial Sequence: Synthetic peptide
VSSNDY

SEQ ID NO: 21373 - DNA, 36 bp, Artificial Sequence
  Description of Artificial Sequence: Synthetic oligonucleotide
aggtcagcagctcggccgggctacggtatggacgtc

SEQ ID NO: 21374 - protein, 12 aa, Artificial Sequence
  Description of Artificial Sequence: Synthetic peptide
RSAARPGYGMDV

SEQ ID NO: 21375 - DNA, 24 bp, Artificial Sequence
  Description of Artificial Sequence: Synthetic oligonucleotide
gagctgggatttctctctgactac

SEQ ID NO: 21376 - protein, 8 aa, Artificial Sequence
  Description of Artificial Sequence: Synthetic peptide
ELGFLSDY

SEQ ID NO: 21377 - DNA, 36 bp, Artificial Sequence; identical to SEQ ID NO: 20135
  Description of Artificial Sequence: Synthetic oligonucleotide

SEQ ID NO: 21378 - protein, 12 aa, Artificial Sequence
  Description of Artificial Sequence: Synthetic peptide
RYSSSWSGGMDV

SEQ ID NO: 21379 - DNA, 36 bp, Artificial Sequence
  Description of Artificial Sequence: Synthetic oligonucleotide
gattctctgtatagcagcagctggttgtttgactac

SEQ ID NO: 21380 - protein, 12 aa, Artificial Sequence
  Description of Artificial Sequence: Synthetic peptide
DSLYSSSWLFDY

SEQ ID NO: 21381 - DNA, 24 bp, Artificial Sequence
  Description of Artificial Sequence: Synthetic oligonucleotide
gatggcacctcgtcctttgactac

SEQ ID NO: 21382 - protein, 8 aa, Artificial Sequence
  Description of Artificial Sequence: Synthetic peptide
DGTSSFDY

SEQ ID NO: 21383 - DNA, 18 bp, Artificial Sequence
  Description of Artificial Sequence: Synthetic oligonucleotide
gtcaactcctttgactac

SEQ ID NO: 21384 - protein, 6 aa, Artificial Sequence
  Description of Artificial Sequence: Synthetic peptide
VNSFDY

SEQ ID NO: 21385 - DNA, 15 bp, Artificial Sequence
  Description of Artificial Sequence: Synthetic oligonucleotide
gatcggggcagcacc

SEQ ID NO: 21386 - protein, 5 aa, Artificial Sequence
  Description of Artificial Sequence: Synthetic peptide
DRGST

SEQ ID NO: 21387 - DNA, 24 bp, Artificial Sequence
  Description of Artificial Sequence: Synthetic oligonucleotide
ggccttggctttacgggagactac

SEQ ID NO: 21388 - protein, 8 aa, Artificial Sequence
  Description of Artificial Sequence: Synthetic peptide
GLGFTGDY

SEQ ID NO: 21389 - DNA, 33 bp, Artificial Sequence
  Description of Artificial Sequence: Synthetic oligonucleotide
aaggtcgtggatacagccatggctcttgactac

SEQ ID NO: 21390 - protein, 11 aa, Artificial Sequence
  Description of Artificial Sequence: Synthetic peptide
KVVDTAMALDY

SEQ ID NO: 21391 - DNA, 36 bp, Artificial Sequence
  Description of Artificial Sequence: Synthetic oligonucleotide
cggggagcagctcgtcctggctacggtatggacgtc

SEQ ID NO: 21392 - protein, 12 aa, Artificial Sequence
  Description of Artificial Sequence: Synthetic peptide
RGAARPGYGMDV

SEQ ID NO: 21393 - DNA, 18 bp, Artificial Sequence
  Description of Artificial Sequence: Synthetic oligonucleotide
gtggccctttttgactac

SEQ ID NO: 21394 - protein, 6 aa, Artificial Sequence
  Description of Artificial Sequence: Synthetic peptide
VALFDY

SEQ ID NO: 21395 - DNA, 33 bp, Artificial Sequence
  Description of Artificial Sequence: Synthetic oligonucleotide
cctctagtgggagcccatgatgcttttgaaatc

SEQ ID NO: 21396 - protein, 11 aa, Artificial Sequence
  Description of Artificial Sequence: Synthetic peptide
PLVGAHDAFEI

SEQ ID NO: 21397 - DNA, 24 bp, Artificial Sequence
  Description of Artificial Sequence: Synthetic oligonucleotide
gaactggggatgacgtctgactac

SEQ ID NO: 21398 - protein, 8 aa, Artificial Sequence
  Description of Artificial Sequence: Synthetic peptide
ELGMTSDY

SEQ ID NO: 21399 - DNA, 36 bp, Artificial Sequence
  Description of Artificial Sequence: Synthetic oligonucleotide
cgacgggcagctcgtccagggtacggtatggacgtc

SEQ ID NO: 21400 - protein, 12 aa, Artificial Sequence
  Description of Artificial Sequence: Synthetic peptide
RRAARPGYGMDV

SEQ ID NO: 21401 - DNA, 24 bp, Artificial Sequence
  Description of Artificial Sequence: Synthetic oligonucleotide
gacggtaccagcagctttgactac

SEQ ID NO: 21402 - protein, 8 aa, Artificial Sequence
  Description of Artificial Sequence: Synthetic peptide
DGTSSFDY

SEQ ID NO: 21403 - DNA, 24 bp, Artificial Sequence
  Description of Artificial Sequence: Synthetic oligonucleotide
gcccgtattgggtactttgactcc

SEQ ID NO: 21404 - protein, 8 aa, Artificial Sequence
  Description of Artificial Sequence: Synthetic peptide
ARIGYFDS

SEQ ID NO: 21405 - DNA, 24 bp, Artificial Sequence
  Description of Artificial Sequence: Synthetic oligonucleotide
gaactgggatttctctctgacttc

SEQ ID NO: 21406 - protein, 8 aa, Artificial Sequence
  Description of Artificial Sequence: Synthetic peptide
ELGFLSDF

SEQ ID NO: 21407 - DNA, 24 bp, Artificial Sequence
  Description of Artificial Sequence: Synthetic oligonucleotide
gaactggggttcctttctgattat

SEQ ID NO: 21408 - protein, 8 aa, Artificial Sequence
  Description of Artificial Sequence: Synthetic peptide
ELGFLSDY

SEQ ID NO: 21409 - DNA, 36 bp, Artificial Sequence
  Description of Artificial Sequence: Synthetic oligonucleotide
ctggggaaggactactactactacggtatggacgtc

SEQ ID NO: 21410 - protein, 12 aa, Artificial Sequence
  Description of Artificial Sequence: Synthetic peptide
LGKDYYYYGMDV

SEQ ID NO: 21411 - DNA, 15 bp, Artificial Sequence
  Description of Artificial Sequence: Synthetic oligonucleotide
atgactacagtaatt

SEQ ID NO: 21412 - protein, 5 aa, Artificial Sequence
  Description of Artificial Sequence: Synthetic peptide
MTTVI

SEQ ID NO: 21413 - DNA, 36 bp, Artificial Sequence; identical to SEQ ID NO: 20135
  Description of Artificial Sequence: Synthetic oligonucleotide

SEQ ID NO: 21414 - protein, 12 aa, Artificial Sequence
  Description of Artificial Sequence: Synthetic peptide
RYSSSWSGGMDV

SEQ ID NO: 21415 - DNA, 24 bp, Artificial Sequence
  Description of Artificial Sequence: Synthetic oligonucleotide
gaactggggatgacgtctgactac

SEQ ID NO: 21416 - protein, 8 aa, Artificial Sequence
  Description of Artificial Sequence: Synthetic peptide
ELGMTSDY

SEQ ID NO: 21417 - DNA, 24 bp, Artificial Sequence
  Description of Artificial Sequence: Synthetic oligonucleotide
gaattggggttcctctctgactac

SEQ ID NO: 21418 - protein, 8 aa, Artificial Sequence
  Description of Artificial Sequence: Synthetic peptide
ELGFLSDY

SEQ ID NO: 21419 - DNA, 24 bp, Artificial Sequence
  Description of Artificial Sequence: Synthetic oligonucleotide
gatggcagatcgtcctttgactac

SEQ ID NO: 21420 - protein, 8 aa, Artificial Sequence
  Description of Artificial Sequence: Synthetic peptide
DGRSSFDY

SEQ ID NO: 21421 - DNA, 36 bp, Artificial Sequence
  Description of Artificial Sequence: Synthetic oligonucleotide
gatcacggtatagtgggaactatttactttgactac

SEQ ID NO: 21422 - protein, 12 aa, Artificial Sequence
  Description of Artificial Sequence: Synthetic peptide
DHGIVGTIYFDY

SEQ ID NO: 21423 - DNA, 36 bp, Artificial Sequence; identical to SEQ ID NO: 20135
  Description of Artificial Sequence: Synthetic oligonucleotide

SEQ ID NO: 21424 - protein, 12 aa, Artificial Sequence
  Description of Artificial Sequence: Synthetic peptide
RYSSSWSGGMDV

SEQ ID NO: 21425 - DNA, 36 bp, Artificial Sequence; identical to SEQ ID NO: 20135
  Description of Artificial Sequence: Synthetic oligonucleotide

SEQ ID NO: 21426 - protein, 12 aa, Artificial Sequence
  Description of Artificial Sequence: Synthetic peptide
RYSSSWSGGMDV

SEQ ID NO: 21427 - DNA, 24 bp, Artificial Sequence
  Description of Artificial Sequence: Synthetic oligonucleotide
gaactgggatttctctctgactac

SEQ ID NO: 21428 - protein, 8 aa, Artificial Sequence
  Description of Artificial Sequence: Synthetic peptide
ELGFLSDY

SEQ ID NO: 21429 - DNA, 12 bp, Artificial Sequence
  Description of Artificial Sequence: Synthetic oligonucleotide
gggactgactac

SEQ ID NO: 21430 - protein, 4 aa, Artificial Sequence
  Description of Artificial Sequence: Synthetic peptide
GTDY

SEQ ID NO: 21431 - DNA, 15 bp, Artificial Sequence
  Description of Artificial Sequence: Synthetic oligonucleotide
gaatggtttgactac

SEQ ID NO: 21432 - protein, 5 aa, Artificial Sequence
  Description of Artificial Sequence: Synthetic peptide
EWFDY

SEQ ID NO: 21433 - DNA, 36 bp, Artificial Sequence; identical to SEQ ID NO: 20135
  Description of Artificial Sequence: Synthetic oligonucleotide

SEQ ID NO: 21434 - protein, 12 aa, Artificial Sequence
  Description of Artificial Sequence: Synthetic peptide
RYSSSWSGGMDV

SEQ ID NO: 21435 - DNA, 36 bp, Artificial Sequence; identical to SEQ ID NO: 21399
  Description of Artificial Sequence: Synthetic oligonucleotide

SEQ ID NO: 21436 - protein, 12 aa, Artificial Sequence
  Description of Artificial Sequence: Synthetic peptide
RRAARPGYGMDV

SEQ ID NO: 21437 - DNA, 27 bp, Artificial Sequence
  Description of Artificial Sequence: Synthetic oligonucleotide
gacgagcagctcgggacctttgactac

SEQ ID NO: 21438 - protein, 9 aa, Artificial Sequence
  Description of Artificial Sequence: Synthetic peptide
DEQLGTFDY

SEQ ID NO: 21439 - DNA, 36 bp, Artificial Sequence; identical to SEQ ID NO: 21315
  Description of Artificial Sequence: Synthetic oligonucleotide

SEQ ID NO: 21440 - protein, 12 aa, Artificial Sequence
  Description of Artificial Sequence: Synthetic peptide
ARAVAGSHWFDP

SEQ ID NO: 21441 - DNA, 24 bp, Artificial Sequence
  Description of Artificial Sequence: Synthetic oligonucleotide
gaagtggggttcctgaatgactac

SEQ ID NO: 21442 - protein, 8 aa, Artificial Sequence
  Description of Artificial Sequence: Synthetic peptide
EVGFLNDY

SEQ ID NO: 21443 - DNA, 42 bp, Artificial Sequence
  Description of Artificial Sequence: Synthetic oligonucleotide
gatcgaggagatggttactacttctactacggtatggacgtc

SEQ ID NO: 21444 - protein, 14 aa, Artificial Sequence
  Description of Artificial Sequence: Synthetic peptide
DRGDGYYFYYGMDV

SEQ ID NO: 21445 - DNA, 45 bp, Artificial Sequence
  Description of Artificial Sequence: Synthetic oligonucleotide
gggagaggtcgatatagtgactacggtcatgatgcttttgatatc

SEQ ID NO: 21446 - protein, 15 aa, Artificial Sequence
  Description of Artificial Sequence: Synthetic peptide
GRGRYSDYGHDAFDI

SEQ ID NO: 21447 - DNA, 27 bp, Artificial Sequence
  Description of Artificial Sequence: Synthetic oligonucleotide
agcagtggctggtacgtttttgactac

SEQ ID NO: 21448 - protein, 9 aa, Artificial Sequence
  Description of Artificial Sequence: Synthetic peptide
SSGWYVFDY

SEQ ID NO: 21449 - DNA, 15 bp, Artificial Sequence
  Description of Artificial Sequence: Synthetic oligonucleotide
gatcggggcagcagc

SEQ ID NO: 21450 - protein, 5 aa, Artificial Sequence
  Description of Artificial Sequence: Synthetic peptide
DRGSS

SEQ ID NO: 21451 - DNA, 33 bp, Artificial Sequence; identical to SEQ ID NO: 21389
  Description of Artificial Sequence: Synthetic oligonucleotide

SEQ ID NO: 21452 - protein, 11 aa, Artificial Sequence
  Description of Artificial Sequence: Synthetic peptide
KVVDTAMALDY

SEQ ID NO: 21453 - DNA, 18 bp, Artificial Sequence
  Description of Artificial Sequence: Synthetic oligonucleotide
gtggctacttttgactac

SEQ ID NO: 21454 - protein, 6 aa, Artificial Sequence
  Description of Artificial Sequence: Synthetic peptide
VATFDY

SEQ ID NO: 21455 - DNA, 24 bp, Artificial Sequence
  Description of Artificial Sequence: Synthetic oligonucleotide
gatggcacctcgtcttttgactac

SEQ ID NO: 21456 - protein, 8 aa, Artificial Sequence
  Description of Artificial Sequence: Synthetic peptide
DGTSSFDY

SEQ ID NO: 21457 - DNA, 27 bp, Artificial Sequence
  Description of Artificial Sequence: Synthetic oligonucleotide
gacgagcagctcgggacctttgactac

SEQ ID NO: 21458 - protein, 9 aa, Artificial Sequence
  Description of Artificial Sequence: Synthetic peptide
DEQLGTFDY

SEQ ID NO: 21459 - DNA, 24 bp, Artificial Sequence
  Description of Artificial Sequence: Synthetic oligonucleotide
gatggcacctcgtcttttgactat

SEQ ID NO: 21460 - protein, 8 aa, Artificial Sequence
  Description of Artificial Sequence: Synthetic peptide
DGTSSFDY

SEQ ID NO: 21461 - DNA, 33 bp, Artificial Sequence
  Description of Artificial Sequence: Synthetic oligonucleotide
gagggagcaactcgtccgacgggttttgactac

SEQ ID NO: 21462 - protein, 11 aa, Artificial Sequence
  Description of Artificial Sequence: Synthetic peptide
EGATRPTGFDY

SEQ ID NO: 21463 - DNA, 48 bp, Artificial Sequence; identical to SEQ ID NO: 21335
  Description of Artificial Sequence: Synthetic oligonucleotide

SEQ ID NO: 21464 - protein, 16 aa, Artificial Sequence
  Description of Artificial Sequence: Synthetic peptide
GGQLGGFNYYYYGMDV

SEQ ID NO: 21465 - DNA, 24 bp, Artificial Sequence
  Description of Artificial Sequence: Synthetic oligonucleotide
gaactggggatgaacggagactac

SEQ ID NO: 21466 - protein, 8 aa, Artificial Sequence
  Description of Artificial Sequence: Synthetic peptide
ELGMNGDY

SEQ ID NO: 21467 - DNA, 36 bp, Artificial Sequence
  Description of Artificial Sequence: Synthetic oligonucleotide
cggtatagcagcagctgggacgggggtatggacgtc

SEQ ID NO: 21468 - protein, 12 aa, Artificial Sequence
  Description of Artificial Sequence: Synthetic peptide
RYSSSWDGGMDV

SEQ ID NO: 21469 - DNA, 24 bp, Artificial Sequence
  Description of Artificial Sequence: Synthetic oligonucleotide
gatgttctggacccttttgactac

SEQ ID NO: 21470 - protein, 8 aa, Artificial Sequence
  Description of Artificial Sequence: Synthetic peptide
DVLDPFDY

SEQ ID NO: 21471 - DNA, 36 bp, Artificial Sequence
  Description of Artificial Sequence: Synthetic oligonucleotide
aggtatagcagaagctggacgggaggcatggacgtc

SEQ ID NO: 21472 - protein, 12 aa, Artificial Sequence
  Description of Artificial Sequence: Synthetic peptide
RYSRSWTGGMDV

SEQ ID NO: 21473 - DNA, 24 bp, Artificial Sequence
  Description of Artificial Sequence: Synthetic oligonucleotide
gaactggggatgaccggagactac

SEQ ID NO: 21474 - protein, 8 aa, Artificial Sequence
  Description of Artificial Sequence: Synthetic peptide
ELGMTGDY

SEQ ID NO: 21475 - DNA, 48 bp, Artificial Sequence
  Description of Artificial Sequence: Synthetic oligonucleotide
gggggcctactgggagctaccaactactattattacggtatggacgtc

SEQ ID NO: 21476 - protein, 16 aa, Artificial Sequence
  Description of Artificial Sequence: Synthetic peptide
GGLLGATNYYYYGMDV

SEQ ID NO: 21477 - DNA, 27 bp, Artificial Sequence
  Description of Artificial Sequence: Synthetic oligonucleotide
agcagtggctggtacttctttgactac

SEQ ID NO: 21478 - protein, 9 aa, Artificial Sequence
  Description of Artificial Sequence: Synthetic peptide
SSGWYFFDY

SEQ ID NO: 21479 - DNA, 18 bp, Artificial Sequence
  Description of Artificial Sequence: Synthetic oligonucleotide
ctaactggatttgactat

SEQ ID NO: 21480 - protein, 6 aa, Artificial Sequence
  Description of Artificial Sequence: Synthetic peptide
LTGFDY

SEQ ID NO: 21481 - DNA, 12 bp, Artificial Sequence
  Description of Artificial Sequence: Synthetic oligonucleotide
ttggggattgac

SEQ ID NO: 21482 - protein, 4 aa, Artificial Sequence
  Description of Artificial Sequence: Synthetic peptide
LGID

SEQ ID NO: 21483 - DNA, 27 bp, Artificial Sequence
  Description of Artificial Sequence: Synthetic oligonucleotide
ctggacagtggctggtcgtttgactac

SEQ ID NO: 21484 - protein, 9 aa, Artificial Sequence
  Description of Artificial Sequence: Synthetic peptide
LDSGWSFDY

SEQ ID NO: 21485 - DNA, 36 bp, Artificial Sequence
  Description of Artificial Sequence: Synthetic oligonucleotide
tttttcggtatagtgggagccgggtactttgactac

SEQ ID NO: 21486 - protein, 12 aa, Artificial Sequence
  Description of Artificial Sequence: Synthetic peptide
FFGIVGAGYFDY

SEQ ID NO: 21487 - DNA, 36 bp, Artificial Sequence
  Description of Artificial Sequence: Synthetic oligonucleotide
ctggggaaggactaccactactacggtatggacgtc

SEQ ID NO: 21488 - protein, 12 aa, Artificial Sequence
  Description of Artificial Sequence: Synthetic peptide
LGKDYHYYGMDV

SEQ ID NO: 21489 - DNA, 36 bp, Artificial Sequence
  Description of Artificial Sequence: Synthetic oligonucleotide
aggtatagcagaagctggacgggaggtatggacgtc

SEQ ID NO: 21490 - protein, 12 aa, Artificial Sequence
  Description of Artificial Sequence: Synthetic peptide
RYSRSWTGGMDV

SEQ ID NO: 21491 - DNA, 36 bp, Artificial Sequence
  Description of Artificial Sequence: Synthetic oligonucleotide
gagggaaaaactgggggggtttcttactttgactac

SEQ ID NO: 21492 - protein, 12 aa, Artificial Sequence
  Description of Artificial Sequence: Synthetic peptide
EGKTGGVSYFDY

SEQ ID NO: 21493 - DNA, 36 bp, Artificial Sequence; identical to SEQ ID NO: 21491
  Description of Artificial Sequence: Synthetic oligonucleotide

SEQ ID NO: 21494 - protein, 12 aa, Artificial Sequence
  Description of Artificial Sequence: Synthetic peptide
EGKTGGVSYFDY

SEQ ID NO: 21495 - DNA, 24 bp, Artificial Sequence
  Description of Artificial Sequence: Synthetic oligonucleotide
gatgttctggacccttttgactac

SEQ ID NO: 21496 - protein, 8 aa, Artificial Sequence
  Description of Artificial Sequence: Synthetic peptide
DVLDPFDY

SEQ ID NO: 21497 - DNA, 42 bp, Artificial Sequence; identical to SEQ ID NO: 21211
  Description of Artificial Sequence: Synthetic oligonucleotide

SEQ ID NO: 21498 - protein, 14 aa, Artificial Sequence
  Description of Artificial Sequence: Synthetic peptide
ERYSSGWYDYGMDV

SEQ ID NO: 21499 - DNA, 36 bp, Artificial Sequence
  Description of Artificial Sequence: Synthetic oligonucleotide
aggtatagcagaagctgggcgggaggcatggacgtc

SEQ ID NO: 21500 - protein, 12 aa, Artificial Sequence
  Description of Artificial Sequence: Synthetic peptide
RYSRSWAGGMDV

SEQ ID NO: 21501 - DNA, 27 bp, Artificial Sequence
  Description of Artificial Sequence: Synthetic oligonucleotide
agcagtggctggtaccgctttgactac

SEQ ID NO: 21502 - protein, 9 aa, Artificial Sequence
  Description of Artificial Sequence: Synthetic peptide
SSGWYRFDY

SEQ ID NO: 21503 - DNA, 27 bp, Artificial Sequence
  Description of Artificial Sequence: Synthetic oligonucleotide
agcagtggctggtactactttgactac

SEQ ID NO: 21504 - protein, 9 aa, Artificial Sequence
  Description of Artificial Sequence: Synthetic peptide
SSGWYYFDY

SEQ ID NO: 21505 - DNA, 36 bp, Artificial Sequence
  Description of Artificial Sequence: Synthetic oligonucleotide
cggggggtctacggtgactttgatgcttttgatatc

SEQ ID NO: 21506 - protein, 12 aa, Artificial Sequence
  Description of Artificial Sequence: Synthetic peptide
RGVYGDFDAFDI

SEQ ID NO: 21507 - DNA, 24 bp, Artificial Sequence
  Description of Artificial Sequence: Synthetic oligonucleotide
ttggaactggggatctttgactac

SEQ ID NO: 21508 - protein, 8 aa, Artificial Sequence
  Description of Artificial Sequence: Synthetic peptide
LELGIFDY

SEQ ID NO: 21509 - DNA, 12 bp, Artificial Sequence
  Description of Artificial Sequence: Synthetic oligonucleotide
tttggagtggac

SEQ ID NO: 21510 - protein, 4 aa, Artificial Sequence
  Description of Artificial Sequence: Synthetic peptide
FGVD

SEQ ID NO: 21511 - DNA, 30 bp, Artificial Sequence
  Description of Artificial Sequence: Synthetic oligonucleotide
gaagacccgcgtaccagctgctctgactac

SEQ ID NO: 21512 - protein, 10 aa, Artificial Sequence
  Description of Artificial Sequence: Synthetic peptide
EDPRTSCSDY

SEQ ID NO: 21513 - DNA, 30 bp, Artificial Sequence
  Description of Artificial Sequence: Synthetic oligonucleotide
gataatggtaactggaactaccttgactac

SEQ ID NO: 21514 - protein, 10 aa, Artificial Sequence
  Description of Artificial Sequence: Synthetic peptide
DNGNWNYLDY

SEQ ID NO: 21515 - DNA, 27 bp, Artificial Sequence
  Description of Artificial Sequence: Synthetic oligonucleotide
ctgagcagtggctggtcctttgactac

SEQ ID NO: 21516 - protein, 9 aa, Artificial Sequence
  Description of Artificial Sequence: Synthetic peptide
LSSGWSFDY

SEQ ID NO: 21517 - DNA, 18 bp, Artificial Sequence
  Description of Artificial Sequence: Synthetic oligonucleotide
gttaactcttttgactcc

SEQ ID NO: 21518 - protein, 6 aa, Artificial Sequence
  Description of Artificial Sequence: Synthetic peptide
VNSFDS

SEQ ID NO: 21519 - DNA, 24 bp, Artificial Sequence
  Description of Artificial Sequence: Synthetic oligonucleotide
gagcttgggttcagcagtgactac

SEQ ID NO: 21520 - protein, 8 aa, Artificial Sequence
  Description of Artificial Sequence: Synthetic peptide
ELGFSSDY

SEQ ID NO: 21521 - DNA, 36 bp, Artificial Sequence
  Description of Artificial Sequence: Synthetic oligonucleotide
gatcagggcatagtgggagctacttggtttgactac

SEQ ID NO: 21522 - protein, 12 aa, Artificial Sequence
  Description of Artificial Sequence: Synthetic peptide
DQGIVGATWFDY

SEQ ID NO: 21523 - DNA, 33 bp, Artificial Sequence
  Description of Artificial Sequence: Synthetic oligonucleotide
ctggggatagactactactacggtatggacgtc

SEQ ID NO: 21524 - protein, 11 aa, Artificial Sequence
  Description of Artificial Sequence: Synthetic peptide
LGIDYYYGMDV

SEQ ID NO: 21525 - DNA, 45 bp, Artificial Sequence
  Description of Artificial Sequence: Synthetic oligonucleotide
gctccgggtatagcagcagctggtacatggggatactttgactac

SEQ ID NO: 21526 - protein, 15 aa, Artificial Sequence
  Description of Artificial Sequence: Synthetic peptide
APGIAAAGTWGYFDY

SEQ ID NO: 21527 - DNA, 18 bp, Artificial Sequence
  Description of Artificial Sequence: Synthetic oligonucleotide
actacgcactttgactac

SEQ ID NO: 21528 - protein, 6 aa, Artificial Sequence
  Description of Artificial Sequence: Synthetic peptide
TTHFDY

SEQ ID NO: 21529 - DNA, 15 bp, Artificial Sequence
  Description of Artificial Sequence: Synthetic oligonucleotide
gatcggggcagcagc

SEQ ID NO: 21530 - protein, 5 aa, Artificial Sequence
  Description of Artificial Sequence: Synthetic peptide
DRGSS

SEQ ID NO: 21531 - DNA, 18 bp, Artificial Sequence
  Description of Artificial Sequence: Synthetic oligonucleotide
gtggctggctttgactac

SEQ ID NO: 21532 - protein, 6 aa, Artificial Sequence
  Description of Artificial Sequence: Synthetic peptide
VAGFDY

SEQ ID NO: 21533 - DNA, 36 bp, Artificial Sequence; identical to SEQ ID NO: 21491
  Description of Artificial Sequence: Synthetic oligonucleotide

SEQ ID NO: 21534 - protein, 12 aa, Artificial Sequence
  Description of Artificial Sequence: Synthetic peptide
EGKTGGVSYFDY

SEQ ID NO: 21535 - DNA, 36 bp, Artificial Sequence
  Description of Artificial Sequence: Synthetic oligonucleotide
gattatggtatagtgggagctacatattttgactac

SEQ ID NO: 21536 - protein, 12 aa, Artificial Sequence
  Description of Artificial Sequence: Synthetic peptide
DYGIVGATYFDY

SEQ ID NO: 21537 - DNA, 24 bp, Artificial Sequence
  Description of Artificial Sequence: Synthetic oligonucleotide
gaactggggatgaggtctgactac

SEQ ID NO: 21538 - protein, 8 aa, Artificial Sequence
  Description of Artificial Sequence: Synthetic peptide
ELGMRSDY

SEQ ID NO: 21539 - DNA, 27 bp, Artificial Sequence
  Description of Artificial Sequence: Synthetic oligonucleotide
agggactggaacgacgtttttgactac

SEQ ID NO: 21540 - protein, 9 aa, Artificial Sequence
  Description of Artificial Sequence: Synthetic peptide
RDWNDVFDY

SEQ ID NO: 21541 - DNA, 12 bp, Artificial Sequence
  Description of Artificial Sequence: Synthetic oligonucleotide
gatatgattacg

SEQ ID NO: 21542 - protein, 4 aa, Artificial Sequence
  Description of Artificial Sequence: Synthetic peptide
DMIT

SEQ ID NO: 21543 - DNA, 24 bp, Artificial Sequence
  Description of Artificial Sequence: Synthetic oligonucleotide
gatgggagaagtggttttgactac

SEQ ID NO: 21544 - protein, 8 aa, Artificial Sequence
  Description of Artificial Sequence: Synthetic peptide
DGRSGFDY

SEQ ID NO: 21545 - DNA, 36 bp, Artificial Sequence
  Description of Artificial Sequence: Synthetic oligonucleotide
tttttcggtgtagtgggagtcgggtgctttgactac

SEQ ID NO: 21546 - protein, 12 aa, Artificial Sequence
  Description of Artificial Sequence: Synthetic peptide
FFGVVGVGCFDY

SEQ ID NO: 21547 - DNA, 24 bp, Artificial Sequence
  Description of Artificial Sequence: Synthetic oligonucleotide
ttggaactggggatctttgactac

SEQ ID NO: 21548 - protein, 8 aa, Artificial Sequence
  Description of Artificial Sequence: Synthetic peptide
LELGIFDY

SEQ ID NO: 21549 - DNA, 36 bp, Artificial Sequence; identical to SEQ ID NO: 21487
  Description of Artificial Sequence: Synthetic oligonucleotide

SEQ ID NO: 21550 - protein, 12 aa, Artificial Sequence
  Description of Artificial Sequence: Synthetic peptide
LGKDYHYYGMDV

SEQ ID NO: 21551 - DNA, 27 bp, Artificial Sequence
  Description of Artificial Sequence: Synthetic oligonucleotide
agcagtggctggaactggttcgacccc

SEQ ID NO: 21552 - protein, 9 aa, Artificial Sequence
  Description of Artificial Sequence: Synthetic peptide
SSGWNWFDP

SEQ ID NO: 21553 - DNA, 27 bp, Artificial Sequence
  Description of Artificial Sequence: Synthetic oligonucleotide
agcagtggctggtaccggttcgacccc

SEQ ID NO: 21554 - protein, 9 aa, Artificial Sequence
  Description of Artificial Sequence: Synthetic peptide
SSGWYRFDP

SEQ ID NO: 21555 - DNA, 36 bp, Artificial Sequence
  Description of Artificial Sequence: Synthetic oligonucleotide
tttttcggtatagtgggtgccgggtactttgactac

SEQ ID NO: 21556 - protein, 12 aa, Artificial Sequence
  Description of Artificial Sequence: Synthetic peptide
FFGIVGAGYFDY

SEQ ID NO: 21557 - DNA, 36 bp, Artificial Sequence
  Description of Artificial Sequence: Synthetic oligonucleotide
tttttcggtatagtgggagccgggttctttgactcc

SEQ ID NO: 21558 - protein, 12 aa, Artificial Sequence
  Description of Artificial Sequence: Synthetic peptide
FFGIVGAGFFDS

SEQ ID NO: 21559 - DNA, 24 bp, Artificial Sequence
  Description of Artificial Sequence: Synthetic oligonucleotide
gaactggggatgaggtctgactac

SEQ ID NO: 21560 - protein, 8 aa, Artificial Sequence
  Description of Artificial Sequence: Synthetic peptide
ELGMRSDY

SEQ ID NO: 21561 - DNA, 27 bp, Artificial Sequence
  Description of Artificial Sequence: Synthetic oligonucleotide
agcagtggctggtactactttgactac

SEQ ID NO: 21562 - protein, 9 aa, Artificial Sequence
  Description of Artificial Sequence: Synthetic peptide
SSGWYYFDY

SEQ ID NO: 21563 - DNA, 36 bp, Artificial Sequence; identical to SEQ ID NO: 21485
  Description of Artificial Sequence: Synthetic oligonucleotide

SEQ ID NO: 21564 - protein, 12 aa, Artificial Sequence
  Description of Artificial Sequence: Synthetic peptide
FFGIVGAGYFDY

SEQ ID NO: 21565 - DNA, 21 bp, Artificial Sequence
  Description of Artificial Sequence: Synthetic oligonucleotide
gatcgggtcacttttgactac

SEQ ID NO: 21566 - protein, 7 aa, Artificial Sequence
  Description of Artificial Sequence: Synthetic peptide
DRVTFDY

SEQ ID NO: 21567 - DNA, 36 bp, Artificial Sequence
  Description of Artificial Sequence: Synthetic oligonucleotide
tttttcggtatggtgggagccggattctttgactac

SEQ ID NO: 21568 - protein, 12 aa, Artificial Sequence
  Description of Artificial Sequence: Synthetic peptide
FFGMVGAGFFDY

SEQ ID NO: 21569 - DNA, 36 bp, Artificial Sequence; identical to SEQ ID NO: 21467
  Description of Artificial Sequence: Synthetic oligonucleotide

SEQ ID NO: 21570 - protein, 12 aa, Artificial Sequence
  Description of Artificial Sequence: Synthetic peptide
RYSSSWDGGMDV

SEQ ID NO: 21571 - DNA, 27 bp, Artificial Sequence
  Description of Artificial Sequence: Synthetic oligonucleotide
agcagtggctggtacttctttgactac

SEQ ID NO: 21572 - protein, 9 aa, Artificial Sequence
  Description of Artificial Sequence: Synthetic peptide
SSGWYFFDY

SEQ ID NO: 21573 - DNA, 21 bp, Artificial Sequence
  Description of Artificial Sequence: Synthetic oligonucleotide
gatccggggccctttgactac

SEQ ID NO: 21574 - protein, 7 aa, Artificial Sequence
  Description of Artificial Sequence: Synthetic peptide
DPGPFDY

SEQ ID NO: 21575 - DNA, 36 bp, Artificial Sequence
  Description of Artificial Sequence: Synthetic oligonucleotide
aggggggtctacggtgactacgaggcttttgatatc

SEQ ID NO: 21576 - protein, 12 aa, Artificial Sequence
  Description of Artificial Sequence: Synthetic peptide
RGVYGDYEAFDI

SEQ ID NO: 21577 - DNA, 39 bp, Artificial Sequence
  Description of Artificial Sequence: Synthetic oligonucleotide
gagaggggtatagcagtggggtactacggtatggacgtc

SEQ ID NO: 21578 - protein, 13 aa, Artificial Sequence
  Description of Artificial Sequence: Synthetic peptide
ERGIAVGYYGMDV

SEQ ID NO: 21579 - DNA, 27 bp, Artificial Sequence
  Description of Artificial Sequence: Synthetic oligonucleotide
catagcagcagctggtcccttgactac

SEQ ID NO: 21580 - protein, 9 aa, Artificial Sequence
  Description of Artificial Sequence: Synthetic peptide
HSSSWSLDY

SEQ ID NO: 21581 - DNA, 48 bp, Artificial Sequence
  Description of Artificial Sequence: Synthetic oligonucleotide
gggggcctactgggagctaccaactactactactacggtatggacgtc

SEQ ID NO: 21582 - protein, 16 aa, Artificial Sequence
  Description of Artificial Sequence: Synthetic peptide
GGLLGATNYYYYGMDV

SEQ ID NO: 21583 - DNA, 36 bp, Artificial Sequence
  Description of Artificial Sequence: Synthetic oligonucleotide
gaatggggaatggcagtggctggcccgtttgactac

SEQ ID NO: 21584 - protein, 12 aa, Artificial Sequence
  Description of Artificial Sequence: Synthetic peptide
EWGMAVAGPFDY

SEQ ID NO: 21585 - DNA, 48 bp, Artificial Sequence
  Description of Artificial Sequence: Synthetic oligonucleotide
gggggcctactgggagctacctactactactactacggtatggacgtc

SEQ ID NO: 21586 - protein, 16 aa, Artificial Sequence
  Description of Artificial Sequence: Synthetic peptide
GGLLGATYYYYYGMDV

SEQ ID NO: 21587 - DNA, 27 bp, Artificial Sequence
  Description of Artificial Sequence: Synthetic oligonucleotide
agcagtggctggtactactttgactac

SEQ ID NO: 21588 - protein, 9 aa, Artificial Sequence
  Description of Artificial Sequence: Synthetic peptide
SSGWYYFDY

SEQ ID NO: 21589 - DNA, 30 bp, Artificial Sequence; identical to SEQ ID NO: 21511
  Description of Artificial Sequence: Synthetic oligonucleotide

SEQ ID NO: 21590 - protein, 10 aa, Artificial Sequence
  Description of Artificial Sequence: Synthetic peptide
EDPRTSCSDY

SEQ ID NO: 21591 - DNA, 36 bp, Artificial Sequence
  Description of Artificial Sequence: Synthetic oligonucleotide
gatagcctctcgggtatagcagcagcttttgactac

SEQ ID NO: 21592 - protein, 12 aa, Artificial Sequence
  Description of Artificial Sequence: Synthetic peptide
DSLSGIAAAFDY

SEQ ID NO: 21593 - DNA, 18 bp, Artificial Sequence
  Description of Artificial Sequence: Synthetic oligonucleotide
ctacgtaattttgactac

SEQ ID NO: 21594 - protein, 6 aa, Artificial Sequence
  Description of Artificial Sequence: Synthetic peptide
LRNFDY

SEQ ID NO: 21595 - DNA, 45 bp, Artificial Sequence
  Description of Artificial Sequence: Synthetic oligonucleotide
gctccgggtgtagcagcagctggttcatggggatactttgactac

SEQ ID NO: 21596 - protein, 15 aa, Artificial Sequence
  Description of Artificial Sequence: Synthetic peptide
APGVAAAGSWGYFDY

SEQ ID NO: 21597 - DNA, 30 bp, Artificial Sequence
  Description of Artificial Sequence: Synthetic oligonucleotide
gatgatcccagatcctcggccggggactac

SEQ ID NO: 21598 - protein, 10 aa, Artificial Sequence
  Description of Artificial Sequence: Synthetic peptide
DDPRSSAGDY

SEQ ID NO: 21599 - DNA, 24 bp, Artificial Sequence
  Description of Artificial Sequence: Synthetic oligonucleotide
gagcttgggttcagcagtgactat

SEQ ID NO: 21600 - protein, 8 aa, Artificial Sequence
  Description of Artificial Sequence: Synthetic peptide
ELGFSSDY

SEQ ID NO: 21601 - DNA, 42 bp, Artificial Sequence
  Description of Artificial Sequence: Synthetic oligonucleotide
gaaaggtatagcagcagctggtacgactacggtatggacgtc

SEQ ID NO: 21602 - protein, 14 aa, Artificial Sequence
  Description of Artificial Sequence: Synthetic peptide
ERYSSSWYDYGMDV

SEQ ID NO: 21603 - DNA, 24 bp, Artificial Sequence
  Description of Artificial Sequence: Synthetic oligonucleotide
tttagcagtggcttttttgactac

SEQ ID NO: 21604 - protein, 8 aa, Artificial Sequence
  Description of Artificial Sequence: Synthetic peptide
FSSGFFDY

SEQ ID NO: 21605 - DNA, 42 bp, Artificial Sequence
  Description of Artificial Sequence: Synthetic oligonucleotide
gaacggtatagcagtggctggtacgactacggtatggacgtc

SEQ ID NO: 21606 - protein, 14 aa, Artificial Sequence
  Description of Artificial Sequence: Synthetic peptide
ERYSSGWYDYGMDV

SEQ ID NO: 21607 - DNA, 36 bp, Artificial Sequence
  Description of Artificial Sequence: Synthetic oligonucleotide
gatacatacgatttttggagtggttatttgggctac

SEQ ID NO: 21608 - protein, 12 aa, Artificial Sequence
  Description of Artificial Sequence: Synthetic peptide
DTYDFWSGYLGY

SEQ ID NO: 21609 - DNA, 45 bp, Artificial Sequence
  Description of Artificial Sequence: Synthetic oligonucleotide
gctccgggtactgcagcaactggtacatggggatactttgactac

SEQ ID NO: 21610 - protein, 15 aa, Artificial Sequence
  Description of Artificial Sequence: Synthetic peptide
APGTAATGTWGYFDY

SEQ ID NO: 21611 - DNA, 24 bp, Artificial Sequence
  Description of Artificial Sequence: Synthetic oligonucleotide
gaactcgggttcctctctgaccac

SEQ ID NO: 21612 - protein, 8 aa, Artificial Sequence
  Description of Artificial Sequence: Synthetic peptide
ELGFLSDH

SEQ ID NO: 21613 - DNA, 27 bp, Artificial Sequence
  Description of Artificial Sequence: Synthetic oligonucleotide
ctggacagtggctggtcctttgactac

SEQ ID NO: 21614 - protein, 9 aa, Artificial Sequence
  Description of Artificial Sequence: Synthetic peptide
LDSGWSFDY

SEQ ID NO: 21615 - DNA, 27 bp, Artificial Sequence
  Description of Artificial Sequence: Synthetic oligonucleotide
aggaactacgacgatgcttttgatatc

SEQ ID NO: 21616 - protein, 9 aa, Artificial Sequence
  Description of Artificial Sequence: Synthetic peptide
RNYDDAFDI

SEQ ID NO: 21617 - DNA, 24 bp, Artificial Sequence
  Description of Artificial Sequence: Synthetic oligonucleotide
gaacttgggttcagcagtgactac

SEQ ID NO: 21618 - protein, 8 aa, Artificial Sequence
  Description of Artificial Sequence: Synthetic peptide
ELGFSSDY

SEQ ID NO: 21619 - DNA, 45 bp, Artificial Sequence
  Description of Artificial Sequence: Synthetic oligonucleotide
gctccgggtaaagcagcagctggtacatggggatactttgactac

SEQ ID NO: 21620 - protein, 15 aa, Artificial Sequence
  Description of Artificial Sequence: Synthetic peptide
APGKAAAGTWGYFDY

SEQ ID NO: 21621 - DNA, 27 bp, Artificial Sequence
  Description of Artificial Sequence: Synthetic oligonucleotide
ggggaagcagtggctgtcttcgacccc

SEQ ID NO: 21622 - protein, 9 aa, Artificial Sequence
  Description of Artificial Sequence: Synthetic peptide
GEAVAVFDP

SEQ ID NO: 21623 - DNA, 36 bp, Artificial Sequence; identical to SEQ ID NO: 21521
  Description of Artificial Sequence: Synthetic oligonucleotide

SEQ ID NO: 21624 - protein, 12 aa, Artificial Sequence
  Description of Artificial Sequence: Synthetic peptide
DQGIVGATWFDY

SEQ ID NO: 21625 - DNA, 12 bp, Artificial Sequence
  Description of Artificial Sequence: Synthetic oligonucleotide
acaagtgggagc

SEQ ID NO: 21626 - protein, 4 aa, Artificial Sequence
  Description of Artificial Sequence: Synthetic peptide
TSGS

SEQ ID NO: 21627 - DNA, 45 bp, Artificial Sequence
  Description of Artificial Sequence: Synthetic oligonucleotide
gctccgggtacagcagcagctggtacatggggatactttgactac

SEQ ID NO: 21628 - protein, 15 aa, Artificial Sequence
  Description of Artificial Sequence: Synthetic peptide
APGTAAAGTWGYFDY

SEQ ID NO: 21629 - DNA, 45 bp, Artificial Sequence
  Description of Artificial Sequence: Synthetic oligonucleotide
gctccgggcacagtagcagctggtacatggggatactttgactat

SEQ ID NO: 21630 - protein, 15 aa, Artificial Sequence
  Description of Artificial Sequence: Synthetic peptide
APGTVAAGTWGYFDY

SEQ ID NO: 21631 - DNA, 24 bp, Artificial Sequence
  Description of Artificial Sequence: Synthetic oligonucleotide
gaacttgggttcagcagtgactac

SEQ ID NO: 21632 - protein, 8 aa, Artificial Sequence
  Description of Artificial Sequence: Synthetic peptide
ELGFSSDY

SEQ ID NO: 21633 - DNA, 30 bp, Artificial Sequence
  Description of Artificial Sequence: Synthetic oligonucleotide
gaagacccgcgtaccagttgttctgactac

SEQ ID NO: 21634 - protein, 10 aa, Artificial Sequence
  Description of Artificial Sequence: Synthetic peptide
EDPRTSCSDY

SEQ ID NO: 21635 - DNA, 18 bp, Artificial Sequence
  Description of Artificial Sequence: Synthetic oligonucleotide
accaatgcttttgatatc

SEQ ID NO: 21636 - protein, 6 aa, Artificial Sequence
  Description of Artificial Sequence: Synthetic peptide
TNAFDI

SEQ ID NO: 21637 - DNA, 33 bp, Artificial Sequence; identical to SEQ ID NO: 21523
  Description of Artificial Sequence: Synthetic oligonucleotide

SEQ ID NO: 21638 - protein, 11 aa, Artificial Sequence
  Description of Artificial Sequence: Synthetic peptide
LGIDYYYGMDV

SEQ ID NO: 21639 - DNA, 42 bp, Artificial Sequence
  Description of Artificial Sequence: Synthetic oligonucleotide
gagatgtatagcagcaactggtacgactacggtttggacgtc

SEQ ID NO: 21640 - protein, 14 aa, Artificial Sequence
  Description of Artificial Sequence: Synthetic peptide
EMYSSNWYDYGLDV

SEQ ID NO: 21641 - DNA, 24 bp, Artificial Sequence
  Description of Artificial Sequence: Synthetic oligonucleotide
gatagtagaagttcgtgggactac

SEQ ID NO: 21642 - protein, 8 aa, Artificial Sequence
  Description of Artificial Sequence: Synthetic peptide
DSRSSWDY

SEQ ID NO: 21643 - DNA, 36 bp, Artificial Sequence; identical to SEQ ID NO: 21521
  Description of Artificial Sequence: Synthetic oligonucleotide

SEQ ID NO: 21644 - protein, 12 aa, Artificial Sequence
  Description of Artificial Sequence: Synthetic peptide
DQGIVGATWFDY

SEQ ID NO: 21645 - DNA, 45 bp, Artificial Sequence; identical to SEQ ID NO: 21609
  Description of Artificial Sequence: Synthetic oligonucleotide

SEQ ID NO: 21646 - protein, 15 aa, Artificial Sequence
  Description of Artificial Sequence: Synthetic peptide
APGTAATGTWGYFDY

SEQ ID NO: 21647 - DNA, 21 bp, Artificial Sequence
  Description of Artificial Sequence: Synthetic oligonucleotide
agtatcccggaatttgactat

SEQ ID NO: 21648 - protein, 7 aa, Artificial Sequence
  Description of Artificial Sequence: Synthetic peptide
SIPEFDY

SEQ ID NO: 21649 - DNA, 24 bp, Artificial Sequence
  Description of Artificial Sequence: Synthetic oligonucleotide
tctagtgggagcccctttgactac

SEQ ID NO: 21650 - protein, 8 aa, Artificial Sequence
  Description of Artificial Sequence: Synthetic peptide
SSGSPFDY

SEQ ID NO: 21651 - DNA, 18 bp, Artificial Sequence
  Description of Artificial Sequence: Synthetic oligonucleotide
gtcaacagctttgactcc

SEQ ID NO: 21652 - protein, 6 aa, Artificial Sequence
  Description of Artificial Sequence: Synthetic peptide
VNSFDS

SEQ ID NO: 21653 - DNA, 24 bp, Artificial Sequence
  Description of Artificial Sequence: Synthetic oligonucleotide
gaactggggatgacctctgactgc

SEQ ID NO: 21654 - protein, 8 aa, Artificial Sequence
  Description of Artificial Sequence: Synthetic peptide
ELGMTSDC

SEQ ID NO: 21655 - DNA, 27 bp, Artificial Sequence
  Description of Artificial Sequence: Synthetic oligonucleotide
catagcaccagctggtccattgactac

SEQ ID NO: 21656 - protein, 9 aa, Artificial Sequence
  Description of Artificial Sequence: Synthetic peptide
HSTSWSIDY

SEQ ID NO: 21657 - DNA, 30 bp, Artificial Sequence
  Description of Artificial Sequence: Synthetic oligonucleotide
gatatccctagcaactcggcgggggactac

SEQ ID NO: 21658 - protein, 10 aa, Artificial Sequence
  Description of Artificial Sequence: Synthetic peptide
DIPSNSAGDY

SEQ ID NO: 21659 - DNA, 24 bp, Artificial Sequence
  Description of Artificial Sequence: Synthetic oligonucleotide
gatagcatatcgtcgtgggactac

SEQ ID NO: 21660 - protein, 8 aa, Artificial Sequence
  Description of Artificial Sequence: Synthetic peptide
DSISSWDY

SEQ ID NO: 21661 - DNA, 36 bp, Artificial Sequence; identical to SEQ ID NO: 21521
  Description of Artificial Sequence: Synthetic oligonucleotide

SEQ ID NO: 21662 - protein, 12 aa, Artificial Sequence
  Description of Artificial Sequence: Synthetic peptide
DQGIVGATWFDY

SEQ ID NO: 21663 - DNA, 45 bp, Artificial Sequence
  Description of Artificial Sequence: Synthetic oligonucleotide
gctccgggtaaagcagcagctggtacatggggattctttgactac

SEQ ID NO: 21664 - protein, 15 aa, Artificial Sequence
  Description of Artificial Sequence: Synthetic peptide
APGKAAAGTWGFFDY

SEQ ID NO: 21665 - DNA, 30 bp, Artificial Sequence; identical to SEQ ID NO: 21597
  Description of Artificial Sequence: Synthetic oligonucleotide

SEQ ID NO: 21666 - protein, 10 aa, Artificial Sequence
  Description of Artificial Sequence: Synthetic peptide
DDPRSSAGDY

SEQ ID NO: 21667 - DNA, 27 bp, Artificial Sequence
  Description of Artificial Sequence: Synthetic oligonucleotide
agcagtggctggtacgtctttgactac

SEQ ID NO: 21668 - protein, 9 aa, Artificial Sequence
  Description of Artificial Sequence: Synthetic peptide
SSGWYVFDY

SEQ ID NO: 21669 - DNA, 24 bp, Artificial Sequence
  Description of Artificial Sequence: Synthetic oligonucleotide
gacctactggacccacgggactac

SEQ ID NO: 21670 - protein, 8 aa, Artificial Sequence
  Description of Artificial Sequence: Synthetic peptide
DLLDPRDY

SEQ ID NO: 21671 - DNA, 45 bp, Artificial Sequence; identical to SEQ ID NO: 21525
  Description of Artificial Sequence: Synthetic oligonucleotide

SEQ ID NO: 21672 - protein, 15 aa, Artificial Sequence
  Description of Artificial Sequence: Synthetic peptide
APGIAAAGTWGYFDY

SEQ ID NO: 21673 - DNA, 45 bp, Artificial Sequence; identical to SEQ ID NO: 21609
  Description of Artificial Sequence: Synthetic oligonucleotide

SEQ ID NO: 21674 - protein, 15 aa, Artificial Sequence
  Description of Artificial Sequence: Synthetic peptide
APGTAATGTWGYFDY

SEQ ID NO: 21675 - DNA, 18 bp, Artificial Sequence
  Description of Artificial Sequence: Synthetic oligonucleotide
gtggccgcctttgactgc

SEQ ID NO: 21676 - protein, 6 aa, Artificial Sequence
  Description of Artificial Sequence: Synthetic peptide
VAAFDC

SEQ ID NO: 21677 - DNA, 24 bp, Artificial Sequence
  Description of Artificial Sequence: Synthetic oligonucleotide
gaattggggtggcaggatgattac

SEQ ID NO: 21678 - protein, 8 aa, Artificial Sequence
  Description of Artificial Sequence: Synthetic peptide
ELGWQDDY

SEQ ID NO: 21679 - DNA, 27 bp, Artificial Sequence
  Description of Artificial Sequence: Synthetic oligonucleotide
agcagtggctggtactactttgactac

SEQ ID NO: 21680 - protein, 9 aa, Artificial Sequence
  Description of Artificial Sequence: Synthetic peptide
SSGWYYFDY

SEQ ID NO: 21681 - DNA, 24 bp, Artificial Sequence
  Description of Artificial Sequence: Synthetic oligonucleotide
gaactggggatgttgtctgactac

SEQ ID NO: 21682 - protein, 8 aa, Artificial Sequence
  Description of Artificial Sequence: Synthetic peptide
ELGMLSDY

SEQ ID NO: 21683 - DNA, 18 bp, Artificial Sequence
  Description of Artificial Sequence: Synthetic oligonucleotide
accaatgcttttgatatc

SEQ ID NO: 21684 - protein, 6 aa, Artificial Sequence
  Description of Artificial Sequence: Synthetic peptide
TNAFDI

SEQ ID NO: 21685 - DNA, 45 bp, Artificial Sequence; identical to SEQ ID NO: 21663
  Description of Artificial Sequence: Synthetic oligonucleotide

SEQ ID NO: 21686 - protein, 15 aa, Artificial Sequence
  Description of Artificial Sequence: Synthetic peptide
APGKAAAGTWGFFDY

SEQ ID NO: 21687 - DNA, 24 bp, Artificial Sequence
  Description of Artificial Sequence: Synthetic oligonucleotide
gaactggggatgttgtctgactac

SEQ ID NO: 21688 - protein, 8 aa, Artificial Sequence
  Description of Artificial Sequence: Synthetic peptide
ELGMLSDY

SEQ ID NO: 21689 - DNA, 36 bp, Artificial Sequence
  Description of Artificial Sequence: Synthetic oligonucleotide
cgtatagcagtgactgggacggaatggtacgacccc

SEQ ID NO: 21690 - protein, 12 aa, Artificial Sequence
  Description of Artificial Sequence: Synthetic peptide
RIAVTGTEWYDP

SEQ ID NO: 21691 - DNA, 24 bp, Artificial Sequence
  Description of Artificial Sequence: Synthetic oligonucleotide
gagcttggtttcagcagtgactac

SEQ ID NO: 21692 - protein, 8 aa, Artificial Sequence
  Description of Artificial Sequence: Synthetic peptide
ELGFSSDY

SEQ ID NO: 21693 - DNA, 45 bp, Artificial Sequence
  Description of Artificial Sequence: Synthetic oligonucleotide
gctccgggtacagcaccagctgggtcatggggatactttgactac

SEQ ID NO: 21694 - protein, 15 aa, Artificial Sequence
  Description of Artificial Sequence: Synthetic peptide
APGTAPAGSWGYFDY

SEQ ID NO: 21695 - DNA, 45 bp, Artificial Sequence
  Description of Artificial Sequence: Synthetic oligonucleotide
gctccgggtacagcagcagctgggtcatggggatgctttgactac

SEQ ID NO: 21696 - protein, 15 aa, Artificial Sequence
  Description of Artificial Sequence: Synthetic peptide
APGTAAAGSWGCFDY

SEQ ID NO: 21697 - DNA, 21 bp, Artificial Sequence
  Description of Artificial Sequence: Synthetic oligonucleotide
agtatcccggactttgactac

SEQ ID NO: 21698 - protein, 7 aa, Artificial Sequence
  Description of Artificial Sequence: Synthetic peptide
SIPDFDY

SEQ ID NO: 21699 - DNA, 42 bp, Artificial Sequence
  Description of Artificial Sequence: Synthetic oligonucleotide
tgggatagcagcagctggtacgacgtgactccctttgactac

SEQ ID NO: 21700 - protein, 14 aa, Artificial Sequence
  Description of Artificial Sequence: Synthetic peptide
WDSSSWYDVTPFDY

SEQ ID NO: 21701 - DNA, 42 bp, Artificial Sequence
  Description of Artificial Sequence: Synthetic oligonucleotide
gaaaggtatagcagcagctggttcgactacggtatggacgtc

SEQ ID NO: 21702 - protein, 14 aa, Artificial Sequence
  Description of Artificial Sequence: Synthetic peptide
ERYSSSWFDYGMDV

SEQ ID NO: 21703 - DNA, 21 bp, Artificial Sequence
  Description of Artificial Sequence: Synthetic oligonucleotide
gactacggtggccttgactac

SEQ ID NO: 21704 - protein, 7 aa, Artificial Sequence
  Description of Artificial Sequence: Synthetic peptide
DYGGLDY

SEQ ID NO: 21705 - DNA, 21 bp, Artificial Sequence
  Description of Artificial Sequence: Synthetic oligonucleotide
gactacggcggtatggacgtc

SEQ ID NO: 21706 - protein, 7 aa, Artificial Sequence
  Description of Artificial Sequence: Synthetic peptide
DYGGMDV

SEQ ID NO: 21707 - DNA, 27 bp, Artificial Sequence
  Description of Artificial Sequence: Synthetic oligonucleotide
agcagtggctggaacttctttgactac

SEQ ID NO: 21708 - protein, 9 aa, Artificial Sequence
  Description of Artificial Sequence: Synthetic peptide
SSGWNFFDY

SEQ ID NO: 21709 - DNA, 27 bp, Artificial Sequence
  Description of Artificial Sequence: Synthetic oligonucleotide
agcagtggctggtactactttgactac

SEQ ID NO: 21710 - protein, 9 aa, Artificial Sequence
  Description of Artificial Sequence: Synthetic peptide
SSGWYYFDY

SEQ ID NO: 21711 - DNA, 27 bp, Artificial Sequence
  Description of Artificial Sequence: Synthetic oligonucleotide
agtagtggctggtactggttcgacccc

SEQ ID NO: 21712 - protein, 9 aa, Artificial Sequence
  Description of Artificial Sequence: Synthetic peptide
SSGWYWFDP

SEQ ID NO: 21713 - DNA, 27 bp, Artificial Sequence
  Description of Artificial Sequence: Synthetic oligonucleotide
tccagtggctggtactggttcgacccc

SEQ ID NO: 21714 - protein, 9 aa, Artificial Sequence
  Description of Artificial Sequence: Synthetic peptide
SSGWYWFDP

SEQ ID NO: 21715 - DNA, 27 bp, Artificial Sequence
  Description of Artificial Sequence: Synthetic oligonucleotide
agcagtggctggtactggttcgacccc

SEQ ID NO: 21716 - protein, 9 aa, Artificial Sequence
  Description of Artificial Sequence: Synthetic peptide
SSGWYWFDP

SEQ ID NO: 21717 - DNA, 36 bp, Artificial Sequence
  Description of Artificial Sequence: Synthetic oligonucleotide
gatcgcaatatagtgggagctacttactttgagtcc

SEQ ID NO: 21718 - protein, 12 aa, Artificial Sequence
  Description of Artificial Sequence: Synthetic peptide
DRNIVGATYFES

SEQ ID NO: 21719 - DNA, 27 bp, Artificial Sequence
  Description of Artificial Sequence: Synthetic oligonucleotide
agcagtggctggtacatgtttgactac

SEQ ID NO: 21720 - protein, 9 aa, Artificial Sequence
  Description of Artificial Sequence: Synthetic peptide
SSGWYMFDY

SEQ ID NO: 21721 - DNA, 27 bp, Artificial Sequence
  Description of Artificial Sequence: Synthetic oligonucleotide
cttgactctaactggggtcttgactac

SEQ ID NO: 21722 - protein, 9 aa, Artificial Sequence
  Description of Artificial Sequence: Synthetic peptide
LDSNWGLDY

SEQ ID NO: 21723 - DNA, 27 bp, Artificial Sequence
  Description of Artificial Sequence: Synthetic oligonucleotide
tccagtggctggaactggttcgacccc

SEQ ID NO: 21724 - protein, 9 aa, Artificial Sequence
  Description of Artificial Sequence: Synthetic peptide
SSGWNWFDP

SEQ ID NO: 21725 - DNA, 21 bp, Artificial Sequence
  Description of Artificial Sequence: Synthetic oligonucleotide
gactacgggggtttggacgtc

SEQ ID NO: 21726 - protein, 7 aa, Artificial Sequence
  Description of Artificial Sequence: Synthetic peptide
DYGGLDV

SEQ ID NO: 21727 - DNA, 21 bp, Artificial Sequence
  Description of Artificial Sequence: Synthetic oligonucleotide
gactacggcggtatggacgtc

SEQ ID NO: 21728 - protein, 7 aa, Artificial Sequence
  Description of Artificial Sequence: Synthetic peptide
DYGGMDV

SEQ ID NO: 21729 - DNA, 21 bp, Artificial Sequence
  Description of Artificial Sequence: Synthetic oligonucleotide
gactacggcggtatggacgtc

SEQ ID NO: 21730 - protein, 7 aa, Artificial Sequence
  Description of Artificial Sequence: Synthetic peptide
DYGGMDV

SEQ ID NO: 21731 - DNA, 27 bp, Artificial Sequence
  Description of Artificial Sequence: Synthetic oligonucleotide
ctgcgacctaactgggactttgactac

SEQ ID NO: 21732 - protein, 9 aa, Artificial Sequence
  Description of Artificial Sequence: Synthetic peptide
LRPNWDFDY

SEQ ID NO: 21733 - DNA, 21 bp, Artificial Sequence
  Description of Artificial Sequence: Synthetic oligonucleotide
gactacggcggtatggacgtc

SEQ ID NO: 21734 - protein, 7 aa, Artificial Sequence
  Description of Artificial Sequence: Synthetic peptide
DYGGMDV

SEQ ID NO: 21735 - DNA, 27 bp, Artificial Sequence
  Description of Artificial Sequence: Synthetic oligonucleotide
agcagtggctggtactggttcgacccc

SEQ ID NO: 21736 - protein, 9 aa, Artificial Sequence
  Description of Artificial Sequence: Synthetic peptide
SSGWYWFDP

SEQ ID NO: 21737 - DNA, 27 bp, Artificial Sequence
  Description of Artificial Sequence: Synthetic oligonucleotide
agcagtggctggtactactttgactac

SEQ ID NO: 21738 - protein, 9 aa, Artificial Sequence
  Description of Artificial Sequence: Synthetic peptide
SSGWYYFDY

SEQ ID NO: 21739 - DNA, 27 bp, Artificial Sequence
  Description of Artificial Sequence: Synthetic oligonucleotide
agcagtggctggtactggttcgacccc

SEQ ID NO: 21740 - protein, 9 aa, Artificial Sequence
  Description of Artificial Sequence: Synthetic peptide
SSGWYWFDP

SEQ ID NO: 21741 - DNA, 27 bp, Artificial Sequence
  Description of Artificial Sequence: Synthetic oligonucleotide
agtagtggctggtactggttcgacccc

SEQ ID NO: 21742 - protein, 9 aa, Artificial Sequence
  Description of Artificial Sequence: Synthetic peptide
SSGWYWFDP

SEQ ID NO: 21743 - DNA, 21 bp, Artificial Sequence
  Description of Artificial Sequence: Synthetic oligonucleotide
gactacggtgggcttgactac

SEQ ID NO: 21744 - protein, 7 aa, Artificial Sequence
  Description of Artificial Sequence: Synthetic peptide
DYGGLDY

SEQ ID NO: 21745 - DNA, 21 bp, Artificial Sequence
  Description of Artificial Sequence: Synthetic oligonucleotide
gactacggtggccttgactac

SEQ ID NO: 21746 - protein, 7 aa, Artificial Sequence
  Description of Artificial Sequence: Synthetic peptide
DYGGLDY

SEQ ID NO: 21747 - DNA, 21 bp, Artificial Sequence
  Description of Artificial Sequence: Synthetic oligonucleotide
gactacggcggtatggacgtc

SEQ ID NO: 21748 - protein, 7 aa, Artificial Sequence
  Description of Artificial Sequence: Synthetic peptide
DYGGMDV

SEQ ID NO: 21749 - DNA, 27 bp, Artificial Sequence
  Description of Artificial Sequence: Synthetic oligonucleotide
tccagtggctggcactggttcgacccc

SEQ ID NO: 21750 - protein, 9 aa, Artificial Sequence
  Description of Artificial Sequence: Synthetic peptide
SSGWHWFDP

SEQ ID NO: 21751 - DNA, 27 bp, Artificial Sequence
  Description of Artificial Sequence: Synthetic oligonucleotide
agtagtggctggtactggttcgacccc

SEQ ID NO: 21752 - protein, 9 aa, Artificial Sequence
  Description of Artificial Sequence: Synthetic peptide
SSGWYWFDP

SEQ ID NO: 21753 - DNA, 21 bp, Artificial Sequence
  Description of Artificial Sequence: Synthetic oligonucleotide
gtgggacctactacggactac

SEQ ID NO: 21754 - protein, 7 aa, Artificial Sequence
  Description of Artificial Sequence: Synthetic peptide
VGPTTDY

SEQ ID NO: 21755 - DNA, 21 bp, Artificial Sequence
  Description of Artificial Sequence: Synthetic oligonucleotide
gactacgggggtttggacgtc

SEQ ID NO: 21756 - protein, 7 aa, Artificial Sequence
  Description of Artificial Sequence: Synthetic peptide
DYGGLDV

SEQ ID NO: 21757 - DNA, 33 bp, Artificial Sequence
  Description of Artificial Sequence: Synthetic oligonucleotide
gatggcagctatggttatgacggccttgactac

SEQ ID NO: 21758 - protein, 11 aa, Artificial Sequence
  Description of Artificial Sequence: Synthetic peptide
DGSYGYDGLDY

SEQ ID NO: 21759 - DNA, 36 bp, Artificial Sequence; identical to SEQ ID NO: 21717
  Description of Artificial Sequence: Synthetic oligonucleotide

SEQ ID NO: 21760 - protein, 12 aa, Artificial Sequence
  Description of Artificial Sequence: Synthetic peptide
DRNIVGATYFES

SEQ ID NO: 21761 - DNA, 48 bp, Artificial Sequence
  Description of Artificial Sequence: Synthetic oligonucleotide
gagtttccatatagtggaagctacctctactactacggtatggacgtc

SEQ ID NO: 21762 - protein, 16 aa, Artificial Sequence
  Description of Artificial Sequence: Synthetic peptide
EFPYSGSYLYYYGMDV

SEQ ID NO: 21763 - DNA, 21 bp, Artificial Sequence
  Description of Artificial Sequence: Synthetic oligonucleotide
gactacggcggtatggacgtc

SEQ ID NO: 21764 - protein, 7 aa, Artificial Sequence
  Description of Artificial Sequence: Synthetic peptide
DYGGMDV

SEQ ID NO: 21765 - DNA, 27 bp, Artificial Sequence
  Description of Artificial Sequence: Synthetic oligonucleotide
agcagtggctggtactactttgactac

SEQ ID NO: 21766 - protein, 9 aa, Artificial Sequence
  Description of Artificial Sequence: Synthetic peptide
SSGWYYFDY

SEQ ID NO: 21767 - DNA, 27 bp, Artificial Sequence
  Description of Artificial Sequence: Synthetic oligonucleotide
agcagtggctggtactactttgactac

SEQ ID NO: 21768 - protein, 9 aa, Artificial Sequence
  Description of Artificial Sequence: Synthetic peptide
SSGWYYFDY

SEQ ID NO: 21769 - DNA, 21 bp, Artificial Sequence
  Description of Artificial Sequence: Synthetic oligonucleotide
gactacggcggtatggacgtc

SEQ ID NO: 21770 - protein, 7 aa, Artificial Sequence
  Description of Artificial Sequence: Synthetic peptide
DYGGMDV

SEQ ID NO: 21771 - DNA, 21 bp, Artificial Sequence
  Description of Artificial Sequence: Synthetic oligonucleotide
gactacggcggtatggacgtc

SEQ ID NO: 21772 - protein, 7 aa, Artificial Sequence
  Description of Artificial Sequence: Synthetic peptide
DYGGMDV

SEQ ID NO: 21773 - DNA, 51 bp, Artificial Sequence
  Description of Artificial Sequence: Synthetic oligonucleotide
gttcttgactacggtgactccttgggctactactactacggtatggacgtc

SEQ ID NO: 21774 - protein, 17 aa, Artificial Sequence
  Description of Artificial Sequence: Synthetic peptide
VLDYGDSLGYYYYGMDV

SEQ ID NO: 21775 - DNA, 21 bp, Artificial Sequence
  Description of Artificial Sequence: Synthetic oligonucleotide
gactacggtggtttggacgtc

SEQ ID NO: 21776 - protein, 7 aa, Artificial Sequence
  Description of Artificial Sequence: Synthetic peptide
DYGGLDV

SEQ ID NO: 21777 - DNA, 36 bp, Artificial Sequence
  Description of Artificial Sequence: Synthetic oligonucleotide
gatcggagtatattgggagctactttctttgactac

SEQ ID NO: 21778 - protein, 12 aa, Artificial Sequence
  Description of Artificial Sequence: Synthetic peptide
DRSILGATFFDY

SEQ ID NO: 21779 - DNA, 21 bp, Artificial Sequence
  Description of Artificial Sequence: Synthetic oligonucleotide
gactacggtgggcttgactac

SEQ ID NO: 21780 - protein, 7 aa, Artificial Sequence
  Description of Artificial Sequence: Synthetic peptide
DYGGLDY

SEQ ID NO: 21781 - DNA, 33 bp, Artificial Sequence
  Description of Artificial Sequence: Synthetic oligonucleotide
gatggcagctatggttacgacggccttgactac

SEQ ID NO: 21782 - protein, 11 aa, Artificial Sequence
  Description of Artificial Sequence: Synthetic peptide
DGSYGYDGLDY

SEQ ID NO: 21783 - DNA, 27 bp, Artificial Sequence
  Description of Artificial Sequence: Synthetic oligonucleotide
tccagtggctggcactggttcgacccc

SEQ ID NO: 21784 - protein, 9 aa, Artificial Sequence
  Description of Artificial Sequence: Synthetic peptide
SSGWHWFDP

SEQ ID NO: 21785 - DNA, 21 bp, Artificial Sequence
  Description of Artificial Sequence: Synthetic oligonucleotide
gactacggcggtatggacgtc

SEQ ID NO: 21786 - protein, 7 aa, Artificial Sequence
  Description of Artificial Sequence: Synthetic peptide
DYGGMDV

SEQ ID NO: 21787 - DNA, 21 bp, Artificial Sequence
  Description of Artificial Sequence: Synthetic oligonucleotide
gactacggcggtatggacgtc

SEQ ID NO: 21788 - protein, 7 aa, Artificial Sequence
  Description of Artificial Sequence: Synthetic peptide
DYGGMDV

SEQ ID NO: 21789 - DNA, 27 bp, Artificial Sequence
  Description of Artificial Sequence: Synthetic oligonucleotide
agcagtggctggtactggttcgacccc

SEQ ID NO: 21790 - protein, 9 aa, Artificial Sequence
  Description of Artificial Sequence: Synthetic peptide
SSGWYWFDP

SEQ ID NO: 21791 - DNA, 21 bp, Artificial Sequence
  Description of Artificial Sequence: Synthetic oligonucleotide
gactacggcggtatggacgtc

SEQ ID NO: 21792 - protein, 7 aa, Artificial Sequence
  Description of Artificial Sequence: Synthetic peptide
DYGGMDV

SEQ ID NO: 21793 - DNA, 27 bp, Artificial Sequence
  Description of Artificial Sequence: Synthetic oligonucleotide
agtagtggctggtactggttcgacccc

SEQ ID NO: 21794 - protein, 9 aa, Artificial Sequence
  Description of Artificial Sequence: Synthetic peptide
SSGWYWFDP

SEQ ID NO: 21795 - DNA, 21 bp, Artificial Sequence
  Description of Artificial Sequence: Synthetic oligonucleotide
gactacggcggtatggacgtc

SEQ ID NO: 21796 - protein, 7 aa, Artificial Sequence
  Description of Artificial Sequence: Synthetic peptide
DYGGMDV

SEQ ID NO: 21797 - DNA, 27 bp, Artificial Sequence
  Description of Artificial Sequence: Synthetic oligonucleotide
agcagtggctggtactggttcgacccc

SEQ ID NO: 21798 - protein, 9 aa, Artificial Sequence
  Description of Artificial Sequence: Synthetic peptide
SSGWYWFDP

SEQ ID NO: 21799 - DNA, 27 bp, Artificial Sequence
  Description of Artificial Sequence: Synthetic oligonucleotide
agtagtggctggtactggttcgacccc

SEQ ID NO: 21800 - protein, 9 aa, Artificial Sequence
  Description of Artificial Sequence: Synthetic peptide
SSGWYWFDP

SEQ ID NO: 21801 - DNA, 21 bp, Artificial Sequence
  Description of Artificial Sequence: Synthetic oligonucleotide
gactacggcggtatggacgtc

SEQ ID NO: 21802 - protein, 7 aa, Artificial Sequence
  Description of Artificial Sequence: Synthetic peptide
DYGGMDV

SEQ ID NO: 21803 - DNA, 27 bp, Artificial Sequence
  Description of Artificial Sequence: Synthetic oligonucleotide
agcagtggctggtactggttcgacccc

SEQ ID NO: 21804 - protein, 9 aa, Artificial Sequence
  Description of Artificial Sequence: Synthetic peptide
SSGWYWFDP

SEQ ID NO: 21805 - DNA, 33 bp, Artificial Sequence; identical to SEQ ID NO: 21781
  Description of Artificial Sequence: Synthetic oligonucleotide

SEQ ID NO: 21806 - protein, 11 aa, Artificial Sequence
  Description of Artificial Sequence: Synthetic peptide
DGSYGYDGLDY

SEQ ID NO: 21807 - DNA, 27 bp, Artificial Sequence
  Description of Artificial Sequence: Synthetic oligonucleotide
tccagtggctggtactggttcgacccc

SEQ ID NO: 21808 - protein, 9 aa, Artificial Sequence
  Description of Artificial Sequence: Synthetic peptide
SSGWYWFDP

SEQ ID NO: 21809 - DNA, 27 bp, Artificial Sequence
  Description of Artificial Sequence: Synthetic oligonucleotide
agcagtggctggtactggttcgacccc

SEQ ID NO: 21810 - protein, 9 aa, Artificial Sequence
  Description of Artificial Sequence: Synthetic peptide
SSGWYWFDP

SEQ ID NO: 21811 - DNA, 48 bp, Artificial Sequence
  Description of Artificial Sequence: Synthetic oligonucleotide
gatgaggggttcggggagttcgactactacaactacggtatggacgtc

SEQ ID NO: 21812 - protein, 16 aa, Artificial Sequence
  Description of Artificial Sequence: Synthetic peptide
DEGFGEFDYYNYGMDV

SEQ ID NO: 21813 - DNA, 36 bp, Artificial Sequence
  Description of Artificial Sequence: Synthetic oligonucleotide
gatcggagtatactgggagctgctttctttgactac

SEQ ID NO: 21814 - protein, 12 aa, Artificial Sequence
  Description of Artificial Sequence: Synthetic peptide
DRSILGAAFFDY

SEQ ID NO: 21815 - DNA, 21 bp, Artificial Sequence
  Description of Artificial Sequence: Synthetic oligonucleotide
gtgggagctactacggactac

SEQ ID NO: 21816 - protein, 7 aa, Artificial Sequence
  Description of Artificial Sequence: Synthetic peptide
VGATTDY

SEQ ID NO: 21817 - DNA, 27 bp, Artificial Sequence
  Description of Artificial Sequence: Synthetic oligonucleotide
agtagtggctggtacaaatttgactac

SEQ ID NO: 21818 - protein, 9 aa, Artificial Sequence
  Description of Artificial Sequence: Synthetic peptide
SSGWYKFDY

SEQ ID NO: 21819 - DNA, 21 bp, Artificial Sequence
  Description of Artificial Sequence: Synthetic oligonucleotide
gactacggtggccttgactac

SEQ ID NO: 21820 - protein, 7 aa, Artificial Sequence
  Description of Artificial Sequence: Synthetic peptide
DYGGLDY

SEQ ID NO: 21821 - DNA, 27 bp, Artificial Sequence
  Description of Artificial Sequence: Synthetic oligonucleotide
tccagtggctggcactggttcgacccc

SEQ ID NO: 21822 - protein, 9 aa, Artificial Sequence
  Description of Artificial Sequence: Synthetic peptide
SSGWHWFDP

SEQ ID NO: 21823 - DNA, 27 bp, Artificial Sequence
  Description of Artificial Sequence: Synthetic oligonucleotide
agcagtggctggaacttctttgactac

SEQ ID NO: 21824 - protein, 9 aa, Artificial Sequence
  Description of Artificial Sequence: Synthetic peptide
SSGWNFFDY

SEQ ID NO: 21825 - DNA, 27 bp, Artificial Sequence
  Description of Artificial Sequence: Synthetic oligonucleotide
tccagtggctggaactggttcgacccc

SEQ ID NO: 21826 - protein, 9 aa, Artificial Sequence
  Description of Artificial Sequence: Synthetic peptide
SSGWNWFDP

SEQ ID NO: 21827 - DNA, 27 bp, Artificial Sequence
  Description of Artificial Sequence: Synthetic oligonucleotide
tccagtggctggcactggttcgacccc

SEQ ID NO: 21828 - protein, 9 aa, Artificial Sequence
  Description of Artificial Sequence: Synthetic peptide
SSGWHWFDP

SEQ ID NO: 21829 - DNA, 21 bp, Artificial Sequence
  Description of Artificial Sequence: Synthetic oligonucleotide
gactacggcggtatggacgtc

SEQ ID NO: 21830 - protein, 7 aa, Artificial Sequence
  Description of Artificial Sequence: Synthetic peptide
DYGGMDV

SEQ ID NO: 21831 - DNA, 21 bp, Artificial Sequence
  Description of Artificial Sequence: Synthetic oligonucleotide
gactacggcggtatggacgtc

SEQ ID NO: 21832 - protein, 7 aa, Artificial Sequence
  Description of Artificial Sequence: Synthetic peptide
DYGGMDV

SEQ ID NO: 21833 - DNA, 27 bp, Artificial Sequence
  Description of Artificial Sequence: Synthetic oligonucleotide
agcagtggctggtaccattttgactac

SEQ ID NO: 21834 - protein, 9 aa, Artificial Sequence
  Description of Artificial Sequence: Synthetic peptide
SSGWYHFDY

SEQ ID NO: 21835 - DNA, 33 bp, Artificial Sequence; identical to SEQ ID NO: 21757
  Description of Artificial Sequence: Synthetic oligonucleotide

SEQ ID NO: 21836 - protein, 11 aa, Artificial Sequence
  Description of Artificial Sequence: Synthetic peptide
DGSYGYDGLDY

SEQ ID NO: 21837 - DNA, 21 bp, Artificial Sequence
  Description of Artificial Sequence: Synthetic oligonucleotide
gtgggagctactacggactac

SEQ ID NO: 21838 - protein, 7 aa, Artificial Sequence
  Description of Artificial Sequence: Synthetic peptide
VGATTDY

SEQ ID NO: 21839 - DNA, 36 bp, Artificial Sequence; identical to SEQ ID NO: 21717
  Description of Artificial Sequence: Synthetic oligonucleotide

SEQ ID NO: 21840 - protein, 12 aa, Artificial Sequence
  Description of Artificial Sequence: Synthetic peptide
DRNIVGATYFES

SEQ ID NO: 21841 - DNA, 27 bp, Artificial Sequence
  Description of Artificial Sequence: Synthetic oligonucleotide
tccagtggctggtactggttcgacccc

SEQ ID NO: 21842 - protein, 9 aa, Artificial Sequence
  Description of Artificial Sequence: Synthetic peptide
SSGWYWFDP

SEQ ID NO: 21843 - DNA, 27 bp, Artificial Sequence
  Description of Artificial Sequence: Synthetic oligonucleotide
agtagtggctggtacaaatttgactac

SEQ ID NO: 21844 - protein, 9 aa, Artificial Sequence
  Description of Artificial Sequence: Synthetic peptide
SSGWYKFDY

SEQ ID NO: 21845 - DNA, 27 bp, Artificial Sequence
  Description of Artificial Sequence: Synthetic oligonucleotide
agcagtggctggtactactttgactac

SEQ ID NO: 21846 - protein, 9 aa, Artificial Sequence
  Description of Artificial Sequence: Synthetic peptide
SSGWYYFDY

SEQ ID NO: 21847 - DNA, 21 bp, Artificial Sequence
  Description of Artificial Sequence: Synthetic oligonucleotide
gactacggcggtatggacgtc

SEQ ID NO: 21848 - protein, 7 aa, Artificial Sequence
  Description of Artificial Sequence: Synthetic peptide
DYGGMDV

SEQ ID NO: 21849 - DNA, 27 bp, Artificial Sequence
  Description of Artificial Sequence: Synthetic oligonucleotide
tccagtggctggaactggttcgacccc

SEQ ID NO: 21850 - protein, 9 aa, Artificial Sequence
  Description of Artificial Sequence: Synthetic peptide
SSGWNWFDP

SEQ ID NO: 21851 - DNA, 21 bp, Artificial Sequence
  Description of Artificial Sequence: Synthetic oligonucleotide
gactacggcggtatggacgtc

SEQ ID NO: 21852 - protein, 7 aa, Artificial Sequence
  Description of Artificial Sequence: Synthetic peptide
DYGGMDV

SEQ ID NO: 21853 - DNA, 21 bp, Artificial Sequence
  Description of Artificial Sequence: Synthetic oligonucleotide
gactacggcggtatggacgtc

SEQ ID NO: 21854 - protein, 7 aa, Artificial Sequence
  Description of Artificial Sequence: Synthetic peptide
DYGGMDV

SEQ ID NO: 21855 - DNA, 27 bp, Artificial Sequence
  Description of Artificial Sequence: Synthetic oligonucleotide
agcagtggctggtacttctttgactac

SEQ ID NO: 21856 - protein, 9 aa, Artificial Sequence
  Description of Artificial Sequence: Synthetic peptide
SSGWYFFDY

SEQ ID NO: 21857 - DNA, 21 bp, Artificial Sequence
  Description of Artificial Sequence: Synthetic oligonucleotide
gactacggcggtatggacgtc

SEQ ID NO: 21858 - protein, 7 aa, Artificial Sequence
  Description of Artificial Sequence: Synthetic peptide
DYGGMDV

SEQ ID NO: 21859 - DNA, 21 bp, Artificial Sequence
  Description of Artificial Sequence: Synthetic oligonucleotide
gactacggcggtatggacgtc

SEQ ID NO: 21860 - protein, 7 aa, Artificial Sequence
  Description of Artificial Sequence: Synthetic peptide
DYGGMDV

SEQ ID NO: 21861 - DNA, 21 bp, Artificial Sequence
  Description of Artificial Sequence: Synthetic oligonucleotide
gactacggcggtatggacgtc

SEQ ID NO: 21862 - protein, 7 aa, Artificial Sequence
  Description of Artificial Sequence: Synthetic peptide
DYGGMDV

SEQ ID NO: 21863 - DNA, 27 bp, Artificial Sequence
  Description of Artificial Sequence: Synthetic oligonucleotide
agtagtggctggtactggttcgacccc

SEQ ID NO: 21864 - protein, 9 aa, Artificial Sequence
  Description of Artificial Sequence: Synthetic peptide
SSGWYWFDP

SEQ ID NO: 21865 - DNA, 27 bp, Artificial Sequence
  Description of Artificial Sequence: Synthetic oligonucleotide
agcagtggctggtactggttcgacccc

SEQ ID NO: 21866 - protein, 9 aa, Artificial Sequence
  Description of Artificial Sequence: Synthetic peptide
SSGWYWFDP

SEQ ID NO: 21867 - DNA, 21 bp, Artificial Sequence
  Description of Artificial Sequence: Synthetic oligonucleotide
gactacggcggtatggacgtc

SEQ ID NO: 21868 - protein, 7 aa, Artificial Sequence
  Description of Artificial Sequence: Synthetic peptide
DYGGMDV

SEQ ID NO: 21869 - DNA, 27 bp, Artificial Sequence
  Description of Artificial Sequence: Synthetic oligonucleotide
accagtggctggaacttctttgactac

SEQ ID NO: 21870 - protein, 9 aa, Artificial Sequence
  Description of Artificial Sequence: Synthetic peptide
TSGWNFFDY

SEQ ID NO: 21871 - DNA, 21 bp, Artificial Sequence
  Description of Artificial Sequence: Synthetic oligonucleotide
gactacgggggtttggacgtc

SEQ ID NO: 21872 - protein, 7 aa, Artificial Sequence
  Description of Artificial Sequence: Synthetic peptide
DYGGLDV

SEQ ID NO: 21873 - DNA, 21 bp, Artificial Sequence
  Description of Artificial Sequence: Synthetic oligonucleotide
gactacggtgggcttgactac

SEQ ID NO: 21874 - protein, 7 aa, Artificial Sequence
  Description of Artificial Sequence: Synthetic peptide
DYGGLDY

SEQ ID NO: 21875 - DNA, 21 bp, Artificial Sequence
  Description of Artificial Sequence: Synthetic oligonucleotide
gactacgggggtatagacgtc

SEQ ID NO: 21876 - protein, 7 aa, Artificial Sequence
  Description of Artificial Sequence: Synthetic peptide
DYGGIDV

SEQ ID NO: 21877 - DNA, 27 bp, Artificial Sequence
  Description of Artificial Sequence: Synthetic oligonucleotide
agcagtggctggtacatctttgactac

SEQ ID NO: 21878 - protein, 9 aa, Artificial Sequence
  Description of Artificial Sequence: Synthetic peptide
SSGWYIFDY

SEQ ID NO: 21879 - DNA, 27 bp, Artificial Sequence
  Description of Artificial Sequence: Synthetic oligonucleotide
agcagtggctggtactggttcgacccc

SEQ ID NO: 21880 - protein, 9 aa, Artificial Sequence
  Description of Artificial Sequence: Synthetic peptide
SSGWYWFDP

SEQ ID NO: 21881 - DNA, 21 bp, Artificial Sequence
  Description of Artificial Sequence: Synthetic oligonucleotide
gactacggtgggcttgactac

SEQ ID NO: 21882 - protein, 7 aa, Artificial Sequence
  Description of Artificial Sequence: Synthetic peptide
DYGGLDY

SEQ ID NO: 21883 - DNA, 33 bp, Artificial Sequence; identical to SEQ ID NO: 21757
  Description of Artificial Sequence: Synthetic oligonucleotide

SEQ ID NO: 21884 - protein, 11 aa, Artificial Sequence
  Description of Artificial Sequence: Synthetic peptide
DGSYGYDGLDY

SEQ ID NO: 21885 - DNA, 33 bp, Artificial Sequence
  Description of Artificial Sequence: Synthetic oligonucleotide
gatggcagctatgggtatgacggccttgactac

SEQ ID NO: 21886 - protein, 11 aa, Artificial Sequence
  Description of Artificial Sequence: Synthetic peptide
DGSYGYDGLDY

SEQ ID NO: 21887 - DNA, 21 bp, Artificial Sequence
  Description of Artificial Sequence: Synthetic oligonucleotide
gactacggcggtatggacgtc

SEQ ID NO: 21888 - protein, 7 aa, Artificial Sequence
  Description of Artificial Sequence: Synthetic peptide
DYGGMDV

SEQ ID NO: 21889 - DNA, 27 bp, Artificial Sequence
  Description of Artificial Sequence: Synthetic oligonucleotide
agcagtggctggtactggttcgacccc

SEQ ID NO: 21890 - protein, 9 aa, Artificial Sequence
  Description of Artificial Sequence: Synthetic peptide
SSGWYWFDP

SEQ ID NO: 21891 - DNA, 21 bp, Artificial Sequence
  Description of Artificial Sequence: Synthetic oligonucleotide
gactacggcggtatggacgtc

SEQ ID NO: 21892 - protein, 7 aa, Artificial Sequence
  Description of Artificial Sequence: Synthetic peptide
DYGGMDV

SEQ ID NO: 21893 - DNA, 21 bp, Artificial Sequence
  Description of Artificial Sequence: Synthetic oligonucleotide
gactacggcggtatggacgtc

SEQ ID NO: 21894 - protein, 7 aa, Artificial Sequence
  Description of Artificial Sequence: Synthetic peptide
DYGGMDV

SEQ ID NO: 21895 - DNA, 27 bp, Artificial Sequence
  Description of Artificial Sequence: Synthetic oligonucleotide
tccagtggctggaactggttcgacccc

SEQ ID NO: 21896 - protein, 9 aa, Artificial Sequence
  Description of Artificial Sequence: Synthetic peptide
SSGWNWFDP

SEQ ID NO: 21897 - DNA, 27 bp, Artificial Sequence
  Description of Artificial Sequence: Synthetic oligonucleotide
agcagtggctggtactggttcgacccc

SEQ ID NO: 21898 - protein, 9 aa, Artificial Sequence
  Description of Artificial Sequence: Synthetic peptide
SSGWYWFDP

SEQ ID NO: 21899 - DNA, 21 bp, Artificial Sequence
  Description of Artificial Sequence: Synthetic oligonucleotide
gactacggcggtatggacgtc

SEQ ID NO: 21900 - protein, 7 aa, Artificial Sequence
  Description of Artificial Sequence: Synthetic peptide
DYGGMDV

SEQ ID NO: 21901 - DNA, 21 bp, Artificial Sequence
  Description of Artificial Sequence: Synthetic oligonucleotide
gactacggcggtatggacgtc

SEQ ID NO: 21902 - protein, 7 aa, Artificial Sequence
  Description of Artificial Sequence: Synthetic peptide
DYGGMDV

SEQ ID NO: 21903 - DNA, 27 bp, Artificial Sequence
  Description of Artificial Sequence: Synthetic oligonucleotide
agcagtggctggtactggttcgacccc

SEQ ID NO: 21904 - protein, 9 aa, Artificial Sequence
  Description of Artificial Sequence: Synthetic peptide
SSGWYWFDP

SEQ ID NO: 21905 - DNA, 27 bp, Artificial Sequence
  Description of Artificial Sequence: Synthetic oligonucleotide
agtagtggctggtactggttcgacccc

SEQ ID NO: 21906 - protein, 9 aa, Artificial Sequence
  Description of Artificial Sequence: Synthetic peptide
SSGWYWFDP

SEQ ID NO: 21907 - DNA, 27 bp, Artificial Sequence
  Description of Artificial Sequence: Synthetic oligonucleotide
agtagtggctggtactggttcgacccc

SEQ ID NO: 21908 - protein, 9 aa, Artificial Sequence
  Description of Artificial Sequence: Synthetic peptide
SSGWYWFDP

SEQ ID NO: 21909 - DNA, 21 bp, Artificial Sequence
  Description of Artificial Sequence: Synthetic oligonucleotide
gactacggcggtatggacgtc

SEQ ID NO: 21910 - protein, 7 aa, Artificial Sequence
  Description of Artificial Sequence: Synthetic peptide
DYGGMDV

SEQ ID NO: 21911 - DNA, 27 bp, Artificial Sequence
  Description of Artificial Sequence: Synthetic oligonucleotide
agcagtggctggtactggttcgacccc

SEQ ID NO: 21912 - protein, 9 aa, Artificial Sequence
  Description of Artificial Sequence: Synthetic peptide
SSGWYWFDP

SEQ ID NO: 21913 - DNA, 51 bp, Artificial Sequence
  Description of Artificial Sequence: Synthetic oligonucleotide
ggcttttacgatactttgactggttccggctactactacgttatggacgtc

SEQ ID NO: 21914 - protein, 17 aa, Artificial Sequence
  Description of Artificial Sequence: Synthetic peptide
GFYDTLTGSGYYYVMDV

SEQ ID NO: 21915 - DNA, 21 bp, Artificial Sequence
  Description of Artificial Sequence: Synthetic oligonucleotide
gactacggcggtatggacgtc

SEQ ID NO: 21916 - protein, 7 aa, Artificial Sequence
  Description of Artificial Sequence: Synthetic peptide
DYGGMDV

SEQ ID NO: 21917 - DNA, 27 bp, Artificial Sequence
  Description of Artificial Sequence: Synthetic oligonucleotide
agtagtggctggtactggttcgacccc

SEQ ID NO: 21918 - protein, 9 aa, Artificial Sequence
  Description of Artificial Sequence: Synthetic peptide
SSGWYWFDP

SEQ ID NO: 21919 - DNA, 27 bp, Artificial Sequence
  Description of Artificial Sequence: Synthetic oligonucleotide
agcagtggctggtactggttcgacccc

SEQ ID NO: 21920 - protein, 9 aa, Artificial Sequence
  Description of Artificial Sequence: Synthetic peptide
SSGWYWFDP

SEQ ID NO: 21921 - DNA, 27 bp, Artificial Sequence
  Description of Artificial Sequence: Synthetic oligonucleotide
agcagtggctggtactggttcgacccc

SEQ ID NO: 21922 - protein, 9 aa, Artificial Sequence
  Description of Artificial Sequence: Synthetic peptide
SSGWYWFDP

SEQ ID NO: 21923 - DNA, 27 bp, Artificial Sequence
  Description of Artificial Sequence: Synthetic oligonucleotide
agtagtggctggtactggttcgacccc

SEQ ID NO: 21924 - protein, 9 aa, Artificial Sequence
  Description of Artificial Sequence: Synthetic peptide
SSGWYWFDP

SEQ ID NO: 21925 - DNA, 21 bp, Artificial Sequence
  Description of Artificial Sequence: Synthetic oligonucleotide
gactacggtgggcttgactac

SEQ ID NO: 21926 - protein, 7 aa, Artificial Sequence
  Description of Artificial Sequence: Synthetic peptide
DYGGLDY

SEQ ID NO: 21927 - DNA, 21 bp, Artificial Sequence
  Description of Artificial Sequence: Synthetic oligonucleotide
gactacggcggtatggacgtc

SEQ ID NO: 21928 - protein, 7 aa, Artificial Sequence
  Description of Artificial Sequence: Synthetic peptide
DYGGMDV

SEQ ID NO: 21929 - DNA, 27 bp, Artificial Sequence
  Description of Artificial Sequence: Synthetic oligonucleotide
tccagtggctggcactggttcgacccc

SEQ ID NO: 21930 - protein, 9 aa, Artificial Sequence
  Description of Artificial Sequence: Synthetic peptide
SSGWHWFDP

SEQ ID NO: 21931 - DNA, 21 bp, Artificial Sequence
  Description of Artificial Sequence: Synthetic oligonucleotide
gactacggtgggcttgactac

SEQ ID NO: 21932 - protein, 7 aa, Artificial Sequence
  Description of Artificial Sequence: Synthetic peptide
DYGGLDY

SEQ ID NO: 21933 - DNA, 27 bp, Artificial Sequence
  Description of Artificial Sequence: Synthetic oligonucleotide
agcagtggctggtacatctttgactac

SEQ ID NO: 21934 - protein, 9 aa, Artificial Sequence
  Description of Artificial Sequence: Synthetic peptide
SSGWYIFDY

SEQ ID NO: 21935 - DNA, 27 bp, Artificial Sequence
  Description of Artificial Sequence: Synthetic oligonucleotide
tccagtggctggcactggttcgacccc

SEQ ID NO: 21936 - protein, 9 aa, Artificial Sequence
  Description of Artificial Sequence: Synthetic peptide
SSGWHWFDP

SEQ ID NO: 21937 - DNA, 33 bp, Artificial Sequence; identical to SEQ ID NO: 21781
  Description of Artificial Sequence: Synthetic oligonucleotide

SEQ ID NO: 21938 - protein, 11 aa, Artificial Sequence
  Description of Artificial Sequence: Synthetic peptide
DGSYGYDGLDY

SEQ ID NO: 21939 - DNA, 21 bp, Artificial Sequence
  Description of Artificial Sequence: Synthetic oligonucleotide
gactacgggggtatagacgtc

SEQ ID NO: 21940 - protein, 7 aa, Artificial Sequence
  Description of Artificial Sequence: Synthetic peptide
DYGGIDV

SEQ ID NO: 21941 - DNA, 36 bp, Artificial Sequence
  Description of Artificial Sequence: Synthetic oligonucleotide
gatccctttatagtgggagctacttactttgactac

SEQ ID NO: 21942 - protein, 12 aa, Artificial Sequence
  Description of Artificial Sequence: Synthetic peptide
DPFIVGATYFDY

SEQ ID NO: 21943 - DNA, 27 bp, Artificial Sequence
  Description of Artificial Sequence: Synthetic oligonucleotide
tccagtggctggtactggttcgacccc

SEQ ID NO: 21944 - protein, 9 aa, Artificial Sequence
  Description of Artificial Sequence: Synthetic peptide
SSGWYWFDP

SEQ ID NO: 21945 - DNA, 21 bp, Artificial Sequence
  Description of Artificial Sequence: Synthetic oligonucleotide
gactacggcggtatggacgtc

SEQ ID NO: 21946 - protein, 7 aa, Artificial Sequence
  Description of Artificial Sequence: Synthetic peptide
DYGGMDV

SEQ ID NO: 21947 - DNA, 21 bp, Artificial Sequence
  Description of Artificial Sequence: Synthetic oligonucleotide
gactacggcggtatggacgtc

SEQ ID NO: 21948 - protein, 7 aa, Artificial Sequence
  Description of Artificial Sequence: Synthetic peptide
DYGGMDV

SEQ ID NO: 21949 - DNA, 27 bp, Artificial Sequence
  Description of Artificial Sequence: Synthetic oligonucleotide
agtagtggctggtactggttcgacccc

SEQ ID NO: 21950 - protein, 9 aa, Artificial Sequence
  Description of Artificial Sequence: Synthetic peptide
SSGWYWFDP

SEQ ID NO: 21951 - DNA, 21 bp, Artificial Sequence
  Description of Artificial Sequence: Synthetic oligonucleotide
gactacggcggtatggacgtc

SEQ ID NO: 21952 - protein, 7 aa, Artificial Sequence
  Description of Artificial Sequence: Synthetic peptide
DYGGMDV

SEQ ID NO: 21953 - DNA, 21 bp, Artificial Sequence
  Description of Artificial Sequence: Synthetic oligonucleotide
gactacggtgggcttgactac

SEQ ID NO: 21954 - protein, 7 aa, Artificial Sequence
  Description of Artificial Sequence: Synthetic peptide
DYGGLDY

SEQ ID NO: 21955 - DNA, 21 bp, Artificial Sequence
  Description of Artificial Sequence: Synthetic oligonucleotide
gactacgggggtttggacgtc

SEQ ID NO: 21956 - protein, 7 aa, Artificial Sequence
  Description of Artificial Sequence: Synthetic peptide
DYGGLDV

SEQ ID NO: 21957 - DNA, 21 bp, Artificial Sequence
  Description of Artificial Sequence: Synthetic oligonucleotide
gactacggcggtatggacgtc

SEQ ID NO: 21958 - protein, 7 aa, Artificial Sequence
  Description of Artificial Sequence: Synthetic peptide
DYGGMDV

SEQ ID NO: 21959 - DNA, 27 bp, Artificial Sequence
  Description of Artificial Sequence: Synthetic oligonucleotide
accagtggctggaacttctttgactac

SEQ ID NO: 21960 - protein, 9 aa, Artificial Sequence
  Description of Artificial Sequence: Synthetic peptide
TSGWNFFDY

SEQ ID NO: 21961 - DNA, 21 bp, Artificial Sequence
  Description of Artificial Sequence: Synthetic oligonucleotide
gactacggtggtttggacgtc

SEQ ID NO: 21962 - protein, 7 aa, Artificial Sequence
  Description of Artificial Sequence: Synthetic peptide
DYGGLDV

SEQ ID NO: 21963 - DNA, 27 bp, Artificial Sequence
  Description of Artificial Sequence: Synthetic oligonucleotide
agtagtggctggtacaaatttgactac

SEQ ID NO: 21964 - protein, 9 aa, Artificial Sequence
  Description of Artificial Sequence: Synthetic peptide
SSGWYKFDY

SEQ ID NO: 21965 - DNA, 27 bp, Artificial Sequence
  Description of Artificial Sequence: Synthetic oligonucleotide
agtagtggctggtactggttcgacccc

SEQ ID NO: 21966 - protein, 9 aa, Artificial Sequence
  Description of Artificial Sequence: Synthetic peptide
SSGWYWFDP

SEQ ID NO: 21967 - DNA, 21 bp, Artificial Sequence
  Description of Artificial Sequence: Synthetic oligonucleotide
gactacggcggtatggacgtc

SEQ ID NO: 21968 - protein, 7 aa, Artificial Sequence
  Description of Artificial Sequence: Synthetic peptide
DYGGMDV

SEQ ID NO: 21969 - DNA, 21 bp, Artificial Sequence
  Description of Artificial Sequence: Synthetic oligonucleotide
gactacggcggtatggacgtc

SEQ ID NO: 21970 - protein, 7 aa, Artificial Sequence
  Description of Artificial Sequence: Synthetic peptide
DYGGMDV

SEQ ID NO: 21971 - DNA, 27 bp, Artificial Sequence
  Description of Artificial Sequence: Synthetic oligonucleotide
tccagtggctggtcctggttcgacccc

SEQ ID NO: 21972 - protein, 9 aa, Artificial Sequence
  Description of Artificial Sequence: Synthetic peptide
SSGWSWFDP

SEQ ID NO: 21973 - DNA, 21 bp, Artificial Sequence
  Description of Artificial Sequence: Synthetic oligonucleotide
gactacggcggtatggacgtc

SEQ ID NO: 21974 - protein, 7 aa, Artificial Sequence
  Description of Artificial Sequence: Synthetic peptide
DYGGMDV

SEQ ID NO: 21975 - DNA, 21 bp, Artificial Sequence
  Description of Artificial Sequence: Synthetic oligonucleotide
gactacggtggtttggacgtc

SEQ ID NO: 21976 - protein, 7 aa, Artificial Sequence
  Description of Artificial Sequence: Synthetic peptide
DYGGLDV

SEQ ID NO: 21977 - DNA, 21 bp, Artificial Sequence
  Description of Artificial Sequence: Synthetic oligonucleotide
gactacggcggtatggacgtc

SEQ ID NO: 21978 - protein, 7 aa, Artificial Sequence
  Description of Artificial Sequence: Synthetic peptide
DYGGMDV

SEQ ID NO: 21979 - DNA, 33 bp, Artificial Sequence
  Description of Artificial Sequence: Synthetic oligonucleotide
gattttggagtgggctactacggtatggacgtc

SEQ ID NO: 21980 - protein, 11 aa, Artificial Sequence
  Description of Artificial Sequence: Synthetic peptide
DFGVGYYGMDV

SEQ ID NO: 21981 - DNA, 21 bp, Artificial Sequence
  Description of Artificial Sequence: Synthetic oligonucleotide
gactacggcggtatggacgtc

SEQ ID NO: 21982 - protein, 7 aa, Artificial Sequence
  Description of Artificial Sequence: Synthetic peptide
DYGGMDV

SEQ ID NO: 21983 - DNA, 27 bp, Artificial Sequence
  Description of Artificial Sequence: Synthetic oligonucleotide
agcagtggctggtactggttcgacccc

SEQ ID NO: 21984 - protein, 9 aa, Artificial Sequence
  Description of Artificial Sequence: Synthetic peptide
SSGWYWFDP

SEQ ID NO: 21985 - DNA, 27 bp, Artificial Sequence
  Description of Artificial Sequence: Synthetic oligonucleotide
agcagtggctggtacttctttgactac

SEQ ID NO: 21986 - protein, 9 aa, Artificial Sequence
  Description of Artificial Sequence: Synthetic peptide
SSGWYFFDY

SEQ ID NO: 21987 - DNA, 21 bp, Artificial Sequence
  Description of Artificial Sequence: Synthetic oligonucleotide
gactacggcggtatggacgtc

SEQ ID NO: 21988 - protein, 7 aa, Artificial Sequence
  Description of Artificial Sequence: Synthetic peptide
DYGGMDV

SEQ ID NO: 21989 - DNA, 27 bp, Artificial Sequence
  Description of Artificial Sequence: Synthetic oligonucleotide
agcagtggctggtactactttgactac

SEQ ID NO: 21990 - protein, 9 aa, Artificial Sequence
  Description of Artificial Sequence: Synthetic peptide
SSGWYYFDY

SEQ ID NO: 21991 - DNA, 21 bp, Artificial Sequence
  Description of Artificial Sequence: Synthetic oligonucleotide
gactacggcggtatggacgtc

SEQ ID NO: 21992 - protein, 7 aa, Artificial Sequence
  Description of Artificial Sequence: Synthetic peptide
DYGGMDV

SEQ ID NO: 21993 - DNA, 27 bp, Artificial Sequence
  Description of Artificial Sequence: Synthetic oligonucleotide
agcagtggctggtactggttcgacccc

SEQ ID NO: 21994 - protein, 9 aa, Artificial Sequence
  Description of Artificial Sequence: Synthetic peptide
SSGWYWFDP

SEQ ID NO: 21995 - DNA, 27 bp, Artificial Sequence
  Description of Artificial Sequence: Synthetic oligonucleotide
agcagtggctggtactactttgactac

SEQ ID NO: 21996 - protein, 9 aa, Artificial Sequence
  Description of Artificial Sequence: Synthetic peptide
SSGWYYFDY

SEQ ID NO: 21997 - DNA, 60 bp, Artificial Sequence
  Description of Artificial Sequence: Synthetic oligonucleotide
gggttttacgattttttgactggttattcccccacctactactactacgatatggacgtc

SEQ ID NO: 21998 - protein, 20 aa, Artificial Sequence
  Description of Artificial Sequence: Synthetic peptide
GFYDFLTGYSPTYYYYDMDV

SEQ ID NO: 21999 - DNA, 21 bp, Artificial Sequence
  Description of Artificial Sequence: Synthetic oligonucleotide
gactacggcggtatggacgtc

SEQ ID NO: 22000 - protein, 7 aa, Artificial Sequence
  Description of Artificial Sequence: Synthetic peptide
DYGGMDV

SEQ ID NO: 22001 - DNA, 21 bp, Artificial Sequence
  Description of Artificial Sequence: Synthetic oligonucleotide
gactacggcggtatggacgtc

SEQ ID NO: 22002 - protein, 7 aa, Artificial Sequence
  Description of Artificial Sequence: Synthetic peptide
DYGGMDV

SEQ ID NO: 22003 - DNA, 21 bp, Artificial Sequence
  Description of Artificial Sequence: Synthetic oligonucleotide
gactacggcggtatggacgtc

SEQ ID NO: 22004 - protein, 7 aa, Artificial Sequence
  Description of Artificial Sequence: Synthetic peptide
DYGGMDV

SEQ ID NO: 22005 - DNA, 27 bp, Artificial Sequence
  Description of Artificial Sequence: Synthetic oligonucleotide
agcagtggctggtactactttgactcc

SEQ ID NO: 22006 - protein, 9 aa, Artificial Sequence
  Description of Artificial Sequence: Synthetic peptide
SSGWYYFDS

SEQ ID NO: 22007 - DNA, 21 bp, Artificial Sequence
  Description of Artificial Sequence: Synthetic oligonucleotide
gactacggcggtatggacgtc

SEQ ID NO: 22008 - protein, 7 aa, Artificial Sequence
  Description of Artificial Sequence: Synthetic peptide
DYGGMDV

SEQ ID NO: 22009 - DNA, 51 bp, Artificial Sequence
  Description of Artificial Sequence: Synthetic oligonucleotide
gctcttgactacggtgactccttgggctactactactacggtatggacgtc

SEQ ID NO: 22010 - protein, 17 aa, Artificial Sequence
  Description of Artificial Sequence: Synthetic peptide
ALDYGDSLGYYYYGMDV

SEQ ID NO: 22011 - DNA, 21 bp, Artificial Sequence
  Description of Artificial Sequence: Synthetic oligonucleotide
gactacggcggtatggacgtc

SEQ ID NO: 22012 - protein, 7 aa, Artificial Sequence
  Description of Artificial Sequence: Synthetic peptide
DYGGMDV

SEQ ID NO: 22013 - DNA, 21 bp, Artificial Sequence
  Description of Artificial Sequence: Synthetic oligonucleotide
gactacggcggtatggacgtc

SEQ ID NO: 22014 - protein, 7 aa, Artificial Sequence
  Description of Artificial Sequence: Synthetic peptide
DYGGMDV

SEQ ID NO: 22015 - DNA, 21 bp, Artificial Sequence
  Description of Artificial Sequence: Synthetic oligonucleotide
gactacggcggtatggacgtc

SEQ ID NO: 22016 - protein, 7 aa, Artificial Sequence
  Description of Artificial Sequence: Synthetic peptide
DYGGMDV

SEQ ID NO: 22017 - DNA, 21 bp, Artificial Sequence
  Description of Artificial Sequence: Synthetic oligonucleotide
gactacggtggtttggacgtc

SEQ ID NO: 22018 - protein, 7 aa, Artificial Sequence
  Description of Artificial Sequence: Synthetic peptide
DYGGLDV

SEQ ID NO: 22019 - DNA, 21 bp, Artificial Sequence
  Description of Artificial Sequence: Synthetic oligonucleotide
gactacggcggtatggacgtc

SEQ ID NO: 22020 - protein, 7 aa, Artificial Sequence
  Description of Artificial Sequence: Synthetic peptide
DYGGMDV

SEQ ID NO: 22021 - DNA, 21 bp, Artificial Sequence
  Description of Artificial Sequence: Synthetic oligonucleotide
gactacggcggtatggacgtc

SEQ ID NO: 22022 - protein, 7 aa, Artificial Sequence
  Description of Artificial Sequence: Synthetic peptide
DYGGMDV

SEQ ID NO: 22023 - DNA, 21 bp, Artificial Sequence
  Description of Artificial Sequence: Synthetic oligonucleotide
gactacggcggtatggacgtc

SEQ ID NO: 22024 - protein, 7 aa, Artificial Sequence
  Description of Artificial Sequence: Synthetic peptide
DYGGMDV

SEQ ID NO: 22025 - DNA, 24 bp, Artificial Sequence
  Description of Artificial Sequence: Synthetic oligonucleotide
gagatggggtggttagatgactac

SEQ ID NO: 22026 - protein, 8 aa, Artificial Sequence
  Description of Artificial Sequence: Synthetic peptide
EMGWLDDY

SEQ ID NO: 22027 - DNA, 27 bp, Artificial Sequence
  Description of Artificial Sequence: Synthetic oligonucleotide
tccagtggctggcactggttcgacccc

SEQ ID NO: 22028 - protein, 9 aa, Artificial Sequence
  Description of Artificial Sequence: Synthetic peptide
SSGWHWFDP

SEQ ID NO: 22029 - DNA, 27 bp, Artificial Sequence
  Description of Artificial Sequence: Synthetic oligonucleotide
agcagtggctggtacatctttgactac

SEQ ID NO: 22030 - protein, 9 aa, Artificial Sequence
  Description of Artificial Sequence: Synthetic peptide
SSGWYIFDY

SEQ ID NO: 22031 - DNA, 21 bp, Artificial Sequence
  Description of Artificial Sequence: Synthetic oligonucleotide
gactacggcggtatggacgtc

SEQ ID NO: 22032 - protein, 7 aa, Artificial Sequence
  Description of Artificial Sequence: Synthetic peptide
DYGGMDV

SEQ ID NO: 22033 - DNA, 51 bp, Artificial Sequence; identical to SEQ ID NO: 21773
  Description of Artificial Sequence: Synthetic oligonucleotide

SEQ ID NO: 22034 - protein, 17 aa, Artificial Sequence
  Description of Artificial Sequence: Synthetic peptide
VLDYGDSLGYYYYGMDV

SEQ ID NO: 22035 - DNA, 27 bp, Artificial Sequence
  Description of Artificial Sequence: Synthetic oligonucleotide
agcagtggctggtactggttcgacccc

SEQ ID NO: 22036 - protein, 9 aa, Artificial Sequence
  Description of Artificial Sequence: Synthetic peptide
SSGWYWFDP

SEQ ID NO: 22037 - DNA, 21 bp, Artificial Sequence
  Description of Artificial Sequence: Synthetic oligonucleotide
gactacggcggtatggacgtc

SEQ ID NO: 22038 - protein, 7 aa, Artificial Sequence
  Description of Artificial Sequence: Synthetic peptide
DYGGMDV

SEQ ID NO: 22039 - DNA, 21 bp, Artificial Sequence
  Description of Artificial Sequence: Synthetic oligonucleotide
gactacggcggtatggacgtc

SEQ ID NO: 22040 - protein, 7 aa, Artificial Sequence
  Description of Artificial Sequence: Synthetic peptide
DYGGMDV

SEQ ID NO: 22041 - DNA, 21 bp, Artificial Sequence
  Description of Artificial Sequence: Synthetic oligonucleotide
gactacggcggtatggacgtc

SEQ ID NO: 22042 - protein, 7 aa, Artificial Sequence
  Description of Artificial Sequence: Synthetic peptide
DYGGMDV

SEQ ID NO: 22043 - DNA, 21 bp, Artificial Sequence
  Description of Artificial Sequence: Synthetic oligonucleotide
gactacggcggtatggacgtc

SEQ ID NO: 22044 - protein, 7 aa, Artificial Sequence
  Description of Artificial Sequence: Synthetic peptide
DYGGMDV

SEQ ID NO: 22045 - DNA, 27 bp, Artificial Sequence
  Description of Artificial Sequence: Synthetic oligonucleotide
agcagtggctggtactggttcgacccc

SEQ ID NO: 22046 - protein, 9 aa, Artificial Sequence
  Description of Artificial Sequence: Synthetic peptide
SSGWYWFDP

SEQ ID NO: 22047 - DNA, 21 bp, Artificial Sequence
  Description of Artificial Sequence: Synthetic oligonucleotide
gactacggcggtatggacgtc

SEQ ID NO: 22048 - protein, 7 aa, Artificial Sequence
  Description of Artificial Sequence: Synthetic peptide
DYGGMDV

SEQ ID NO: 22049 - DNA, 21 bp, Artificial Sequence
  Description of Artificial Sequence: Synthetic oligonucleotide
gactacggcggtttggacgtc

SEQ ID NO: 22050 - protein, 7 aa, Artificial Sequence
  Description of Artificial Sequence: Synthetic peptide
DYGGLDV

SEQ ID NO: 22051 - DNA, 51 bp, Artificial Sequence; identical to SEQ ID NO: 22009
  Description of Artificial Sequence: Synthetic oligonucleotide

SEQ ID NO: 22052 - protein, 17 aa, Artificial Sequence
  Description of Artificial Sequence: Synthetic peptide
ALDYGDSLGYYYYGMDV

SEQ ID NO: 22053 - DNA, 36 bp, Artificial Sequence; identical to SEQ ID NO: 21941
  Description of Artificial Sequence: Synthetic oligonucleotide

SEQ ID NO: 22054 - protein, 12 aa, Artificial Sequence
  Description of Artificial Sequence: Synthetic peptide
DPFIVGATYFDY

SEQ ID NO: 22055 - DNA, 21 bp, Artificial Sequence
  Description of Artificial Sequence: Synthetic oligonucleotide
gactacggcggtatggacgtc

SEQ ID NO: 22056 - protein, 7 aa, Artificial Sequence
  Description of Artificial Sequence: Synthetic peptide
DYGGMDV

SEQ ID NO: 22057 - DNA, 27 bp, Artificial Sequence
  Description of Artificial Sequence: Synthetic oligonucleotide
agcagtggctggtacttttttgactac

SEQ ID NO: 22058 - protein, 9 aa, Artificial Sequence
  Description of Artificial Sequence: Synthetic peptide
SSGWYFFDY

SEQ ID NO: 22059 - DNA, 21 bp, Artificial Sequence
  Description of Artificial Sequence: Synthetic oligonucleotide
gactacggcggtatggacgtc

SEQ ID NO: 22060 - protein, 7 aa, Artificial Sequence
  Description of Artificial Sequence: Synthetic peptide
DYGGMDV

SEQ ID NO: 22061 - DNA, 27 bp, Artificial Sequence
  Description of Artificial Sequence: Synthetic oligonucleotide
accagtggcgggaagttcttcgactac

SEQ ID NO: 22062 - protein, 9 aa, Artificial Sequence
  Description of Artificial Sequence: Synthetic peptide
TSGGKFFDY

SEQ ID NO: 22063 - DNA, 21 bp, Artificial Sequence
  Description of Artificial Sequence: Synthetic oligonucleotide
gactacggcggtatggacgtc

SEQ ID NO: 22064 - protein, 7 aa, Artificial Sequence
  Description of Artificial Sequence: Synthetic peptide
DYGGMDV

SEQ ID NO: 22065 - DNA, 21 bp, Artificial Sequence
  Description of Artificial Sequence: Synthetic oligonucleotide
gactacggcggtatggacgtc

SEQ ID NO: 22066 - protein, 7 aa, Artificial Sequence
  Description of Artificial Sequence: Synthetic peptide
DYGGMDV

SEQ ID NO: 22067 - DNA, 21 bp, Artificial Sequence
  Description of Artificial Sequence: Synthetic oligonucleotide
gactacggtgggcttgactac

SEQ ID NO: 22068 - protein, 7 aa, Artificial Sequence
  Description of Artificial Sequence: Synthetic peptide
DYGGLDY

SEQ ID NO: 22069 - DNA, 21 bp, Artificial Sequence
  Description of Artificial Sequence: Synthetic oligonucleotide
gactacggcggtatggacgtc

SEQ ID NO: 22070 - protein, 7 aa, Artificial Sequence
  Description of Artificial Sequence: Synthetic peptide
DYGGMDV

SEQ ID NO: 22071 - DNA, 42 bp, Artificial Sequence
  Description of Artificial Sequence: Synthetic oligonucleotide
gaaaaatatagcagtggctggtacgactacggtatggacgtc

SEQ ID NO: 22072 - protein, 14 aa, Artificial Sequence
  Description of Artificial Sequence: Synthetic peptide
EKYSSGWYDYGMDV

SEQ ID NO: 22073 - DNA, 27 bp, Artificial Sequence
  Description of Artificial Sequence: Synthetic oligonucleotide
tccagtggctggcactggttcgacccc

SEQ ID NO: 22074 - protein, 9 aa, Artificial Sequence
  Description of Artificial Sequence: Synthetic peptide
SSGWHWFDP

SEQ ID NO: 22075 - DNA, 27 bp, Artificial Sequence
  Description of Artificial Sequence: Synthetic oligonucleotide
agcagtggctggtactactttgactac

SEQ ID NO: 22076 - protein, 9 aa, Artificial Sequence
  Description of Artificial Sequence: Synthetic peptide
SSGWYYFDY

SEQ ID NO: 22077 - DNA, 27 bp, Artificial Sequence
  Description of Artificial Sequence: Synthetic oligonucleotide
tccagtggctggaagtggttcgacccc

SEQ ID NO: 22078 - protein, 9 aa, Artificial Sequence
  Description of Artificial Sequence: Synthetic peptide
SSGWKWFDP

SEQ ID NO: 22079 - DNA, 27 bp, Artificial Sequence
  Description of Artificial Sequence: Synthetic oligonucleotide
accagtggctggaagttctttgactac

SEQ ID NO: 22080 - protein, 9 aa, Artificial Sequence
  Description of Artificial Sequence: Synthetic peptide
TSGWKFFDY

SEQ ID NO: 22081 - DNA, 21 bp, Artificial Sequence
  Description of Artificial Sequence: Synthetic oligonucleotide
gactacggcggtatggacgtc

SEQ ID NO: 22082 - protein, 7 aa, Artificial Sequence
  Description of Artificial Sequence: Synthetic peptide
DYGGMDV

SEQ ID NO: 22083 - DNA, 21 bp, Artificial Sequence
  Description of Artificial Sequence: Synthetic oligonucleotide
gactacggcggtatggacgtc

SEQ ID NO: 22084 - protein, 7 aa, Artificial Sequence
  Description of Artificial Sequence: Synthetic peptide
DYGGMDV

SEQ ID NO: 22085 - DNA, 36 bp, Artificial Sequence; identical to SEQ ID NO: 21717
  Description of Artificial Sequence: Synthetic oligonucleotide

SEQ ID NO: 22086 - protein, 12 aa, Artificial Sequence
  Description of Artificial Sequence: Synthetic peptide
DRNIVGATYFES

SEQ ID NO: 22087 - DNA, 27 bp, Artificial Sequence
  Description of Artificial Sequence: Synthetic oligonucleotide
tccagtggctggaactggttcgacccc

SEQ ID NO: 22088 - protein, 9 aa, Artificial Sequence
  Description of Artificial Sequence: Synthetic peptide
SSGWNWFDP

SEQ ID NO: 22089 - DNA, 21 bp, Artificial Sequence
  Description of Artificial Sequence: Synthetic oligonucleotide
gactacggcggtatggacgtc

SEQ ID NO: 22090 - protein, 7 aa, Artificial Sequence
  Description of Artificial Sequence: Synthetic peptide
DYGGMDV

SEQ ID NO: 22091 - DNA, 21 bp, Artificial Sequence
  Description of Artificial Sequence: Synthetic oligonucleotide
gactacggcggtatggacgtc

SEQ ID NO: 22092 - protein, 7 aa, Artificial Sequence
  Description of Artificial Sequence: Synthetic peptide
DYGGMDV

SEQ ID NO: 22093 - DNA, 21 bp, Artificial Sequence
  Description of Artificial Sequence: Synthetic oligonucleotide
gactacggcggtatggacgtc

SEQ ID NO: 22094 - protein, 7 aa, Artificial Sequence
  Description of Artificial Sequence: Synthetic peptide
DYGGMDV

SEQ ID NO: 22095 - DNA, 27 bp, Artificial Sequence
  Description of Artificial Sequence: Synthetic oligonucleotide
agcagtggctggtactggttcgacccc

SEQ ID NO: 22096 - protein, 9 aa, Artificial Sequence
  Description of Artificial Sequence: Synthetic peptide
SSGWYWFDP

SEQ ID NO: 22097 - DNA, 27 bp, Artificial Sequence
  Description of Artificial Sequence: Synthetic oligonucleotide
agcagtggctggtactggttcgacccc

SEQ ID NO: 22098 - protein, 9 aa, Artificial Sequence
  Description of Artificial Sequence: Synthetic peptide
SSGWYWFDP

SEQ ID NO: 22099 - DNA, 27 bp, Artificial Sequence
  Description of Artificial Sequence: Synthetic oligonucleotide
tccagtggctggtactggttcgacccc

SEQ ID NO: 22100 - protein, 9 aa, Artificial Sequence
  Description of Artificial Sequence: Synthetic peptide
SSGWYWFDP

SEQ ID NO: 22101 - DNA, 27 bp, Artificial Sequence
  Description of Artificial Sequence: Synthetic oligonucleotide
cttgactctaactggggtcttgactac

SEQ ID NO: 22102 - protein, 9 aa, Artificial Sequence
  Description of Artificial Sequence: Synthetic peptide
LDSNWGLDY

SEQ ID NO: 22103 - DNA, 51 bp, Artificial Sequence; identical to SEQ ID NO: 21913
  Description of Artificial Sequence: Synthetic oligonucleotide

SEQ ID NO: 22104 - protein, 17 aa, Artificial Sequence
  Description of Artificial Sequence: Synthetic peptide
GFYDTLTGSGYYYVMDV

SEQ ID NO: 22105 - DNA, 27 bp, Artificial Sequence
  Description of Artificial Sequence: Synthetic oligonucleotide
tccagtggctggtcctggttcgacccc

SEQ ID NO: 22106 - protein, 9 aa, Artificial Sequence
  Description of Artificial Sequence: Synthetic peptide
SSGWSWFDP

SEQ ID NO: 22107 - DNA, 27 bp, Artificial Sequence
  Description of Artificial Sequence: Synthetic oligonucleotide
agtagtggctggtacaaatttgactac

SEQ ID NO: 22108 - protein, 9 aa, Artificial Sequence
  Description of Artificial Sequence: Synthetic peptide
SSGWYKFDY

SEQ ID NO: 22109 - DNA, 51 bp, Artificial Sequence
  Description of Artificial Sequence: Synthetic oligonucleotide
ggcggctacgatgttttgcctgggaataactactactacgatatggacgtc

SEQ ID NO: 22110 - protein, 17 aa, Artificial Sequence
  Description of Artificial Sequence: Synthetic peptide
GGYDVLPGNNYYYDMDV

SEQ ID NO: 22111 - DNA, 27 bp, Artificial Sequence
  Description of Artificial Sequence: Synthetic oligonucleotide
agcagtggctggtacttttttgactac

SEQ ID NO: 22112 - protein, 9 aa, Artificial Sequence
  Description of Artificial Sequence: Synthetic peptide
SSGWYFFDY

SEQ ID NO: 22113 - DNA, 21 bp, Artificial Sequence
  Description of Artificial Sequence: Synthetic oligonucleotide
gactacggcggtatggacgtc

SEQ ID NO: 22114 - protein, 7 aa, Artificial Sequence
  Description of Artificial Sequence: Synthetic peptide
DYGGMDV

SEQ ID NO: 22115 - DNA, 27 bp, Artificial Sequence
  Description of Artificial Sequence: Synthetic oligonucleotide
agcagtggctggtactggttcgacccc

SEQ ID NO: 22116 - protein, 9 aa, Artificial Sequence
  Description of Artificial Sequence: Synthetic peptide
SSGWYWFDP

SEQ ID NO: 22117 - DNA, 21 bp, Artificial Sequence
  Description of Artificial Sequence: Synthetic oligonucleotide
gactacggcggtatggacgtc

SEQ ID NO: 22118 - protein, 7 aa, Artificial Sequence
  Description of Artificial Sequence: Synthetic peptide
DYGGMDV

SEQ ID NO: 22119 - DNA, 39 bp, Artificial Sequence
  Description of Artificial Sequence: Synthetic oligonucleotide
gatcgtttagtgggagctaccgctgatgcttttgatatc

SEQ ID NO: 22120 - protein, 13 aa, Artificial Sequence
  Description of Artificial Sequence: Synthetic peptide
DRLVGATADAFDI

SEQ ID NO: 22121 - DNA, 27 bp, Artificial Sequence
  Description of Artificial Sequence: Synthetic oligonucleotide
cttgatctcctgtggagttttgactac

SEQ ID NO: 22122 - protein, 9 aa, Artificial Sequence
  Description of Artificial Sequence: Synthetic peptide
LDLLWSFDY

SEQ ID NO: 22123 - DNA, 39 bp, Artificial Sequence
  Description of Artificial Sequence: Synthetic oligonucleotide
cgggtgacggactacggtggtaacgactggttcgacccc

SEQ ID NO: 22124 - protein, 13 aa, Artificial Sequence
  Description of Artificial Sequence: Synthetic peptide
RVTDYGGNDWFDP

SEQ ID NO: 22125 - DNA, 45 bp, Artificial Sequence
  Description of Artificial Sequence: Synthetic oligonucleotide
atgggtatagaagtggctgtggactactactacggtatggacgtc

SEQ ID NO: 22126 - protein, 15 aa, Artificial Sequence
  Description of Artificial Sequence: Synthetic peptide
MGIEVAVDYYYGMDV

SEQ ID NO: 22127 - DNA, 27 bp, Artificial Sequence
  Description of Artificial Sequence: Synthetic oligonucleotide
agcagtggctggtactactttgactac

SEQ ID NO: 22128 - protein, 9 aa, Artificial Sequence
  Description of Artificial Sequence: Synthetic peptide
SSGWYYFDY

SEQ ID NO: 22129 - DNA, 33 bp, Artificial Sequence
  Description of Artificial Sequence: Synthetic oligonucleotide
gggaaatataactggaaccatgcttttgatatc

SEQ ID NO: 22130 - protein, 11 aa, Artificial Sequence
  Description of Artificial Sequence: Synthetic peptide
GKYNWNHAFDI

SEQ ID NO: 22131 - DNA, 42 bp, Artificial Sequence
  Description of Artificial Sequence: Synthetic oligonucleotide
aaggataatgattacgtttgggggagtccttactttgactac

SEQ ID NO: 22132 - protein, 14 aa, Artificial Sequence
  Description of Artificial Sequence: Synthetic peptide
KDNDYVWGSPYFDY

SEQ ID NO: 22133 - DNA, 27 bp, Artificial Sequence
  Description of Artificial Sequence: Synthetic oligonucleotide
agcagtggctggtactcctttgactac

SEQ ID NO: 22134 - protein, 9 aa, Artificial Sequence
  Description of Artificial Sequence: Synthetic peptide
SSGWYSFDY

SEQ ID NO: 22135 - DNA, 39 bp, Artificial Sequence; identical to SEQ ID NO: 22123
  Description of Artificial Sequence: Synthetic oligonucleotide

SEQ ID NO: 22136 - protein, 13 aa, Artificial Sequence
  Description of Artificial Sequence: Synthetic peptide
RVTDYGGNDWFDP

SEQ ID NO: 22137 - DNA, 27 bp, Artificial Sequence
  Description of Artificial Sequence: Synthetic oligonucleotide
agcagtggctggtacttttttgactac

SEQ ID NO: 22138 - protein, 9 aa, Artificial Sequence
  Description of Artificial Sequence: Synthetic peptide
SSGWYFFDY

SEQ ID NO: 22139 - DNA, 24 bp, Artificial Sequence
  Description of Artificial Sequence: Synthetic oligonucleotide
gaattgggatttctctctgactat

SEQ ID NO: 22140 - protein, 8 aa, Artificial Sequence
  Description of Artificial Sequence: Synthetic peptide
ELGFLSDY

SEQ ID NO: 22141 - DNA, 27 bp, Artificial Sequence
  Description of Artificial Sequence: Synthetic oligonucleotide
ggtagcagctcgtccgggtttgactac

SEQ ID NO: 22142 - protein, 9 aa, Artificial Sequence
  Description of Artificial Sequence: Synthetic peptide
GSSSSGFDY

SEQ ID NO: 22143 - DNA, 36 bp, Artificial Sequence
  Description of Artificial Sequence: Synthetic oligonucleotide
aggtatagcagcagctggtcggggggtatggacgtc

SEQ ID NO: 22144 - protein, 12 aa, Artificial Sequence
  Description of Artificial Sequence: Synthetic peptide
RYSSSWSGGMDV

SEQ ID NO: 22145 - DNA, 36 bp, Artificial Sequence
  Description of Artificial Sequence: Synthetic oligonucleotide
gggggagcttactactcctactacggtatggacgtc

SEQ ID NO: 22146 - protein, 12 aa, Artificial Sequence
  Description of Artificial Sequence: Synthetic peptide
GGAYYSYYGMDV

SEQ ID NO: 22147 - DNA, 33 bp, Artificial Sequence
  Description of Artificial Sequence: Synthetic oligonucleotide
gggggatataactggaaccatgcttttgatttc

SEQ ID NO: 22148 - protein, 11 aa, Artificial Sequence
  Description of Artificial Sequence: Synthetic peptide
GGYNWNHAFDF

SEQ ID NO: 22149 - DNA, 27 bp, Artificial Sequence
  Description of Artificial Sequence: Synthetic oligonucleotide
agcagtggctggtacttttttgactac

SEQ ID NO: 22150 - protein, 9 aa, Artificial Sequence
  Description of Artificial Sequence: Synthetic peptide
SSGWYFFDY

SEQ ID NO: 22151 - DNA, 27 bp, Artificial Sequence
  Description of Artificial Sequence: Synthetic oligonucleotide
agcagtggctggtactactttgactac

SEQ ID NO: 22152 - protein, 9 aa, Artificial Sequence
  Description of Artificial Sequence: Synthetic peptide
SSGWYYFDY

SEQ ID NO: 22153 - DNA, 42 bp, Artificial Sequence; identical to SEQ ID NO: 20179
  Description of Artificial Sequence: Synthetic oligonucleotide

SEQ ID NO: 22154 - protein, 14 aa, Artificial Sequence
  Description of Artificial Sequence: Synthetic peptide
ERYSSGWYDYGLDV

SEQ ID NO: 22155 - DNA, 27 bp, Artificial Sequence
  Description of Artificial Sequence: Synthetic oligonucleotide
agcagtggctggtactggttcgacccc

SEQ ID NO: 22156 - protein, 9 aa, Artificial Sequence
  Description of Artificial Sequence: Synthetic peptide
SSGWYWFDP

SEQ ID NO: 22157 - DNA, 36 bp, Artificial Sequence
  Description of Artificial Sequence: Synthetic oligonucleotide
aggtatagcagcagctggacggggggtatggacgtc

SEQ ID NO: 22158 - protein, 12 aa, Artificial Sequence
  Description of Artificial Sequence: Synthetic peptide
RYSSSWTGGMDV

SEQ ID NO: 22159 - DNA, 21 bp, Artificial Sequence
  Description of Artificial Sequence: Synthetic oligonucleotide
gactacggtgtttttgactac

SEQ ID NO: 22160 - protein, 7 aa, Artificial Sequence
  Description of Artificial Sequence: Synthetic peptide
DYGVFDY

SEQ ID NO: 22161 - DNA, 15 bp, Artificial Sequence
  Description of Artificial Sequence: Synthetic oligonucleotide
gatcggggcagttgc

SEQ ID NO: 22162 - protein, 5 aa, Artificial Sequence
  Description of Artificial Sequence: Synthetic peptide
DRGSC

SEQ ID NO: 22163 - DNA, 42 bp, Artificial Sequence
  Description of Artificial Sequence: Synthetic oligonucleotide
aaggattatgattacgtttgggggagtccttactttgactac

SEQ ID NO: 22164 - protein, 14 aa, Artificial Sequence
  Description of Artificial Sequence: Synthetic peptide
KDYDYVWGSPYFDY

SEQ ID NO: 22165 - DNA, 42 bp, Artificial Sequence; identical to SEQ ID NO: 22163
  Description of Artificial Sequence: Synthetic oligonucleotide

SEQ ID NO: 22166 - protein, 14 aa, Artificial Sequence
  Description of Artificial Sequence: Synthetic peptide
KDYDYVWGSPYFDY

SEQ ID NO: 22167 - DNA, 36 bp, Artificial Sequence
  Description of Artificial Sequence: Synthetic oligonucleotide
gatcatttcgatttttggagtggtcactttgactac

SEQ ID NO: 22168 - protein, 12 aa, Artificial Sequence
  Description of Artificial Sequence: Synthetic peptide
DHFDFWSGHFDY

SEQ ID NO: 22169 - DNA, 42 bp, Artificial Sequence; identical to SEQ ID NO: 22163
  Description of Artificial Sequence: Synthetic oligonucleotide

SEQ ID NO: 22170 - protein, 14 aa, Artificial Sequence
  Description of Artificial Sequence: Synthetic peptide
KDYDYVWGSPYFDY

SEQ ID NO: 22171 - DNA, 27 bp, Artificial Sequence
  Description of Artificial Sequence: Synthetic oligonucleotide
agcagtggctggtacttttttgactac

SEQ ID NO: 22172 - protein, 9 aa, Artificial Sequence
  Description of Artificial Sequence: Synthetic peptide
SSGWYFFDY

SEQ ID NO: 22173 - DNA, 39 bp, Artificial Sequence; identical to SEQ ID NO: 22123
  Description of Artificial Sequence: Synthetic oligonucleotide

SEQ ID NO: 22174 - protein, 13 aa, Artificial Sequence
  Description of Artificial Sequence: Synthetic peptide
RVTDYGGNDWFDP

SEQ ID NO: 22175 - DNA, 36 bp, Artificial Sequence; identical to SEQ ID NO: 22143
  Description of Artificial Sequence: Synthetic oligonucleotide

SEQ ID NO: 22176 - protein, 12 aa, Artificial Sequence
  Description of Artificial Sequence: Synthetic peptide
RYSSSWSGGMDV

SEQ ID NO: 22177 - DNA, 36 bp, Artificial Sequence
  Description of Artificial Sequence: Synthetic oligonucleotide
gatcctgtagtagtaccagctgccccctttgactac

SEQ ID NO: 22178 - protein, 12 aa, Artificial Sequence
  Description of Artificial Sequence: Synthetic peptide
DPVVVPAAPFDY

SEQ ID NO: 22179 - DNA, 27 bp, Artificial Sequence
  Description of Artificial Sequence: Synthetic oligonucleotide
agcagtggctggtactactttgactac

SEQ ID NO: 22180 - protein, 9 aa, Artificial Sequence
  Description of Artificial Sequence: Synthetic peptide
SSGWYYFDY

SEQ ID NO: 22181 - DNA, 39 bp, Artificial Sequence; identical to SEQ ID NO: 22123
  Description of Artificial Sequence: Synthetic oligonucleotide

SEQ ID NO: 22182 - protein, 13 aa, Artificial Sequence
  Description of Artificial Sequence: Synthetic peptide
RVTDYGGNDWFDP

SEQ ID NO: 22183 - DNA, 36 bp, Artificial Sequence
  Description of Artificial Sequence: Synthetic oligonucleotide
gatcgttacgatttttggagtggtcactttgactac

SEQ ID NO: 22184 - protein, 12 aa, Artificial Sequence
  Description of Artificial Sequence: Synthetic peptide
DRYDFWSGHFDY

SEQ ID NO: 22185 - DNA, 36 bp, Artificial Sequence; identical to SEQ ID NO: 22143
  Description of Artificial Sequence: Synthetic oligonucleotide

SEQ ID NO: 22186 - protein, 12 aa, Artificial Sequence
  Description of Artificial Sequence: Synthetic peptide
RYSSSWSGGMDV

SEQ ID NO: 22187 - DNA, 27 bp, Artificial Sequence
  Description of Artificial Sequence: Synthetic oligonucleotide
cttgatccccagtggagttttgactac

SEQ ID NO: 22188 - protein, 9 aa, Artificial Sequence
  Description of Artificial Sequence: Synthetic peptide
LDPQWSFDY

SEQ ID NO: 22189 - DNA, 36 bp, Artificial Sequence
  Description of Artificial Sequence: Synthetic oligonucleotide
tacagtacctacgactactactacggtatggacgtc

SEQ ID NO: 22190 - protein, 12 aa, Artificial Sequence
  Description of Artificial Sequence: Synthetic peptide
YSTYDYYYGMDV

SEQ ID NO: 22191 - DNA, 36 bp, Artificial Sequence; identical to SEQ ID NO: 22167
  Description of Artificial Sequence: Synthetic oligonucleotide

SEQ ID NO: 22192 - protein, 12 aa, Artificial Sequence
  Description of Artificial Sequence: Synthetic peptide
DHFDFWSGHFDY

SEQ ID NO: 22193 - DNA, 24 bp, Artificial Sequence
  Description of Artificial Sequence: Synthetic oligonucleotide
gaaataggattcagtgaggactac

SEQ ID NO: 22194 - protein, 8 aa, Artificial Sequence
  Description of Artificial Sequence: Synthetic peptide
EIGFSEDY

SEQ ID NO: 22195 - DNA, 27 bp, Artificial Sequence
  Description of Artificial Sequence: Synthetic oligonucleotide
agcagtggctggtactactttgactac

SEQ ID NO: 22196 - protein, 9 aa, Artificial Sequence
  Description of Artificial Sequence: Synthetic peptide
SSGWYYFDY

SEQ ID NO: 22197 - DNA, 39 bp, Artificial Sequence; identical to SEQ ID NO: 22123
  Description of Artificial Sequence: Synthetic oligonucleotide

SEQ ID NO: 22198 - protein, 13 aa, Artificial Sequence
  Description of Artificial Sequence: Synthetic peptide
RVTDYGGNDWFDP

SEQ ID NO: 22199 - DNA, 27 bp, Artificial Sequence
  Description of Artificial Sequence: Synthetic oligonucleotide
agcagtggctggtactggtttgactac

SEQ ID NO: 22200 - protein, 9 aa, Artificial Sequence
  Description of Artificial Sequence: Synthetic peptide
SSGWYWFDY

SEQ ID NO: 22201 - DNA, 27 bp, Artificial Sequence
  Description of Artificial Sequence: Synthetic oligonucleotide
agcagtggctggtactactttgactac

SEQ ID NO: 22202 - protein, 9 aa, Artificial Sequence
  Description of Artificial Sequence: Synthetic peptide
SSGWYYFDY

SEQ ID NO: 22203 - DNA, 36 bp, Artificial Sequence; identical to SEQ ID NO: 22189
  Description of Artificial Sequence: Synthetic oligonucleotide

SEQ ID NO: 22204 - protein, 12 aa, Artificial Sequence
  Description of Artificial Sequence: Synthetic peptide
YSTYDYYYGMDV

SEQ ID NO: 22205 - DNA, 27 bp, Artificial Sequence
  Description of Artificial Sequence: Synthetic oligonucleotide
cgaactccggaagatgtttttgatatc

SEQ ID NO: 22206 - protein, 9 aa, Artificial Sequence
  Description of Artificial Sequence: Synthetic peptide
RTPEDVFDI

SEQ ID NO: 22207 - DNA, 42 bp, Artificial Sequence; identical to SEQ ID NO: 22163
  Description of Artificial Sequence: Synthetic oligonucleotide

SEQ ID NO: 22208 - protein, 14 aa, Artificial Sequence
  Description of Artificial Sequence: Synthetic peptide
KDYDYVWGSPYFDY

SEQ ID NO: 22209 - DNA, 33 bp, Artificial Sequence
  Description of Artificial Sequence: Synthetic oligonucleotide
gggggatataactggaaccatgcttttgatatc

SEQ ID NO: 22210 - protein, 11 aa, Artificial Sequence
  Description of Artificial Sequence: Synthetic peptide
GGYNWNHAFDI

SEQ ID NO: 22211 - DNA, 42 bp, Artificial Sequence; identical to SEQ ID NO: 22163
  Description of Artificial Sequence: Synthetic oligonucleotide

SEQ ID NO: 22212 - protein, 14 aa, Artificial Sequence
  Description of Artificial Sequence: Synthetic peptide
KDYDYVWGSPYFDY

SEQ ID NO: 22213 - DNA, 42 bp, Artificial Sequence; identical to SEQ ID NO: 21211
  Description of Artificial Sequence: Synthetic oligonucleotide

SEQ ID NO: 22214 - protein, 14 aa, Artificial Sequence
  Description of Artificial Sequence: Synthetic peptide
ERYSSGWYDYGMDV

SEQ ID NO: 22215 - DNA, 42 bp, Artificial Sequence; identical to SEQ ID NO: 22163
  Description of Artificial Sequence: Synthetic oligonucleotide

SEQ ID NO: 22216 - protein, 14 aa, Artificial Sequence
  Description of Artificial Sequence: Synthetic peptide
KDYDYVWGSPYFDY

SEQ ID NO: 22217 - DNA, 24 bp, Artificial Sequence
  Description of Artificial Sequence: Synthetic oligonucleotide
gaaatagggttcagtgaggactac

SEQ ID NO: 22218 - protein, 8 aa, Artificial Sequence
  Description of Artificial Sequence: Synthetic peptide
EIGFSEDY

SEQ ID NO: 22219 - DNA, 27 bp, Artificial Sequence
  Description of Artificial Sequence: Synthetic oligonucleotide
agcagtggctggtactactttgactac

SEQ ID NO: 22220 - protein, 9 aa, Artificial Sequence
  Description of Artificial Sequence: Synthetic peptide
SSGWYYFDY

SEQ ID NO: 22221 - DNA, 42 bp, Artificial Sequence
  Description of Artificial Sequence: Synthetic oligonucleotide
gaggagtatagcagcagctggtacgggtacggtatggacgtc

SEQ ID NO: 22222 - protein, 14 aa, Artificial Sequence
  Description of Artificial Sequence: Synthetic peptide
EEYSSSWYGYGMDV

SEQ ID NO: 22223 - DNA, 42 bp, Artificial Sequence; identical to SEQ ID NO: 22163
  Description of Artificial Sequence: Synthetic oligonucleotide

SEQ ID NO: 22224 - protein, 14 aa, Artificial Sequence
  Description of Artificial Sequence: Synthetic peptide
KDYDYVWGSPYFDY

SEQ ID NO: 22225 - DNA, 27 bp, Artificial Sequence
  Description of Artificial Sequence: Synthetic oligonucleotide
agcagtggctggtacttttttgactac

SEQ ID NO: 22226 - protein, 9 aa, Artificial Sequence
  Description of Artificial Sequence: Synthetic peptide
SSGWYFFDY

SEQ ID NO: 22227 - DNA, 24 bp, Artificial Sequence
  Description of Artificial Sequence: Synthetic oligonucleotide
gaaatagggttcagtgaggactac

SEQ ID NO: 22228 - protein, 8 aa, Artificial Sequence
  Description of Artificial Sequence: Synthetic peptide
EIGFSEDY

SEQ ID NO: 22229 - DNA, 24 bp, Artificial Sequence
  Description of Artificial Sequence: Synthetic oligonucleotide
tcggcatttagcccttttgattac

SEQ ID NO: 22230 - protein, 8 aa, Artificial Sequence
  Description of Artificial Sequence: Synthetic peptide
SAFSPFDY

SEQ ID NO: 22231 - DNA, 36 bp, Artificial Sequence; identical to SEQ ID NO: 22183
  Description of Artificial Sequence: Synthetic oligonucleotide

SEQ ID NO: 22232 - protein, 12 aa, Artificial Sequence
  Description of Artificial Sequence: Synthetic peptide
DRYDFWSGHFDY

SEQ ID NO: 22233 - DNA, 39 bp, Artificial Sequence; identical to SEQ ID NO: 22123
  Description of Artificial Sequence: Synthetic oligonucleotide

SEQ ID NO: 22234 - protein, 13 aa, Artificial Sequence
  Description of Artificial Sequence: Synthetic peptide
RVTDYGGNDWFDP

SEQ ID NO: 22235 - DNA, 36 bp, Artificial Sequence
  Description of Artificial Sequence: Synthetic oligonucleotide
aggtttagcagcagctggtcggggggtatggacgtc

SEQ ID NO: 22236 - protein, 12 aa, Artificial Sequence
  Description of Artificial Sequence: Synthetic peptide
RFSSSWSGGMDV

SEQ ID NO: 22237 - DNA, 39 bp, Artificial Sequence; identical to SEQ ID NO: 22123
  Description of Artificial Sequence: Synthetic oligonucleotide

SEQ ID NO: 22238 - protein, 13 aa, Artificial Sequence
  Description of Artificial Sequence: Synthetic peptide
RVTDYGGNDWFDP

SEQ ID NO: 22239 - DNA, 18 bp, Artificial Sequence
  Description of Artificial Sequence: Synthetic oligonucleotide
gatacaccactggtttac

SEQ ID NO: 22240 - protein, 6 aa, Artificial Sequence
  Description of Artificial Sequence: Synthetic peptide
DTPLVY

SEQ ID NO: 22241 - DNA, 36 bp, Artificial Sequence
  Description of Artificial Sequence: Synthetic oligonucleotide
gatcgatacgatttttggagtggtcactttgactac

SEQ ID NO: 22242 - protein, 12 aa, Artificial Sequence
  Description of Artificial Sequence: Synthetic peptide
DRYDFWSGHFDY

SEQ ID NO: 22243 - DNA, 39 bp, Artificial Sequence; identical to SEQ ID NO: 22123
  Description of Artificial Sequence: Synthetic oligonucleotide

SEQ ID NO: 22244 - protein, 13 aa, Artificial Sequence
  Description of Artificial Sequence: Synthetic peptide
RVTDYGGNDWFDP

SEQ ID NO: 22245 - DNA, 48 bp, Artificial Sequence
  Description of Artificial Sequence: Synthetic oligonucleotide
ggggtattactatggttcggggagctagaagatgactggttcgacccc

SEQ ID NO: 22246 - protein, 16 aa, Artificial Sequence
  Description of Artificial Sequence: Synthetic peptide
GVLLWFGELEDDWFDP

SEQ ID NO: 22247 - DNA, 36 bp, Artificial Sequence; identical to SEQ ID NO: 20139
  Description of Artificial Sequence: Synthetic oligonucleotide

SEQ ID NO: 22248 - protein, 12 aa, Artificial Sequence
  Description of Artificial Sequence: Synthetic peptide
DHYDFWSGHFDY

SEQ ID NO: 22249 - DNA, 39 bp, Artificial Sequence; identical to SEQ ID NO: 22123
  Description of Artificial Sequence: Synthetic oligonucleotide

SEQ ID NO: 22250 - protein, 13 aa, Artificial Sequence
  Description of Artificial Sequence: Synthetic peptide
RVTDYGGNDWFDP

SEQ ID NO: 22251 - DNA, 27 bp, Artificial Sequence
  Description of Artificial Sequence: Synthetic oligonucleotide
agcagtggctggtacttttttgactac

SEQ ID NO: 22252 - protein, 9 aa, Artificial Sequence
  Description of Artificial Sequence: Synthetic peptide
SSGWYFFDY

SEQ ID NO: 22253 - DNA, 27 bp, Artificial Sequence
  Description of Artificial Sequence: Synthetic oligonucleotide
agcagtggctggtactggtttgactac

SEQ ID NO: 22254 - protein, 9 aa, Artificial Sequence
  Description of Artificial Sequence: Synthetic peptide
SSGWYWFDY

SEQ ID NO: 22255 - DNA, 27 bp, Artificial Sequence
  Description of Artificial Sequence: Synthetic oligonucleotide
agcagtggctggtactggttcgacccc

SEQ ID NO: 22256 - protein, 9 aa, Artificial Sequence
  Description of Artificial Sequence: Synthetic peptide
SSGWYWFDP

SEQ ID NO: 22257 - DNA, 39 bp, Artificial Sequence; identical to SEQ ID NO: 22123
  Description of Artificial Sequence: Synthetic oligonucleotide

SEQ ID NO: 22258 - protein, 13 aa, Artificial Sequence
  Description of Artificial Sequence: Synthetic peptide
RVTDYGGNDWFDP

SEQ ID NO: 22259 - DNA, 36 bp, Artificial Sequence
  Description of Artificial Sequence: Synthetic oligonucleotide
gaggggtacgatttttggagtggttaccttggctac

SEQ ID NO: 22260 - protein, 12 aa, Artificial Sequence
  Description of Artificial Sequence: Synthetic peptide
EGYDFWSGYLGY

SEQ ID NO: 22261 - DNA, 33 bp, Artificial Sequence; identical to SEQ ID NO: 22209
  Description of Artificial Sequence: Synthetic oligonucleotide

SEQ ID NO: 22262 - protein, 11 aa, Artificial Sequence
  Description of Artificial Sequence: Synthetic peptide
GGYNWNHAFDI

SEQ ID NO: 22263 - DNA, 42 bp, Artificial Sequence; identical to SEQ ID NO: 22221
  Description of Artificial Sequence: Synthetic oligonucleotide

SEQ ID NO: 22264 - protein, 14 aa, Artificial Sequence
  Description of Artificial Sequence: Synthetic peptide
EEYSSSWYGYGMDV

SEQ ID NO: 22265 - DNA, 42 bp, Artificial Sequence; identical to SEQ ID NO: 22131
  Description of Artificial Sequence: Synthetic oligonucleotide

SEQ ID NO: 22266 - protein, 14 aa, Artificial Sequence
  Description of Artificial Sequence: Synthetic peptide
KDNDYVWGSPYFDY

SEQ ID NO: 22267 - DNA, 27 bp, Artificial Sequence
  Description of Artificial Sequence: Synthetic oligonucleotide
cttgatctccagtggagttttgacttc

SEQ ID NO: 22268 - protein, 9 aa, Artificial Sequence
  Description of Artificial Sequence: Synthetic peptide
LDLQWSFDF

SEQ ID NO: 22269 - DNA, 33 bp, Artificial Sequence
  Description of Artificial Sequence: Synthetic oligonucleotide
gaggggggattgggagctaccttctttgactac

SEQ ID NO: 22270 - protein, 11 aa, Artificial Sequence
  Description of Artificial Sequence: Synthetic peptide
EGGLGATFFDY

SEQ ID NO: 22271 - DNA, 42 bp, Artificial Sequence; identical to SEQ ID NO: 22163
  Description of Artificial Sequence: Synthetic oligonucleotide

SEQ ID NO: 22272 - protein, 14 aa, Artificial Sequence
  Description of Artificial Sequence: Synthetic peptide
KDYDYVWGSPYFDY

SEQ ID NO: 22273 - DNA, 39 bp, Artificial Sequence; identical to SEQ ID NO: 22123
  Description of Artificial Sequence: Synthetic oligonucleotide

SEQ ID NO: 22274 - protein, 13 aa, Artificial Sequence
  Description of Artificial Sequence: Synthetic peptide
RVTDYGGNDWFDP

SEQ ID NO: 22275 - DNA, 36 bp, Artificial Sequence
  Description of Artificial Sequence: Synthetic oligonucleotide
gaggcttacgatttttggagtggttattttgactac

SEQ ID NO: 22276 - protein, 12 aa, Artificial Sequence
  Description of Artificial Sequence: Synthetic peptide
EAYDFWSGYFDY

SEQ ID NO: 22277 - DNA, 27 bp, Artificial Sequence
  Description of Artificial Sequence: Synthetic oligonucleotide
agcagtggctggtactactttgactac

SEQ ID NO: 22278 - protein, 9 aa, Artificial Sequence
  Description of Artificial Sequence: Synthetic peptide
SSGWYYFDY

SEQ ID NO: 22279 - DNA, 18 bp, Artificial Sequence
  Description of Artificial Sequence: Synthetic oligonucleotide
acggcgactaaggactac

SEQ ID NO: 22280 - protein, 6 aa, Artificial Sequence
  Description of Artificial Sequence: Synthetic peptide
TATKDY

SEQ ID NO: 22281 - DNA, 36 bp, Artificial Sequence; identical to SEQ ID NO: 22259
  Description of Artificial Sequence: Synthetic oligonucleotide

SEQ ID NO: 22282 - protein, 12 aa, Artificial Sequence
  Description of Artificial Sequence: Synthetic peptide
EGYDFWSGYLGY

SEQ ID NO: 22283 - DNA, 33 bp, Artificial Sequence; identical to SEQ ID NO: 22209
  Description of Artificial Sequence: Synthetic oligonucleotide

SEQ ID NO: 22284 - protein, 11 aa, Artificial Sequence
  Description of Artificial Sequence: Synthetic peptide
GGYNWNHAFDI

SEQ ID NO: 22285 - DNA, 33 bp, Artificial Sequence
  Description of Artificial Sequence: Synthetic oligonucleotide
gaggggggagtgggagctacgtactttgactac

SEQ ID NO: 22286 - protein, 11 aa, Artificial Sequence
  Description of Artificial Sequence: Synthetic peptide
EGGVGATYFDY

SEQ ID NO: 22287 - DNA, 36 bp, Artificial Sequence
  Description of Artificial Sequence: Synthetic oligonucleotide
cgctatagccgcagctgggccgggggtatggacgtc

SEQ ID NO: 22288 - protein, 12 aa, Artificial Sequence
  Description of Artificial Sequence: Synthetic peptide
RYSRSWAGGMDV

SEQ ID NO: 22289 - DNA, 27 bp, Artificial Sequence
  Description of Artificial Sequence: Synthetic oligonucleotide
agcagtggctggtacttctttgacaac

SEQ ID NO: 22290 - protein, 9 aa, Artificial Sequence
  Description of Artificial Sequence: Synthetic peptide
SSGWYFFDN

SEQ ID NO: 22291 - DNA, 27 bp, Artificial Sequence
  Description of Artificial Sequence: Synthetic oligonucleotide
agcagtggctggtacatctttgactac

SEQ ID NO: 22292 - protein, 9 aa, Artificial Sequence
  Description of Artificial Sequence: Synthetic peptide
SSGWYIFDY

SEQ ID NO: 22293 - DNA, 42 bp, Artificial Sequence
  Description of Artificial Sequence: Synthetic oligonucleotide
aggggatttcgatttttggagtggttggggggctttgactac

SEQ ID NO: 22294 - protein, 14 aa, Artificial Sequence
  Description of Artificial Sequence: Synthetic peptide
RGFRFLEWLGGFDY

SEQ ID NO: 22295 - DNA, 27 bp, Artificial Sequence
  Description of Artificial Sequence: Synthetic oligonucleotide
agcagtggctggtactacttcgactac

SEQ ID NO: 22296 - protein, 9 aa, Artificial Sequence
  Description of Artificial Sequence: Synthetic peptide
SSGWYYFDY

SEQ ID NO: 22297 - DNA, 42 bp, Artificial Sequence; identical to SEQ ID NO: 22163
  Description of Artificial Sequence: Synthetic oligonucleotide

SEQ ID NO: 22298 - protein, 14 aa, Artificial Sequence
  Description of Artificial Sequence: Synthetic peptide
KDYDYVWGSPYFDY

SEQ ID NO: 22299 - DNA, 42 bp, Artificial Sequence; identical to SEQ ID NO: 22163
  Description of Artificial Sequence: Synthetic oligonucleotide

SEQ ID NO: 22300 - protein, 14 aa, Artificial Sequence
  Description of Artificial Sequence: Synthetic peptide
KDYDYVWGSPYFDY

SEQ ID NO: 22301 - DNA, 39 bp, Artificial Sequence; identical to SEQ ID NO: 22123
  Description of Artificial Sequence: Synthetic oligonucleotide

SEQ ID NO: 22302 - protein, 13 aa, Artificial Sequence
  Description of Artificial Sequence: Synthetic peptide
RVTDYGGNDWFDP

SEQ ID NO: 22303 - DNA, 36 bp, Artificial Sequence; identical to SEQ ID NO: 22241
  Description of Artificial Sequence: Synthetic oligonucleotide

SEQ ID NO: 22304 - protein, 12 aa, Artificial Sequence
  Description of Artificial Sequence: Synthetic peptide
DRYDFWSGHFDY

SEQ ID NO: 22305 - DNA, 27 bp, Artificial Sequence
  Description of Artificial Sequence: Synthetic oligonucleotide
agcagtggctggtactattttgactac

SEQ ID NO: 22306 - protein, 9 aa, Artificial Sequence
  Description of Artificial Sequence: Synthetic peptide
SSGWYYFDY

SEQ ID NO: 22307 - DNA, 27 bp, Artificial Sequence
  Description of Artificial Sequence: Synthetic oligonucleotide
agcagtggctggtactactttgactac

SEQ ID NO: 22308 - protein, 9 aa, Artificial Sequence
  Description of Artificial Sequence: Synthetic peptide
SSGWYYFDY

SEQ ID NO: 22309 - DNA, 39 bp, Artificial Sequence
  Description of Artificial Sequence: Synthetic oligonucleotide
gaccatgactacggtgactacaatatctactttgactac

SEQ ID NO: 22310 - protein, 13 aa, Artificial Sequence
  Description of Artificial Sequence: Synthetic peptide
DHDYGDYNIYFDY

SEQ ID NO: 22311 - DNA, 27 bp, Artificial Sequence
  Description of Artificial Sequence: Synthetic oligonucleotide
cttgatctccagtggagttttgacttc

SEQ ID NO: 22312 - protein, 9 aa, Artificial Sequence
  Description of Artificial Sequence: Synthetic peptide
LDLQWSFDF

SEQ ID NO: 22313 - DNA, 27 bp, Artificial Sequence
  Description of Artificial Sequence: Synthetic oligonucleotide
agcagtggctggtactactttgactac

SEQ ID NO: 22314 - protein, 9 aa, Artificial Sequence
  Description of Artificial Sequence: Synthetic peptide
SSGWYYFDY

SEQ ID NO: 22315 - DNA, 39 bp, Artificial Sequence; identical to SEQ ID NO: 22123
  Description of Artificial Sequence: Synthetic oligonucleotide

SEQ ID NO: 22316 - protein, 13 aa, Artificial Sequence
  Description of Artificial Sequence: Synthetic peptide
RVTDYGGNDWFDP

SEQ ID NO: 22317 - DNA, 18 bp, Artificial Sequence
  Description of Artificial Sequence: Synthetic oligonucleotide
caggcagcccaggactac

SEQ ID NO: 22318 - protein, 6 aa, Artificial Sequence
  Description of Artificial Sequence: Synthetic peptide
QAAQDY

SEQ ID NO: 22319 - DNA, 9 bp, Artificial Sequence
  Description of Artificial Sequence: Synthetic oligonucleotide
acctacctc

SEQ ID NO: 22320 - protein, 3 aa, Artificial Sequence
  Description of Artificial Sequence: Synthetic peptide
TYL

SEQ ID NO: 22321 - DNA, 24 bp, Artificial Sequence
  Description of Artificial Sequence: Synthetic oligonucleotide
gagctggggttcctctctgactat

SEQ ID NO: 22322 - protein, 8 aa, Artificial Sequence
  Description of Artificial Sequence: Synthetic peptide
ELGFLSDY

SEQ ID NO: 22323 - DNA, 36 bp, Artificial Sequence
  Description of Artificial Sequence: Synthetic oligonucleotide
aggagcagtggctggtacgaggatgctcttgatatc

SEQ ID NO: 22324 - protein, 12 aa, Artificial Sequence
  Description of Artificial Sequence: Synthetic peptide
RSSGWYEDALDI

SEQ ID NO: 22325 - DNA, 18 bp, Artificial Sequence
  Description of Artificial Sequence: Synthetic oligonucleotide
gtagctacctttgactac

SEQ ID NO: 22326 - protein, 6 aa, Artificial Sequence
  Description of Artificial Sequence: Synthetic peptide
VATFDY

SEQ ID NO: 22327 - DNA, 15 bp, Artificial Sequence
  Description of Artificial Sequence: Synthetic oligonucleotide
gatagagggtccatc

SEQ ID NO: 22328 - protein, 5 aa, Artificial Sequence
  Description of Artificial Sequence: Synthetic peptide
DRGSI

SEQ ID NO: 22329 - DNA, 18 bp, Artificial Sequence
  Description of Artificial Sequence: Synthetic oligonucleotide
tatacctggaacggctac

SEQ ID NO: 22330 - protein, 6 aa, Artificial Sequence
  Description of Artificial Sequence: Synthetic peptide
YTWNGY

SEQ ID NO: 22331 - DNA, 27 bp, Artificial Sequence
  Description of Artificial Sequence: Synthetic oligonucleotide
cataaagtggctggtccctttgactac

SEQ ID NO: 22332 - protein, 9 aa, Artificial Sequence
  Description of Artificial Sequence: Synthetic peptide
HKVAGPFDY

SEQ ID NO: 22333 - DNA, 15 bp, Artificial Sequence
  Description of Artificial Sequence: Synthetic oligonucleotide
gatcggggcagcagc

SEQ ID NO: 22334 - protein, 5 aa, Artificial Sequence
  Description of Artificial Sequence: Synthetic peptide
DRGSS

SEQ ID NO: 22335 - DNA, 15 bp, Artificial Sequence
  Description of Artificial Sequence: Synthetic oligonucleotide
gatcgagggggctat

SEQ ID NO: 22336 - protein, 5 aa, Artificial Sequence
  Description of Artificial Sequence: Synthetic peptide
DRGGY

SEQ ID NO: 22337 - DNA, 36 bp, Artificial Sequence
  Description of Artificial Sequence: Synthetic oligonucleotide
gagggatacgatttttggagtggtttctttgactcc

SEQ ID NO: 22338 - protein, 12 aa, Artificial Sequence
  Description of Artificial Sequence: Synthetic peptide
EGYDFWSGFFDS

SEQ ID NO: 22339 - DNA, 24 bp, Artificial Sequence
  Description of Artificial Sequence: Synthetic oligonucleotide
gagctggggttcctctctgactac

SEQ ID NO: 22340 - protein, 8 aa, Artificial Sequence
  Description of Artificial Sequence: Synthetic peptide
ELGFLSDY

SEQ ID NO: 22341 - DNA, 18 bp, Artificial Sequence
  Description of Artificial Sequence: Synthetic oligonucleotide
gtggctcactttgactac

SEQ ID NO: 22342 - protein, 6 aa, Artificial Sequence
  Description of Artificial Sequence: Synthetic peptide
VAHFDY

SEQ ID NO: 22343 - DNA, 15 bp, Artificial Sequence
  Description of Artificial Sequence: Synthetic oligonucleotide
tccaagtttgactcc

SEQ ID NO: 22344 - protein, 5 aa, Artificial Sequence
  Description of Artificial Sequence: Synthetic peptide
SKFDS

SEQ ID NO: 22345 - DNA, 15 bp, Artificial Sequence
  Description of Artificial Sequence: Synthetic oligonucleotide
agcagtggctggtct

SEQ ID NO: 22346 - protein, 5 aa, Artificial Sequence
  Description of Artificial Sequence: Synthetic peptide
SSGWS

SEQ ID NO: 22347 - DNA, 42 bp, Artificial Sequence
  Description of Artificial Sequence: Synthetic oligonucleotide
gaaccgtatactagtggctggtacgactacggtatggacgtc

SEQ ID NO: 22348 - protein, 14 aa, Artificial Sequence
  Description of Artificial Sequence: Synthetic peptide
EPYTSGWYDYGMDV

SEQ ID NO: 22349 - DNA, 24 bp, Artificial Sequence
  Description of Artificial Sequence: Synthetic oligonucleotide
ttgagcagtggctggtttgactac

SEQ ID NO: 22350 - protein, 8 aa, Artificial Sequence
  Description of Artificial Sequence: Synthetic peptide
LSSGWFDY

SEQ ID NO: 22351 - DNA, 15 bp, Artificial Sequence
  Description of Artificial Sequence: Synthetic oligonucleotide
gatcggggcagcagc

SEQ ID NO: 22352 - protein, 5 aa, Artificial Sequence
  Description of Artificial Sequence: Synthetic peptide
DRGSS

SEQ ID NO: 22353 - DNA, 15 bp, Artificial Sequence
  Description of Artificial Sequence: Synthetic oligonucleotide
gatcggggcagcagc

SEQ ID NO: 22354 - protein, 5 aa, Artificial Sequence
  Description of Artificial Sequence: Synthetic peptide
DRGSS

SEQ ID NO: 22355 - DNA, 24 bp, Artificial Sequence
  Description of Artificial Sequence: Synthetic oligonucleotide
gaactgggatgggcggaggactac

SEQ ID NO: 22356 - protein, 8 aa, Artificial Sequence
  Description of Artificial Sequence: Synthetic peptide
ELGWAEDY

SEQ ID NO: 22357 - DNA, 15 bp, Artificial Sequence
  Description of Artificial Sequence: Synthetic oligonucleotide
gatcgaggcagcctc

SEQ ID NO: 22358 - protein, 5 aa, Artificial Sequence
  Description of Artificial Sequence: Synthetic peptide
DRGSL

SEQ ID NO: 22359 - DNA, 27 bp, Artificial Sequence
  Description of Artificial Sequence: Synthetic oligonucleotide
agcagtggctggtaccgctttgactac

SEQ ID NO: 22360 - protein, 9 aa, Artificial Sequence
  Description of Artificial Sequence: Synthetic peptide
SSGWYRFDY

SEQ ID NO: 22361 - DNA, 18 bp, Artificial Sequence
  Description of Artificial Sequence: Synthetic oligonucleotide
gggggctggaaccacgac

SEQ ID NO: 22362 - protein, 6 aa, Artificial Sequence
  Description of Artificial Sequence: Synthetic peptide
GGWNHD

SEQ ID NO: 22363 - DNA, 12 bp, Artificial Sequence
  Description of Artificial Sequence: Synthetic oligonucleotide
ggttgggacgtc

SEQ ID NO: 22364 - protein, 4 aa, Artificial Sequence
  Description of Artificial Sequence: Synthetic peptide
GWDV

SEQ ID NO: 22365 - DNA, 18 bp, Artificial Sequence
  Description of Artificial Sequence: Synthetic oligonucleotide
aagaaaactggggactac

SEQ ID NO: 22366 - protein, 6 aa, Artificial Sequence
  Description of Artificial Sequence: Synthetic peptide
KKTGDY

SEQ ID NO: 22367 - DNA, 36 bp, Artificial Sequence
  Description of Artificial Sequence: Synthetic oligonucleotide
cggagcagctcgtgggggggctacggtatggacgtc

SEQ ID NO: 22368 - protein, 12 aa, Artificial Sequence
  Description of Artificial Sequence: Synthetic peptide
RSSSWGGYGMDV

SEQ ID NO: 22369 - DNA, 24 bp, Artificial Sequence
  Description of Artificial Sequence: Synthetic oligonucleotide
gagctggggttcctctctgactac

SEQ ID NO: 22370 - protein, 8 aa, Artificial Sequence
  Description of Artificial Sequence: Synthetic peptide
ELGFLSDY

SEQ ID NO: 22371 - DNA, 42 bp, Artificial Sequence
  Description of Artificial Sequence: Synthetic oligonucleotide
gaaccgtataatagtggctggtacgactacggtatggacgtc

SEQ ID NO: 22372 - protein, 14 aa, Artificial Sequence
  Description of Artificial Sequence: Synthetic peptide
EPYNSGWYDYGMDV

SEQ ID NO: 22373 - DNA, 42 bp, Artificial Sequence
  Description of Artificial Sequence: Synthetic oligonucleotide
gaaccgtatagtagtggctggtacgactacggtatggacgtc

SEQ ID NO: 22374 - protein, 14 aa, Artificial Sequence
  Description of Artificial Sequence: Synthetic peptide
EPYSSGWYDYGMDV

SEQ ID NO: 22375 - DNA, 18 bp, Artificial Sequence
  Description of Artificial Sequence: Synthetic oligonucleotide
gtgagctgggctgactgc

SEQ ID NO: 22376 - protein, 6 aa, Artificial Sequence
  Description of Artificial Sequence: Synthetic peptide
VSWADC

SEQ ID NO: 22377 - DNA, 36 bp, Artificial Sequence
  Description of Artificial Sequence: Synthetic oligonucleotide
gaggcctacgatttttggagtggttattatgactac

SEQ ID NO: 22378 - protein, 12 aa, Artificial Sequence
  Description of Artificial Sequence: Synthetic peptide
EAYDFWSGYYDY

SEQ ID NO: 22379 - DNA, 12 bp, Artificial Sequence
  Description of Artificial Sequence: Synthetic oligonucleotide
catggatacagc

SEQ ID NO: 22380 - protein, 4 aa, Artificial Sequence
  Description of Artificial Sequence: Synthetic peptide
HGYS

SEQ ID NO: 22381 - DNA, 12 bp, Artificial Sequence
  Description of Artificial Sequence: Synthetic oligonucleotide
gataaagattac

SEQ ID NO: 22382 - protein, 4 aa, Artificial Sequence
  Description of Artificial Sequence: Synthetic peptide
DKDY

SEQ ID NO: 22383 - DNA, 15 bp, Artificial Sequence
  Description of Artificial Sequence: Synthetic oligonucleotide
agcagtggctggtct

SEQ ID NO: 22384 - protein, 5 aa, Artificial Sequence
  Description of Artificial Sequence: Synthetic peptide
SSGWS

SEQ ID NO: 22385 - DNA, 12 bp, Artificial Sequence
  Description of Artificial Sequence: Synthetic oligonucleotide
catggatacagc

SEQ ID NO: 22386 - protein, 4 aa, Artificial Sequence
  Description of Artificial Sequence: Synthetic peptide
HGYS

SEQ ID NO: 22387 - DNA, 27 bp, Artificial Sequence
  Description of Artificial Sequence: Synthetic oligonucleotide
ctctctcaacggtgggactttgactac

SEQ ID NO: 22388 - protein, 9 aa, Artificial Sequence
  Description of Artificial Sequence: Synthetic peptide
LSQRWDFDY

SEQ ID NO: 22389 - DNA, 27 bp, Artificial Sequence
  Description of Artificial Sequence: Synthetic oligonucleotide
agcagcggctggtacatttttgactac

SEQ ID NO: 22390 - protein, 9 aa, Artificial Sequence
  Description of Artificial Sequence: Synthetic peptide
SSGWYIFDY

SEQ ID NO: 22391 - DNA, 42 bp, Artificial Sequence; identical to SEQ ID NO: 22371
  Description of Artificial Sequence: Synthetic oligonucleotide

SEQ ID NO: 22392 - protein, 14 aa, Artificial Sequence
  Description of Artificial Sequence: Synthetic peptide
EPYNSGWYDYGMDV

SEQ ID NO: 22393 - DNA, 15 bp, Artificial Sequence
  Description of Artificial Sequence: Synthetic oligonucleotide
gatcggggcagcagc

SEQ ID NO: 22394 - protein, 5 aa, Artificial Sequence
  Description of Artificial Sequence: Synthetic peptide
DRGSS

SEQ ID NO: 22395 - DNA, 18 bp, Artificial Sequence
  Description of Artificial Sequence: Synthetic oligonucleotide
aagagttggtttgactac

SEQ ID NO: 22396 - protein, 6 aa, Artificial Sequence
  Description of Artificial Sequence: Synthetic peptide
KSWFDY

SEQ ID NO: 22397 - DNA, 27 bp, Artificial Sequence
  Description of Artificial Sequence: Synthetic oligonucleotide
catgacccaaactggggagttgactac

SEQ ID NO: 22398 - protein, 9 aa, Artificial Sequence
  Description of Artificial Sequence: Synthetic peptide
HDPNWGVDY

SEQ ID NO: 22399 - DNA, 45 bp, Artificial Sequence
  Description of Artificial Sequence: Synthetic oligonucleotide
gttggtatagaagtggctggtgactactacttcggtatggaagtc

SEQ ID NO: 22400 - protein, 15 aa, Artificial Sequence
  Description of Artificial Sequence: Synthetic peptide
VGIEVAGDYYFGMEV

SEQ ID NO: 22401 - DNA, 30 bp, Artificial Sequence
  Description of Artificial Sequence: Synthetic oligonucleotide
aattggggaatggctggcccctttgactac

SEQ ID NO: 22402 - protein, 10 aa, Artificial Sequence
  Description of Artificial Sequence: Synthetic peptide
NWGMAGPFDY

SEQ ID NO: 22403 - DNA, 36 bp, Artificial Sequence
  Description of Artificial Sequence: Synthetic oligonucleotide
cggagcagctcgtcggggggctacggtatggacgtc

SEQ ID NO: 22404 - protein, 12 aa, Artificial Sequence
  Description of Artificial Sequence: Synthetic peptide
RSSSSGGYGMDV

SEQ ID NO: 22405 - DNA, 24 bp, Artificial Sequence
  Description of Artificial Sequence: Synthetic oligonucleotide
gagattggctggctctctgactac

SEQ ID NO: 22406 - protein, 8 aa, Artificial Sequence
  Description of Artificial Sequence: Synthetic peptide
EIGWLSDY

SEQ ID NO: 22407 - DNA, 36 bp, Artificial Sequence
  Description of Artificial Sequence: Synthetic oligonucleotide
cgtatagcagcagctggtcactacggtatggacgtc

SEQ ID NO: 22408 - protein, 12 aa, Artificial Sequence
  Description of Artificial Sequence: Synthetic peptide
RIAAAGHYGMDV

SEQ ID NO: 22409 - DNA, 24 bp, Artificial Sequence
  Description of Artificial Sequence: Synthetic oligonucleotide
gagattggctggctctctgactac

SEQ ID NO: 22410 - protein, 8 aa, Artificial Sequence
  Description of Artificial Sequence: Synthetic peptide
EIGWLSDY

SEQ ID NO: 22411 - DNA, 42 bp, Artificial Sequence; identical to SEQ ID NO: 22371
  Description of Artificial Sequence: Synthetic oligonucleotide

SEQ ID NO: 22412 - protein, 14 aa, Artificial Sequence
  Description of Artificial Sequence: Synthetic peptide
EPYNSGWYDYGMDV

SEQ ID NO: 22413 - DNA, 15 bp, Artificial Sequence
  Description of Artificial Sequence: Synthetic oligonucleotide
gatcggggcagcagc

SEQ ID NO: 22414 - protein, 5 aa, Artificial Sequence
  Description of Artificial Sequence: Synthetic peptide
DRGSS

SEQ ID NO: 22415 - DNA, 15 bp, Artificial Sequence
  Description of Artificial Sequence: Synthetic oligonucleotide
gatcggggcagcagc

SEQ ID NO: 22416 - protein, 5 aa, Artificial Sequence
  Description of Artificial Sequence: Synthetic peptide
DRGSS

SEQ ID NO: 22417 - DNA, 27 bp, Artificial Sequence
  Description of Artificial Sequence: Synthetic oligonucleotide
agcagtggctggtacttctttgactac

SEQ ID NO: 22418 - protein, 9 aa, Artificial Sequence
  Description of Artificial Sequence: Synthetic peptide
SSGWYFFDY

SEQ ID NO: 22419 - DNA, 27 bp, Artificial Sequence
  Description of Artificial Sequence: Synthetic oligonucleotide
agcagtggctggtaccgctttgactac

SEQ ID NO: 22420 - protein, 9 aa, Artificial Sequence
  Description of Artificial Sequence: Synthetic peptide
SSGWYRFDY

SEQ ID NO: 22421 - DNA, 45 bp, Artificial Sequence
  Description of Artificial Sequence: Synthetic oligonucleotide
aaaggtatagcagcagttggagactactactacggtatggacgtc

SEQ ID NO: 22422 - protein, 15 aa, Artificial Sequence
  Description of Artificial Sequence: Synthetic peptide
KGIAAVGDYYYGMDV

SEQ ID NO: 22423 - DNA, 18 bp, Artificial Sequence
  Description of Artificial Sequence: Synthetic oligonucleotide
tatagcagctcgcactat

SEQ ID NO: 22424 - protein, 6 aa, Artificial Sequence
  Description of Artificial Sequence: Synthetic peptide
YSSSHY

SEQ ID NO: 22425 - DNA, 15 bp, Artificial Sequence
  Description of Artificial Sequence: Synthetic oligonucleotide
gatcgaggcagcctc

SEQ ID NO: 22426 - protein, 5 aa, Artificial Sequence
  Description of Artificial Sequence: Synthetic peptide
DRGSL

SEQ ID NO: 22427 - DNA, 18 bp, Artificial Sequence
  Description of Artificial Sequence: Synthetic oligonucleotide
ttgagcggtatggacgtc

SEQ ID NO: 22428 - protein, 6 aa, Artificial Sequence
  Description of Artificial Sequence: Synthetic peptide
LSGMDV

SEQ ID NO: 22429 - DNA, 15 bp, Artificial Sequence
  Description of Artificial Sequence: Synthetic oligonucleotide
gatcgaggcagcctc

SEQ ID NO: 22430 - protein, 5 aa, Artificial Sequence
  Description of Artificial Sequence: Synthetic peptide
DRGSL

SEQ ID NO: 22431 - DNA, 15 bp, Artificial Sequence
  Description of Artificial Sequence: Synthetic oligonucleotide
gcccgtatggacgtc

SEQ ID NO: 22432 - protein, 5 aa, Artificial Sequence
  Description of Artificial Sequence: Synthetic peptide
ARMDV

SEQ ID NO: 22433 - DNA, 27 bp, Artificial Sequence
  Description of Artificial Sequence: Synthetic oligonucleotide
agcagtggctggtacatgtttgactac

SEQ ID NO: 22434 - protein, 9 aa, Artificial Sequence
  Description of Artificial Sequence: Synthetic peptide
SSGWYMFDY

SEQ ID NO: 22435 - DNA, 18 bp, Artificial Sequence
  Description of Artificial Sequence: Synthetic oligonucleotide
ctaactggctttgactac

SEQ ID NO: 22436 - protein, 6 aa, Artificial Sequence
  Description of Artificial Sequence: Synthetic peptide
LTGFDY

SEQ ID NO: 22437 - DNA, 45 bp, Artificial Sequence
  Description of Artificial Sequence: Synthetic oligonucleotide
gttggtattgaagtggctggtgactactactacggtatggaagtc

SEQ ID NO: 22438 - protein, 15 aa, Artificial Sequence
  Description of Artificial Sequence: Synthetic peptide
VGIEVAGDYYYGMEV

SEQ ID NO: 22439 - DNA, 45 bp, Artificial Sequence
  Description of Artificial Sequence: Synthetic oligonucleotide
gttggtatagaagtggctggtgactactactacggtatggaagtc

SEQ ID NO: 22440 - protein, 15 aa, Artificial Sequence
  Description of Artificial Sequence: Synthetic peptide
VGIEVAGDYYYGMEV

SEQ ID NO: 22441 - DNA, 18 bp, Artificial Sequence
  Description of Artificial Sequence: Synthetic oligonucleotide
tatacctggaacggctac

SEQ ID NO: 22442 - protein, 6 aa, Artificial Sequence
  Description of Artificial Sequence: Synthetic peptide
YTWNGY

SEQ ID NO: 22443 - DNA, 39 bp, Artificial Sequence
  Description of Artificial Sequence: Synthetic oligonucleotide
gatcccttacgtggatacaatgacccggttatggactac

SEQ ID NO: 22444 - protein, 13 aa, Artificial Sequence
  Description of Artificial Sequence: Synthetic peptide
DPLRGYNDPVMDY

SEQ ID NO: 22445 - DNA, 33 bp, Artificial Sequence
  Description of Artificial Sequence: Synthetic oligonucleotide
gagggaggagtgggagctacctactttgactac

SEQ ID NO: 22446 - protein, 11 aa, Artificial Sequence
  Description of Artificial Sequence: Synthetic peptide
EGGVGATYFDY

SEQ ID NO: 22447 - DNA, 42 bp, Artificial Sequence
  Description of Artificial Sequence: Synthetic oligonucleotide
agggggattactgtggttcggaatgaggacggtttggacgtc

SEQ ID NO: 22448 - protein, 14 aa, Artificial Sequence
  Description of Artificial Sequence: Synthetic peptide
RGITVVRNEDGLDV

SEQ ID NO: 22449 - DNA, 39 bp, Artificial Sequence; identical to SEQ ID NO: 22443
  Description of Artificial Sequence: Synthetic oligonucleotide

SEQ ID NO: 22450 - protein, 13 aa, Artificial Sequence
  Description of Artificial Sequence: Synthetic peptide
DPLRGYNDPVMDY

SEQ ID NO: 22451 - DNA, 33 bp, Artificial Sequence; identical to SEQ ID NO: 22445
  Description of Artificial Sequence: Synthetic oligonucleotide

SEQ ID NO: 22452 - protein, 11 aa, Artificial Sequence
  Description of Artificial Sequence: Synthetic peptide
EGGVGATYFDY

SEQ ID NO: 22453 - DNA, 42 bp, Artificial Sequence; identical to SEQ ID NO: 22447
  Description of Artificial Sequence: Synthetic oligonucleotide

SEQ ID NO: 22454 - protein, 14 aa, Artificial Sequence
  Description of Artificial Sequence: Synthetic peptide
RGITVVRNEDGLDV

SEQ ID NO: 22455 - DNA, 30 bp, Artificial Sequence
  Description of Artificial Sequence: Synthetic oligonucleotide
gtcgggaggtactactacggtatggacgtc

SEQ ID NO: 22456 - protein, 10 aa, Artificial Sequence
  Description of Artificial Sequence: Synthetic peptide
VGRYYYGMDV

SEQ ID NO: 22457 - DNA, 39 bp, Artificial Sequence
  Description of Artificial Sequence: Synthetic oligonucleotide
ggggggactacggtggctacgtggggggtctttgactac

SEQ ID NO: 22458 - protein, 13 aa, Artificial Sequence
  Description of Artificial Sequence: Synthetic peptide
GGTTVATWGVFDY

SEQ ID NO: 22459 - DNA, 18 bp, Artificial Sequence
  Description of Artificial Sequence: Synthetic oligonucleotide
gtggctttctttgactat

SEQ ID NO: 22460 - protein, 6 aa, Artificial Sequence
  Description of Artificial Sequence: Synthetic peptide
VAFFDY

SEQ ID NO: 22461 - DNA, 42 bp, Artificial Sequence
  Description of Artificial Sequence: Synthetic oligonucleotide
gaaaggtatagcagtggctggtacgactacggtatggacgtc

SEQ ID NO: 22462 - protein, 14 aa, Artificial Sequence
  Description of Artificial Sequence: Synthetic peptide
ERYSSGWYDYGMDV

SEQ ID NO: 22463 - DNA, 36 bp, Artificial Sequence
  Description of Artificial Sequence: Synthetic oligonucleotide
gatgcccacgatttttggagtggttactttgactcc

SEQ ID NO: 22464 - protein, 12 aa, Artificial Sequence
  Description of Artificial Sequence: Synthetic peptide
DAHDFWSGYFDS

SEQ ID NO: 22465 - DNA, 18 bp, Artificial Sequence
  Description of Artificial Sequence: Synthetic oligonucleotide
gtggctttctttgactat

SEQ ID NO: 22466 - protein, 6 aa, Artificial Sequence
  Description of Artificial Sequence: Synthetic peptide
VAFFDY

SEQ ID NO: 22467 - DNA, 30 bp, Artificial Sequence
  Description of Artificial Sequence: Synthetic oligonucleotide
gtcgggaggtactactatggtatggacgtc

SEQ ID NO: 22468 - protein, 10 aa, Artificial Sequence
  Description of Artificial Sequence: Synthetic peptide
VGRYYYGMDV

SEQ ID NO: 22469 - DNA, 42 bp, Artificial Sequence
  Description of Artificial Sequence: Synthetic oligonucleotide
gagacgtatagcagcagctggtacgactacggtatggacgtc

SEQ ID NO: 22470 - protein, 14 aa, Artificial Sequence
  Description of Artificial Sequence: Synthetic peptide
ETYSSSWYDYGMDV

SEQ ID NO: 22471 - DNA, 39 bp, Artificial Sequence; identical to SEQ ID NO: 22443
  Description of Artificial Sequence: Synthetic oligonucleotide

SEQ ID NO: 22472 - protein, 13 aa, Artificial Sequence
  Description of Artificial Sequence: Synthetic peptide
DPLRGYNDPVMDY

SEQ ID NO: 22473 - DNA, 39 bp, Artificial Sequence; identical to SEQ ID NO: 22443
  Description of Artificial Sequence: Synthetic oligonucleotide

SEQ ID NO: 22474 - protein, 13 aa, Artificial Sequence
  Description of Artificial Sequence: Synthetic peptide
DPLRGYNDPVMDY

SEQ ID NO: 22475 - DNA, 39 bp, Artificial Sequence; identical to SEQ ID NO: 22443
  Description of Artificial Sequence: Synthetic oligonucleotide

SEQ ID NO: 22476 - protein, 13 aa, Artificial Sequence
  Description of Artificial Sequence: Synthetic peptide
DPLRGYNDPVMDY

SEQ ID NO: 22477 - DNA, 39 bp, Artificial Sequence; identical to SEQ ID NO: 22457
  Description of Artificial Sequence: Synthetic oligonucleotide

SEQ ID NO: 22478 - protein, 13 aa, Artificial Sequence
  Description of Artificial Sequence: Synthetic peptide
GGTTVATWGVFDY

SEQ ID NO: 22479 - DNA, 27 bp, Artificial Sequence
  Description of Artificial Sequence: Synthetic oligonucleotide
agcagtggctggtactggttcgacccc

SEQ ID NO: 22480 - protein, 9 aa, Artificial Sequence
  Description of Artificial Sequence: Synthetic peptide
SSGWYWFDP

SEQ ID NO: 22481 - DNA, 39 bp, Artificial Sequence; identical to SEQ ID NO: 22443
  Description of Artificial Sequence: Synthetic oligonucleotide

SEQ ID NO: 22482 - protein, 13 aa, Artificial Sequence
  Description of Artificial Sequence: Synthetic peptide
DPLRGYNDPVMDY

SEQ ID NO: 22483 - DNA, 39 bp, Artificial Sequence; identical to SEQ ID NO: 22443
  Description of Artificial Sequence: Synthetic oligonucleotide

SEQ ID NO: 22484 - protein, 13 aa, Artificial Sequence
  Description of Artificial Sequence: Synthetic peptide
DPLRGYNDPVMDY

SEQ ID NO: 22485 - DNA, 39 bp, Artificial Sequence; identical to SEQ ID NO: 22443
  Description of Artificial Sequence: Synthetic oligonucleotide

SEQ ID NO: 22486 - protein, 13 aa, Artificial Sequence
  Description of Artificial Sequence: Synthetic peptide
DPLRGYNDPVMDY

SEQ ID NO: 22487 - DNA, 33 bp, Artificial Sequence
  Description of Artificial Sequence: Synthetic oligonucleotide
gatcttattgggggagctacttactttgactac

SEQ ID NO: 22488 - protein, 11 aa, Artificial Sequence
  Description of Artificial Sequence: Synthetic peptide
DLIGGATYFDY

SEQ ID NO: 22489 - DNA, 36 bp, Artificial Sequence
  Description of Artificial Sequence: Synthetic oligonucleotide
gatcgtcaccgtttggactactacgctttggacgtc

SEQ ID NO: 22490 - protein, 12 aa, Artificial Sequence
  Description of Artificial Sequence: Synthetic peptide
DRHRLDYYALDV

SEQ ID NO: 22491 - DNA, 27 bp, Artificial Sequence
  Description of Artificial Sequence: Synthetic oligonucleotide
tcgaatagcagtggctggtttgactac

SEQ ID NO: 22492 - protein, 9 aa, Artificial Sequence
  Description of Artificial Sequence: Synthetic peptide
SNSSGWFDY

SEQ ID NO: 22493 - DNA, 36 bp, Artificial Sequence
  Description of Artificial Sequence: Synthetic oligonucleotide
ctggggatcgactactactactacggtatggacgtc

SEQ ID NO: 22494 - protein, 12 aa, Artificial Sequence
  Description of Artificial Sequence: Synthetic peptide
LGIDYYYYGMDV

SEQ ID NO: 22495 - DNA, 15 bp, Artificial Sequence
  Description of Artificial Sequence: Synthetic oligonucleotide
gataggggcagctcc

SEQ ID NO: 22496 - protein, 5 aa, Artificial Sequence
  Description of Artificial Sequence: Synthetic peptide
DRGSS

SEQ ID NO: 22497 - DNA, 39 bp, Artificial Sequence; identical to SEQ ID NO: 22443
  Description of Artificial Sequence: Synthetic oligonucleotide

SEQ ID NO: 22498 - protein, 13 aa, Artificial Sequence
  Description of Artificial Sequence: Synthetic peptide
DPLRGYNDPVMDY

SEQ ID NO: 22499 - DNA, 36 bp, Artificial Sequence
  Description of Artificial Sequence: Synthetic oligonucleotide
gaggcgtacgatttttggagtggttattgggactac

SEQ ID NO: 22500 - protein, 12 aa, Artificial Sequence
  Description of Artificial Sequence: Synthetic peptide
EAYDFWSGYWDY

SEQ ID NO: 22501 - DNA, 39 bp, Artificial Sequence; identical to SEQ ID NO: 22443
  Description of Artificial Sequence: Synthetic oligonucleotide

SEQ ID NO: 22502 - protein, 13 aa, Artificial Sequence
  Description of Artificial Sequence: Synthetic peptide
DPLRGYNDPVMDY

SEQ ID NO: 22503 - DNA, 27 bp, Artificial Sequence
  Description of Artificial Sequence: Synthetic oligonucleotide
agcagtggctggtaccggtttgactac

SEQ ID NO: 22504 - protein, 9 aa, Artificial Sequence
  Description of Artificial Sequence: Synthetic peptide
SSGWYRFDY

SEQ ID NO: 22505 - DNA, 36 bp, Artificial Sequence
  Description of Artificial Sequence: Synthetic oligonucleotide
agggatacctacaacggttgggatgcttttgatatc

SEQ ID NO: 22506 - protein, 12 aa, Artificial Sequence
  Description of Artificial Sequence: Synthetic peptide
RDTYNGWDAFDI

SEQ ID NO: 22507 - DNA, 36 bp, Artificial Sequence
  Description of Artificial Sequence: Synthetic oligonucleotide
gaggcctacgatttttggagtggtttctttgactcc

SEQ ID NO: 22508 - protein, 12 aa, Artificial Sequence
  Description of Artificial Sequence: Synthetic peptide
EAYDFWSGFFDS

SEQ ID NO: 22509 - DNA, 36 bp, Artificial Sequence
  Description of Artificial Sequence: Synthetic oligonucleotide
cggtatagcagcagctggtccggtggtatggacgtc

SEQ ID NO: 22510 - protein, 12 aa, Artificial Sequence
  Description of Artificial Sequence: Synthetic peptide
RYSSSWSGGMDV

SEQ ID NO: 22511 - DNA, 39 bp, Artificial Sequence; identical to SEQ ID NO: 22443
  Description of Artificial Sequence: Synthetic oligonucleotide

SEQ ID NO: 22512 - protein, 13 aa, Artificial Sequence
  Description of Artificial Sequence: Synthetic peptide
DPLRGYNDPVMDY

SEQ ID NO: 22513 - DNA, 27 bp, Artificial Sequence
  Description of Artificial Sequence: Synthetic oligonucleotide
agcagtggctggtactggttcgacccc

SEQ ID NO: 22514 - protein, 9 aa, Artificial Sequence
  Description of Artificial Sequence: Synthetic peptide
SSGWYWFDP

SEQ ID NO: 22515 - DNA, 27 bp, Artificial Sequence
  Description of Artificial Sequence: Synthetic oligonucleotide
tcgaatagcagtggctggtttgactac

SEQ ID NO: 22516 - protein, 9 aa, Artificial Sequence
  Description of Artificial Sequence: Synthetic peptide
SNSSGWFDY

SEQ ID NO: 22517 - DNA, 42 bp, Artificial Sequence; identical to SEQ ID NO: 22461
  Description of Artificial Sequence: Synthetic oligonucleotide

SEQ ID NO: 22518 - protein, 14 aa, Artificial Sequence
  Description of Artificial Sequence: Synthetic peptide
ERYSSGWYDYGMDV

SEQ ID NO: 22519 - DNA, 39 bp, Artificial Sequence; identical to SEQ ID NO: 22443
  Description of Artificial Sequence: Synthetic oligonucleotide

SEQ ID NO: 22520 - protein, 13 aa, Artificial Sequence
  Description of Artificial Sequence: Synthetic peptide
DPLRGYNDPVMDY

SEQ ID NO: 22521 - DNA, 39 bp, Artificial Sequence
  Description of Artificial Sequence: Synthetic oligonucleotide
ggggggactacggtgactacgtggggggtctttgactac

SEQ ID NO: 22522 - protein, 13 aa, Artificial Sequence
  Description of Artificial Sequence: Synthetic peptide
GGTTVTTWGVFDY

SEQ ID NO: 22523 - DNA, 18 bp, Artificial Sequence
  Description of Artificial Sequence: Synthetic oligonucleotide
acagcgggctttgactac

SEQ ID NO: 22524 - protein, 6 aa, Artificial Sequence
  Description of Artificial Sequence: Synthetic peptide
TAGFDY

SEQ ID NO: 22525 - DNA, 27 bp, Artificial Sequence
  Description of Artificial Sequence: Synthetic oligonucleotide
tcgaatagcagtggctggtttgactac

SEQ ID NO: 22526 - protein, 9 aa, Artificial Sequence
  Description of Artificial Sequence: Synthetic peptide
SNSSGWFDY

SEQ ID NO: 22527 - DNA, 27 bp, Artificial Sequence
  Description of Artificial Sequence: Synthetic oligonucleotide
agcagtggctggtactactttgactac

SEQ ID NO: 22528 - protein, 9 aa, Artificial Sequence
  Description of Artificial Sequence: Synthetic peptide
SSGWYYFDY

SEQ ID NO: 22529 - DNA, 36 bp, Artificial Sequence
  Description of Artificial Sequence: Synthetic oligonucleotide
agggatacctggaacggttgggatgcttttgatatc

SEQ ID NO: 22530 - protein, 12 aa, Artificial Sequence
  Description of Artificial Sequence: Synthetic peptide
RDTWNGWDAFDI

SEQ ID NO: 22531 - DNA, 36 bp, Artificial Sequence
  Description of Artificial Sequence: Synthetic oligonucleotide
gatgcccacgatttttggagtggttactttgcctac

SEQ ID NO: 22532 - protein, 12 aa, Artificial Sequence
  Description of Artificial Sequence: Synthetic peptide
DAHDFWSGYFAY

SEQ ID NO: 22533 - DNA, 42 bp, Artificial Sequence; identical to SEQ ID NO: 22447
  Description of Artificial Sequence: Synthetic oligonucleotide

SEQ ID NO: 22534 - protein, 14 aa, Artificial Sequence
  Description of Artificial Sequence: Synthetic peptide
RGITVVRNEDGLDV

SEQ ID NO: 22535 - DNA, 39 bp, Artificial Sequence
  Description of Artificial Sequence: Synthetic oligonucleotide
gatcccttacgtggatacaatgacccggttttggactac

SEQ ID NO: 22536 - protein, 13 aa, Artificial Sequence
  Description of Artificial Sequence: Synthetic peptide
DPLRGYNDPVLDY

SEQ ID NO: 22537 - DNA, 42 bp, Artificial Sequence
  Description of Artificial Sequence: Synthetic oligonucleotide
gaaaagtatagcagcaactggtacgactacggtatggacgtc

SEQ ID NO: 22538 - protein, 14 aa, Artificial Sequence
  Description of Artificial Sequence: Synthetic peptide
EKYSSNWYDYGMDV

SEQ ID NO: 22539 - DNA, 18 bp, Artificial Sequence
  Description of Artificial Sequence: Synthetic oligonucleotide
gtgactttctttgactat

SEQ ID NO: 22540 - protein, 6 aa, Artificial Sequence
  Description of Artificial Sequence: Synthetic peptide
VTFFDY

SEQ ID NO: 22541 - DNA, 42 bp, Artificial Sequence
  Description of Artificial Sequence: Synthetic oligonucleotide
gaaaagtatagcagcagctggtacgactacggtttggacgtc

SEQ ID NO: 22542 - protein, 14 aa, Artificial Sequence
  Description of Artificial Sequence: Synthetic peptide
EKYSSSWYDYGLDV

SEQ ID NO: 22543 - DNA, 42 bp, Artificial Sequence
  Description of Artificial Sequence: Synthetic oligonucleotide
ggttactatgatagtagtggttattactacccttttgacttc

SEQ ID NO: 22544 - protein, 14 aa, Artificial Sequence
  Description of Artificial Sequence: Synthetic peptide
GYYDSSGYYYPFDF

SEQ ID NO: 22545 - DNA, 36 bp, Artificial Sequence
  Description of Artificial Sequence: Synthetic oligonucleotide
gagacttacgatttttggagtggttattttgtcttc

SEQ ID NO: 22546 - protein, 12 aa, Artificial Sequence
  Description of Artificial Sequence: Synthetic peptide
ETYDFWSGYFVF

SEQ ID NO: 22547 - DNA, 27 bp, Artificial Sequence
  Description of Artificial Sequence: Synthetic oligonucleotide
agcagtggctggtactactttgacttc

SEQ ID NO: 22548 - protein, 9 aa, Artificial Sequence
  Description of Artificial Sequence: Synthetic peptide
SSGWYYFDF

SEQ ID NO: 22549 - DNA, 24 bp, Artificial Sequence
  Description of Artificial Sequence: Synthetic oligonucleotide
cgggacggtgactactttgactac

SEQ ID NO: 22550 - protein, 8 aa, Artificial Sequence
  Description of Artificial Sequence: Synthetic peptide
RDGDYFDY

SEQ ID NO: 22551 - DNA, 24 bp, Artificial Sequence
  Description of Artificial Sequence: Synthetic oligonucleotide
cggtacggtgactactttgactac

SEQ ID NO: 22552 - protein, 8 aa, Artificial Sequence
  Description of Artificial Sequence: Synthetic peptide
RYGDYFDY

SEQ ID NO: 22553 - DNA, 39 bp, Artificial Sequence; identical to SEQ ID NO: 22443
  Description of Artificial Sequence: Synthetic oligonucleotide

SEQ ID NO: 22554 - protein, 13 aa, Artificial Sequence
  Description of Artificial Sequence: Synthetic peptide
DPLRGYNDPVMDY

SEQ ID NO: 22555 - DNA, 36 bp, Artificial Sequence
  Description of Artificial Sequence: Synthetic oligonucleotide
gaacggtacgatttttggagtggtcattttgactac

SEQ ID NO: 22556 - protein, 12 aa, Artificial Sequence
  Description of Artificial Sequence: Synthetic peptide
ERYDFWSGHFDY

SEQ ID NO: 22557 - DNA, 24 bp, Artificial Sequence
  Description of Artificial Sequence: Synthetic oligonucleotide
cggtacggtgactactttgactac

SEQ ID NO: 22558 - protein, 8 aa, Artificial Sequence
  Description of Artificial Sequence: Synthetic peptide
RYGDYFDY

SEQ ID NO: 22559 - DNA, 36 bp, Artificial Sequence
  Description of Artificial Sequence: Synthetic oligonucleotide
cggtatagcggcagctggtccggtggtatggacgtc

SEQ ID NO: 22560 - protein, 12 aa, Artificial Sequence
  Description of Artificial Sequence: Synthetic peptide
RYSGSWSGGMDV

SEQ ID NO: 22561 - DNA, 27 bp, Artificial Sequence
  Description of Artificial Sequence: Synthetic oligonucleotide
cggactggggatgatgtttttgatgtc

SEQ ID NO: 22562 - protein, 9 aa, Artificial Sequence
  Description of Artificial Sequence: Synthetic peptide
RTGDDVFDV

SEQ ID NO: 22563 - DNA, 42 bp, Artificial Sequence
  Description of Artificial Sequence: Synthetic oligonucleotide
accggtgtggatccctgggactactacaacggaatggacgtc

SEQ ID NO: 22564 - protein, 14 aa, Artificial Sequence
  Description of Artificial Sequence: Synthetic peptide
TGVDPWDYYNGMDV

SEQ ID NO: 22565 - DNA, 24 bp, Artificial Sequence
  Description of Artificial Sequence: Synthetic oligonucleotide
gaggttggctggtccgatgactac

SEQ ID NO: 22566 - protein, 8 aa, Artificial Sequence
  Description of Artificial Sequence: Synthetic peptide
EVGWSDDY

SEQ ID NO: 22567 - DNA, 30 bp, Artificial Sequence
  Description of Artificial Sequence: Synthetic oligonucleotide
gatcatccccggtggagctacggagactac

SEQ ID NO: 22568 - protein, 10 aa, Artificial Sequence
  Description of Artificial Sequence: Synthetic peptide
DHPRWSYGDY

SEQ ID NO: 22569 - DNA, 36 bp, Artificial Sequence
  Description of Artificial Sequence: Synthetic oligonucleotide
gatcattacgatttttggagtgggcactttgacttc

SEQ ID NO: 22570 - protein, 12 aa, Artificial Sequence
  Description of Artificial Sequence: Synthetic peptide
DHYDFWSGHFDF

SEQ ID NO: 22571 - DNA, 12 bp, Artificial Sequence
  Description of Artificial Sequence: Synthetic oligonucleotide
aagtttggggac

SEQ ID NO: 22572 - protein, 4 aa, Artificial Sequence
  Description of Artificial Sequence: Synthetic peptide
KFGD

SEQ ID NO: 22573 - DNA, 39 bp, Artificial Sequence
  Description of Artificial Sequence: Synthetic oligonucleotide
cgggagacctacgactggggatccgatgcttttgatatc

SEQ ID NO: 22574 - protein, 13 aa, Artificial Sequence
  Description of Artificial Sequence: Synthetic peptide
RETYDWGSDAFDI

SEQ ID NO: 22575 - DNA, 27 bp, Artificial Sequence
  Description of Artificial Sequence: Synthetic oligonucleotide
agtagtggctggtacatctttgactac

SEQ ID NO: 22576 - protein, 9 aa, Artificial Sequence
  Description of Artificial Sequence: Synthetic peptide
SSGWYIFDY

SEQ ID NO: 22577 - DNA, 24 bp, Artificial Sequence
  Description of Artificial Sequence: Synthetic oligonucleotide
gaggttggctggtccgatgactac

SEQ ID NO: 22578 - protein, 8 aa, Artificial Sequence
  Description of Artificial Sequence: Synthetic peptide
EVGWSDDY

SEQ ID NO: 22579 - DNA, 36 bp, Artificial Sequence
  Description of Artificial Sequence: Synthetic oligonucleotide
gatcattacgatttttggagtgggcactttgactac

SEQ ID NO: 22580 - protein, 12 aa, Artificial Sequence
  Description of Artificial Sequence: Synthetic peptide
DHYDFWSGHFDY

SEQ ID NO: 22581 - DNA, 27 bp, Artificial Sequence
  Description of Artificial Sequence: Synthetic oligonucleotide
cggactggggatgatgtttttgatatc

SEQ ID NO: 22582 - protein, 9 aa, Artificial Sequence
  Description of Artificial Sequence: Synthetic peptide
RTGDDVFDI

SEQ ID NO: 22583 - DNA, 42 bp, Artificial Sequence
  Description of Artificial Sequence: Synthetic oligonucleotide
aggcccccgcagtggctggtagagggctacggtatggacgtc

SEQ ID NO: 22584 - protein, 14 aa, Artificial Sequence
  Description of Artificial Sequence: Synthetic peptide
RPPQWLVEGYGMDV

SEQ ID NO: 22585 - DNA, 33 bp, Artificial Sequence
  Description of Artificial Sequence: Synthetic oligonucleotide
aggtatagcagtggctgggactggttcgacccc

SEQ ID NO: 22586 - protein, 11 aa, Artificial Sequence
  Description of Artificial Sequence: Synthetic peptide
RYSSGWDWFDP

SEQ ID NO: 22587 - DNA, 21 bp, Artificial Sequence
  Description of Artificial Sequence: Synthetic oligonucleotide
gcaactatggcccttgactac

SEQ ID NO: 22588 - protein, 7 aa, Artificial Sequence
  Description of Artificial Sequence: Synthetic peptide
ATMALDY

SEQ ID NO: 22589 - DNA, 36 bp, Artificial Sequence
  Description of Artificial Sequence: Synthetic oligonucleotide
gatcggggatactatggctactacggtatggacgtc

SEQ ID NO: 22590 - protein, 12 aa, Artificial Sequence
  Description of Artificial Sequence: Synthetic peptide
DRGYYGYYGMDV

SEQ ID NO: 22591 - DNA, 33 bp, Artificial Sequence
  Description of Artificial Sequence: Synthetic oligonucleotide
gatcagggcgtgggctacgacggtttggacgtc

SEQ ID NO: 22592 - protein, 11 aa, Artificial Sequence
  Description of Artificial Sequence: Synthetic peptide
DQGVGYDGLDV

SEQ ID NO: 22593 - DNA, 33 bp, Artificial Sequence
  Description of Artificial Sequence: Synthetic oligonucleotide
gcccagggggtctactactacgttatggacgtc

SEQ ID NO: 22594 - protein, 11 aa, Artificial Sequence
  Description of Artificial Sequence: Synthetic peptide
AQGVYYYVMDV

SEQ ID NO: 22595 - DNA, 42 bp, Artificial Sequence
  Description of Artificial Sequence: Synthetic oligonucleotide
gaggaggattactatgatagtagtggcccggggttcgacccc

SEQ ID NO: 22596 - protein, 14 aa, Artificial Sequence
  Description of Artificial Sequence: Synthetic peptide
EEDYYDSSGPGFDP

SEQ ID NO: 22597 - DNA, 33 bp, Artificial Sequence; identical to SEQ ID NO: 22591
  Description of Artificial Sequence: Synthetic oligonucleotide

SEQ ID NO: 22598 - protein, 11 aa, Artificial Sequence
  Description of Artificial Sequence: Synthetic peptide
DQGVGYDGLDV

SEQ ID NO: 22599 - DNA, 36 bp, Artificial Sequence
  Description of Artificial Sequence: Synthetic oligonucleotide
ctccggtataactggaacttcccttactttgactac

SEQ ID NO: 22600 - protein, 12 aa, Artificial Sequence
  Description of Artificial Sequence: Synthetic peptide
LRYNWNFPYFDY

SEQ ID NO: 22601 - DNA, 33 bp, Artificial Sequence
  Description of Artificial Sequence: Synthetic oligonucleotide
tccgggtataattgggacgccggggtcgacccc

SEQ ID NO: 22602 - protein, 11 aa, Artificial Sequence
  Description of Artificial Sequence: Synthetic peptide
SGYNWDAGVDP

SEQ ID NO: 22603 - DNA, 33 bp, Artificial Sequence; identical to SEQ ID NO: 20155
  Description of Artificial Sequence: Synthetic oligonucleotide

SEQ ID NO: 22604 - protein, 11 aa, Artificial Sequence
  Description of Artificial Sequence: Synthetic peptide
GTHGYYYGVDV

SEQ ID NO: 22605 - DNA, 36 bp, Artificial Sequence
  Description of Artificial Sequence: Synthetic oligonucleotide
gatatgggtagatacagctatggtttctttgactac

SEQ ID NO: 22606 - protein, 12 aa, Artificial Sequence
  Description of Artificial Sequence: Synthetic peptide
DMGRYSYGFFDY

SEQ ID NO: 22607 - DNA, 33 bp, Artificial Sequence
  Description of Artificial Sequence: Synthetic oligonucleotide
gatagaagcgtcggctacgacggtttagatgtc

SEQ ID NO: 22608 - protein, 11 aa, Artificial Sequence
  Description of Artificial Sequence: Synthetic peptide
DRSVGYDGLDV

SEQ ID NO: 22609 - DNA, 33 bp, Artificial Sequence; identical to SEQ ID NO: 22591
  Description of Artificial Sequence: Synthetic oligonucleotide

SEQ ID NO: 22610 - protein, 11 aa, Artificial Sequence
  Description of Artificial Sequence: Synthetic peptide
DQGVGYDGLDV

SEQ ID NO: 22611 - DNA, 36 bp, Artificial Sequence
  Description of Artificial Sequence: Synthetic oligonucleotide
ctccggtataactggaacttccctttctttgactat

SEQ ID NO: 22612 - protein, 12 aa, Artificial Sequence
  Description of Artificial Sequence: Synthetic peptide
LRYNWNFPFFDY

SEQ ID NO: 22613 - DNA, 27 bp, Artificial Sequence
  Description of Artificial Sequence: Synthetic oligonucleotide
agcagtggctggtactactttgactac

SEQ ID NO: 22614 - protein, 9 aa, Artificial Sequence
  Description of Artificial Sequence: Synthetic peptide
SSGWYYFDY

SEQ ID NO: 22615 - DNA, 51 bp, Artificial Sequence
  Description of Artificial Sequence: Synthetic oligonucleotide
ggggattacgatggttcggggagttatcactactattacggtatggacgtc

SEQ ID NO: 22616 - protein, 17 aa, Artificial Sequence
  Description of Artificial Sequence: Synthetic peptide
GDYDGSGSYHYYYGMDV

SEQ ID NO: 22617 - DNA, 33 bp, Artificial Sequence
  Description of Artificial Sequence: Synthetic oligonucleotide
gataggggggtgggttactacggtttggacgtc

SEQ ID NO: 22618 - protein, 11 aa, Artificial Sequence
  Description of Artificial Sequence: Synthetic peptide
DRGVGYYGLDV

SEQ ID NO: 22619 - DNA, 51 bp, Artificial Sequence
  Description of Artificial Sequence: Synthetic oligonucleotide
ggggattacgatggttcggggagttatcactactactacggtatggacgtc

SEQ ID NO: 22620 - protein, 17 aa, Artificial Sequence
  Description of Artificial Sequence: Synthetic peptide
GDYDGSGSYHYYYGMDV

SEQ ID NO: 22621 - DNA, 51 bp, Artificial Sequence
  Description of Artificial Sequence: Synthetic oligonucleotide
ggggattacgatggttcggggagttatcacttctactacggtatggacgtc

SEQ ID NO: 22622 - protein, 17 aa, Artificial Sequence
  Description of Artificial Sequence: Synthetic peptide
GDYDGSGSYHFYYGMDV

SEQ ID NO: 22623 - DNA, 51 bp, Artificial Sequence; identical to SEQ ID NO: 22615
  Description of Artificial Sequence: Synthetic oligonucleotide

SEQ ID NO: 22624 - protein, 17 aa, Artificial Sequence
  Description of Artificial Sequence: Synthetic peptide
GDYDGSGSYHYYYGMDV

SEQ ID NO: 22625 - DNA, 36 bp, Artificial Sequence; identical to SEQ ID NO: 22599
  Description of Artificial Sequence: Synthetic oligonucleotide

SEQ ID NO: 22626 - protein, 12 aa, Artificial Sequence
  Description of Artificial Sequence: Synthetic peptide
LRYNWNFPYFDY

SEQ ID NO: 22627 - DNA, 27 bp, Artificial Sequence
  Description of Artificial Sequence: Synthetic oligonucleotide
agcagtggctggtacatctttgactac

SEQ ID NO: 22628 - protein, 9 aa, Artificial Sequence
  Description of Artificial Sequence: Synthetic peptide
SSGWYIFDY

SEQ ID NO: 22629 - DNA, 33 bp, Artificial Sequence; identical to SEQ ID NO: 20155
  Description of Artificial Sequence: Synthetic oligonucleotide

SEQ ID NO: 22630 - protein, 11 aa, Artificial Sequence
  Description of Artificial Sequence: Synthetic peptide
GTHGYYYGVDV

SEQ ID NO: 22631 - DNA, 33 bp, Artificial Sequence; identical to SEQ ID NO: 22591
  Description of Artificial Sequence: Synthetic oligonucleotide

SEQ ID NO: 22632 - protein, 11 aa, Artificial Sequence
  Description of Artificial Sequence: Synthetic peptide
DQGVGYDGLDV

SEQ ID NO: 22633 - DNA, 33 bp, Artificial Sequence
  Description of Artificial Sequence: Synthetic oligonucleotide
gatttctctgtagggtacgacggtatggacgtc

SEQ ID NO: 22634 - protein, 11 aa, Artificial Sequence
  Description of Artificial Sequence: Synthetic peptide
DFSVGYDGMDV

SEQ ID NO: 22635 - DNA, 33 bp, Artificial Sequence
  Description of Artificial Sequence: Synthetic oligonucleotide
tccgggtataactgggacaacggggtcgacccc

SEQ ID NO: 22636 - protein, 11 aa, Artificial Sequence
  Description of Artificial Sequence: Synthetic peptide
SGYNWDNGVDP

SEQ ID NO: 22637 - DNA, 21 bp, Artificial Sequence
  Description of Artificial Sequence: Synthetic oligonucleotide
gctactatggcccttgactac

SEQ ID NO: 22638 - protein, 7 aa, Artificial Sequence
  Description of Artificial Sequence: Synthetic peptide
ATMALDY

SEQ ID NO: 22639 - DNA, 42 bp, Artificial Sequence; identical to SEQ ID NO: 22595
  Description of Artificial Sequence: Synthetic oligonucleotide

SEQ ID NO: 22640 - protein, 14 aa, Artificial Sequence
  Description of Artificial Sequence: Synthetic peptide
EEDYYDSSGPGFDP

SEQ ID NO: 22641 - DNA, 33 bp, Artificial Sequence
  Description of Artificial Sequence: Synthetic oligonucleotide
gatagaacagtgggatactccggtatggacgtc

SEQ ID NO: 22642 - protein, 11 aa, Artificial Sequence
  Description of Artificial Sequence: Synthetic peptide
DRTVGYSGMDV

SEQ ID NO: 22643 - DNA, 36 bp, Artificial Sequence
  Description of Artificial Sequence: Synthetic oligonucleotide
ctccggtataactggaacttcccttactttgacttc

SEQ ID NO: 22644 - protein, 12 aa, Artificial Sequence
  Description of Artificial Sequence: Synthetic peptide
LRYNWNFPYFDF

SEQ ID NO: 22645 - DNA, 33 bp, Artificial Sequence; identical to SEQ ID NO: 22591
  Description of Artificial Sequence: Synthetic oligonucleotide

SEQ ID NO: 22646 - protein, 11 aa, Artificial Sequence
  Description of Artificial Sequence: Synthetic peptide
DQGVGYDGLDV

SEQ ID NO: 22647 - DNA, 33 bp, Artificial Sequence
  Description of Artificial Sequence: Synthetic oligonucleotide
gatggattcggtgggagctcctactttgactac

SEQ ID NO: 22648 - protein, 11 aa, Artificial Sequence
  Description of Artificial Sequence: Synthetic peptide
DGFGGSSYFDY

SEQ ID NO: 22649 - DNA, 12 bp, Artificial Sequence
  Description of Artificial Sequence: Synthetic oligonucleotide
aagtttggggac

SEQ ID NO: 22650 - protein, 4 aa, Artificial Sequence
  Description of Artificial Sequence: Synthetic peptide
KFGD

SEQ ID NO: 22651 - DNA, 24 bp, Artificial Sequence
  Description of Artificial Sequence: Synthetic oligonucleotide
gaggttggctggcacgatgactat

SEQ ID NO: 22652 - protein, 8 aa, Artificial Sequence
  Description of Artificial Sequence: Synthetic peptide
EVGWHDDY

SEQ ID NO: 22653 - DNA, 24 bp, Artificial Sequence
  Description of Artificial Sequence: Synthetic oligonucleotide
gaggttggctggcacgatgactat

SEQ ID NO: 22654 - protein, 8 aa, Artificial Sequence
  Description of Artificial Sequence: Synthetic peptide
EVGWHDDY

SEQ ID NO: 22655 - DNA, 18 bp, Artificial Sequence
  Description of Artificial Sequence: Synthetic oligonucleotide
agcaacctttttgactgc

SEQ ID NO: 22656 - protein, 6 aa, Artificial Sequence
  Description of Artificial Sequence: Synthetic peptide
SNLFDC

SEQ ID NO: 22657 - DNA, 12 bp, Artificial Sequence
  Description of Artificial Sequence: Synthetic oligonucleotide
aagtttggggac

SEQ ID NO: 22658 - protein, 4 aa, Artificial Sequence
  Description of Artificial Sequence: Synthetic peptide
KFGD

SEQ ID NO: 22659 - DNA, 36 bp, Artificial Sequence; identical to SEQ ID NO: 22579
  Description of Artificial Sequence: Synthetic oligonucleotide

SEQ ID NO: 22660 - protein, 12 aa, Artificial Sequence
  Description of Artificial Sequence: Synthetic peptide
DHYDFWSGHFDY

SEQ ID NO: 22661 - DNA, 27 bp, Artificial Sequence
  Description of Artificial Sequence: Synthetic oligonucleotide
cggactggggatgatgtttttgatatc

SEQ ID NO: 22662 - protein, 9 aa, Artificial Sequence
  Description of Artificial Sequence: Synthetic peptide
RTGDDVFDI

SEQ ID NO: 22663 - DNA, 12 bp, Artificial Sequence
  Description of Artificial Sequence: Synthetic oligonucleotide
aagtttggggac

SEQ ID NO: 22664 - protein, 4 aa, Artificial Sequence
  Description of Artificial Sequence: Synthetic peptide
KFGD

SEQ ID NO: 22665 - DNA, 27 bp, Artificial Sequence
  Description of Artificial Sequence: Synthetic oligonucleotide
aggaacaccgatgatgcttttgatatc

SEQ ID NO: 22666 - protein, 9 aa, Artificial Sequence
  Description of Artificial Sequence: Synthetic peptide
RNTDDAFDI

SEQ ID NO: 22667 - DNA, 12 bp, Artificial Sequence
  Description of Artificial Sequence: Synthetic oligonucleotide
aagtttggggac

SEQ ID NO: 22668 - protein, 4 aa, Artificial Sequence
  Description of Artificial Sequence: Synthetic peptide
KFGD

SEQ ID NO: 22669 - DNA, 36 bp, Artificial Sequence
  Description of Artificial Sequence: Synthetic oligonucleotide
gagagatacgatttttggagtggtcattttgactac

SEQ ID NO: 22670 - protein, 12 aa, Artificial Sequence
  Description of Artificial Sequence: Synthetic peptide
ERYDFWSGHFDY

SEQ ID NO: 22671 - DNA, 36 bp, Artificial Sequence
  Description of Artificial Sequence: Synthetic oligonucleotide
gatcgattcgatttttggagtggttattccgactac

SEQ ID NO: 22672 - protein, 12 aa, Artificial Sequence
  Description of Artificial Sequence: Synthetic peptide
DRFDFWSGYSDY

SEQ ID NO: 22673 - DNA, 21 bp, Artificial Sequence
  Description of Artificial Sequence: Synthetic oligonucleotide
gaatgggtgggagccgactac

SEQ ID NO: 22674 - protein, 7 aa, Artificial Sequence
  Description of Artificial Sequence: Synthetic peptide
EWVGADY

SEQ ID NO: 22675 - DNA, 51 bp, Artificial Sequence; identical to SEQ ID NO: 22615
  Description of Artificial Sequence: Synthetic oligonucleotide

SEQ ID NO: 22676 - protein, 17 aa, Artificial Sequence
  Description of Artificial Sequence: Synthetic peptide
GDYDGSGSYHYYYGMDV

SEQ ID NO: 22677 - DNA, 33 bp, Artificial Sequence; identical to SEQ ID NO: 20155
  Description of Artificial Sequence: Synthetic oligonucleotide

SEQ ID NO: 22678 - protein, 11 aa, Artificial Sequence
  Description of Artificial Sequence: Synthetic peptide
GTHGYYYGVDV

SEQ ID NO: 22679 - DNA, 33 bp, Artificial Sequence
  Description of Artificial Sequence: Synthetic oligonucleotide
gatggattcggtgggagctcctattttgactac

SEQ ID NO: 22680 - protein, 11 aa, Artificial Sequence
  Description of Artificial Sequence: Synthetic peptide
DGFGGSSYFDY

SEQ ID NO: 22681 - DNA, 51 bp, Artificial Sequence; identical to SEQ ID NO: 22619
  Description of Artificial Sequence: Synthetic oligonucleotide

SEQ ID NO: 22682 - protein, 17 aa, Artificial Sequence
  Description of Artificial Sequence: Synthetic peptide
GDYDGSGSYHYYYGMDV

SEQ ID NO: 22683 - DNA, 51 bp, Artificial Sequence
  Description of Artificial Sequence: Synthetic oligonucleotide
ggggattacgatggttcggggagttatcactactactacggtttggacgtc

SEQ ID NO: 22684 - protein, 17 aa, Artificial Sequence
  Description of Artificial Sequence: Synthetic peptide
GDYDGSGSYHYYYGLDV

SEQ ID NO: 22685 - DNA, 27 bp, Artificial Sequence
  Description of Artificial Sequence: Synthetic oligonucleotide
agcagtggctggtacatctttgactac

SEQ ID NO: 22686 - protein, 9 aa, Artificial Sequence
  Description of Artificial Sequence: Synthetic peptide
SSGWYIFDY

SEQ ID NO: 22687 - DNA, 36 bp, Artificial Sequence; identical to SEQ ID NO: 22589
  Description of Artificial Sequence: Synthetic oligonucleotide

SEQ ID NO: 22688 - protein, 12 aa, Artificial Sequence
  Description of Artificial Sequence: Synthetic peptide
DRGYYGYYGMDV

SEQ ID NO: 22689 - DNA, 33 bp, Artificial Sequence; identical to SEQ ID NO: 20155
  Description of Artificial Sequence: Synthetic oligonucleotide

SEQ ID NO: 22690 - protein, 11 aa, Artificial Sequence
  Description of Artificial Sequence: Synthetic peptide
GTHGYYYGVDV

SEQ ID NO: 22691 - DNA, 42 bp, Artificial Sequence
  Description of Artificial Sequence: Synthetic oligonucleotide
gaggagtatagcagtggctggttcgggtacggtatggacgtc

SEQ ID NO: 22692 - protein, 14 aa, Artificial Sequence
  Description of Artificial Sequence: Synthetic peptide
EEYSSGWFGYGMDV

SEQ ID NO: 22693 - DNA, 21 bp, Artificial Sequence
  Description of Artificial Sequence: Synthetic oligonucleotide
gaatgggtgggagccgactac

SEQ ID NO: 22694 - protein, 7 aa, Artificial Sequence
  Description of Artificial Sequence: Synthetic peptide
EWVGADY

SEQ ID NO: 22695 - DNA, 27 bp, Artificial Sequence
  Description of Artificial Sequence: Synthetic oligonucleotide
agcagtggctggtacttctttgactac

SEQ ID NO: 22696 - protein, 9 aa, Artificial Sequence
  Description of Artificial Sequence: Synthetic peptide
SSGWYFFDY

SEQ ID NO: 22697 - DNA, 36 bp, Artificial Sequence; identical to SEQ ID NO: 22599
  Description of Artificial Sequence: Synthetic oligonucleotide

SEQ ID NO: 22698 - protein, 12 aa, Artificial Sequence
  Description of Artificial Sequence: Synthetic peptide
LRYNWNFPYFDY

SEQ ID NO: 22699 - DNA, 42 bp, Artificial Sequence; identical to SEQ ID NO: 22595
  Description of Artificial Sequence: Synthetic oligonucleotide

SEQ ID NO: 22700 - protein, 14 aa, Artificial Sequence
  Description of Artificial Sequence: Synthetic peptide
EEDYYDSSGPGFDP

SEQ ID NO: 22701 - DNA, 33 bp, Artificial Sequence; identical to SEQ ID NO: 22591
  Description of Artificial Sequence: Synthetic oligonucleotide

SEQ ID NO: 22702 - protein, 11 aa, Artificial Sequence
  Description of Artificial Sequence: Synthetic peptide
DQGVGYDGLDV

SEQ ID NO: 22703 - DNA, 42 bp, Artificial Sequence; identical to SEQ ID NO: 22595
  Description of Artificial Sequence: Synthetic oligonucleotide

SEQ ID NO: 22704 - protein, 14 aa, Artificial Sequence
  Description of Artificial Sequence: Synthetic peptide
EEDYYDSSGPGFDP

SEQ ID NO: 22705 - DNA, 33 bp, Artificial Sequence; identical to SEQ ID NO: 22607
  Description of Artificial Sequence: Synthetic oligonucleotide

SEQ ID NO: 22706 - protein, 11 aa, Artificial Sequence
  Description of Artificial Sequence: Synthetic peptide
DRSVGYDGLDV

SEQ ID NO: 22707 - DNA, 51 bp, Artificial Sequence; identical to SEQ ID NO: 22615
  Description of Artificial Sequence: Synthetic oligonucleotide

SEQ ID NO: 22708 - protein, 17 aa, Artificial Sequence
  Description of Artificial Sequence: Synthetic peptide
GDYDGSGSYHYYYGMDV

SEQ ID NO: 22709 - DNA, 33 bp, Artificial Sequence
  Description of Artificial Sequence: Synthetic oligonucleotide
gcccacggggtctactactacgctatggacgtc

SEQ ID NO: 22710 - protein, 11 aa, Artificial Sequence
  Description of Artificial Sequence: Synthetic peptide
AHGVYYYAMDV

SEQ ID NO: 22711 - DNA, 33 bp, Artificial Sequence; identical to SEQ ID NO: 22601
  Description of Artificial Sequence: Synthetic oligonucleotide

SEQ ID NO: 22712 - protein, 11 aa, Artificial Sequence
  Description of Artificial Sequence: Synthetic peptide
SGYNWDAGVDP

SEQ ID NO: 22713 - DNA, 33 bp, Artificial Sequence; identical to SEQ ID NO: 22591
  Description of Artificial Sequence: Synthetic oligonucleotide

SEQ ID NO: 22714 - protein, 11 aa, Artificial Sequence
  Description of Artificial Sequence: Synthetic peptide
DQGVGYDGLDV

SEQ ID NO: 22715 - DNA, 33 bp, Artificial Sequence; identical to SEQ ID NO: 22591
  Description of Artificial Sequence: Synthetic oligonucleotide

SEQ ID NO: 22716 - protein, 11 aa, Artificial Sequence
  Description of Artificial Sequence: Synthetic peptide
DQGVGYDGLDV

SEQ ID NO: 22717 - DNA, 21 bp, Artificial Sequence
  Description of Artificial Sequence: Synthetic oligonucleotide
gaatgggtgggagccgactac

SEQ ID NO: 22718 - protein, 7 aa, Artificial Sequence
  Description of Artificial Sequence: Synthetic peptide
EWVGADY

SEQ ID NO: 22719 - DNA, 33 bp, Artificial Sequence; identical to SEQ ID NO: 22591
  Description of Artificial Sequence: Synthetic oligonucleotide

SEQ ID NO: 22720 - protein, 11 aa, Artificial Sequence
  Description of Artificial Sequence: Synthetic peptide
DQGVGYDGLDV

SEQ ID NO: 22721 - DNA, 54 bp, Artificial Sequence
  Description of Artificial Sequence: Synthetic oligonucleotide
gaggattccccttatagtggctacgccttggactacttctacggtatggacgtc

SEQ ID NO: 22722 - protein, 18 aa, Artificial Sequence
  Description of Artificial Sequence: Synthetic peptide
EDSPYSGYALDYFYGMDV

SEQ ID NO: 22723 - DNA, 33 bp, Artificial Sequence
  Description of Artificial Sequence: Synthetic oligonucleotide
gatcgtggggttggctactacggtatggacgtc

SEQ ID NO: 22724 - protein, 11 aa, Artificial Sequence
  Description of Artificial Sequence: Synthetic peptide
DRGVGYYGMDV

SEQ ID NO: 22725 - DNA, 36 bp, Artificial Sequence
  Description of Artificial Sequence: Synthetic oligonucleotide
ctcatagcagtagttgggtcccactactttgactac

SEQ ID NO: 22726 - protein, 12 aa, Artificial Sequence
  Description of Artificial Sequence: Synthetic peptide
LIAVVGSHYFDY

SEQ ID NO: 22727 - DNA, 51 bp, Artificial Sequence
  Description of Artificial Sequence: Synthetic oligonucleotide
ggggattacgatggttcggggagttatcaccactactacggtatggacgtc

SEQ ID NO: 22728 - protein, 17 aa, Artificial Sequence
  Description of Artificial Sequence: Synthetic peptide
GDYDGSGSYHHYYGMDV

SEQ ID NO: 22729 - DNA, 33 bp, Artificial Sequence; identical to SEQ ID NO: 22617
  Description of Artificial Sequence: Synthetic oligonucleotide

SEQ ID NO: 22730 - protein, 11 aa, Artificial Sequence
  Description of Artificial Sequence: Synthetic peptide
DRGVGYYGLDV

SEQ ID NO: 22731 - DNA, 51 bp, Artificial Sequence
  Description of Artificial Sequence: Synthetic oligonucleotide
ggggattacgatggttcggggagttatcactactaccacggtatggacgtc

SEQ ID NO: 22732 - protein, 17 aa, Artificial Sequence
  Description of Artificial Sequence: Synthetic peptide
GDYDGSGSYHYYHGMDV

SEQ ID NO: 22733 - DNA, 33 bp, Artificial Sequence
  Description of Artificial Sequence: Synthetic oligonucleotide
gatagaagcgtcggctacgacggtatggacgtc

SEQ ID NO: 22734 - protein, 11 aa, Artificial Sequence
  Description of Artificial Sequence: Synthetic peptide
DRSVGYDGMDV

SEQ ID NO: 22735 - DNA, 33 bp, Artificial Sequence
  Description of Artificial Sequence: Synthetic oligonucleotide
gatcaaggtgtggggtactacggtatggacgtc

SEQ ID NO: 22736 - protein, 11 aa, Artificial Sequence
  Description of Artificial Sequence: Synthetic peptide
DQGVGYYGMDV

SEQ ID NO: 22737 - DNA, 33 bp, Artificial Sequence
  Description of Artificial Sequence: Synthetic oligonucleotide
gcgggatataactgggacaacgggtttgactac

SEQ ID NO: 22738 - protein, 11 aa, Artificial Sequence
  Description of Artificial Sequence: Synthetic peptide
AGYNWDNGFDY

SEQ ID NO: 22739 - DNA, 42 bp, Artificial Sequence
  Description of Artificial Sequence: Synthetic oligonucleotide
gaggagtatagtagcggctggttcgggtacggtatggacgtc

SEQ ID NO: 22740 - protein, 14 aa, Artificial Sequence
  Description of Artificial Sequence: Synthetic peptide
EEYSSGWFGYGMDV

SEQ ID NO: 22741 - DNA, 33 bp, Artificial Sequence; identical to SEQ ID NO: 22591
  Description of Artificial Sequence: Synthetic oligonucleotide

SEQ ID NO: 22742 - protein, 11 aa, Artificial Sequence
  Description of Artificial Sequence: Synthetic peptide
DQGVGYDGLDV

SEQ ID NO: 22743 - DNA, 33 bp, Artificial Sequence; identical to SEQ ID NO: 20155
  Description of Artificial Sequence: Synthetic oligonucleotide

SEQ ID NO: 22744 - protein, 11 aa, Artificial Sequence
  Description of Artificial Sequence: Synthetic peptide
GTHGYYYGVDV

SEQ ID NO: 22745 - DNA, 33 bp, Artificial Sequence
  Description of Artificial Sequence: Synthetic oligonucleotide
gataggggagtgggttactacggtatggacgtc

SEQ ID NO: 22746 - protein, 11 aa, Artificial Sequence
  Description of Artificial Sequence: Synthetic peptide
DRGVGYYGMDV

SEQ ID NO: 22747 - DNA, 21 bp, Artificial Sequence
  Description of Artificial Sequence: Synthetic oligonucleotide
gactacggtgtctttgactac

SEQ ID NO: 22748 - protein, 7 aa, Artificial Sequence
  Description of Artificial Sequence: Synthetic peptide
DYGVFDY

SEQ ID NO: 22749 - DNA, 33 bp, Artificial Sequence; identical to SEQ ID NO: 22591
  Description of Artificial Sequence: Synthetic oligonucleotide

SEQ ID NO: 22750 - protein, 11 aa, Artificial Sequence
  Description of Artificial Sequence: Synthetic peptide
DQGVGYDGLDV

SEQ ID NO: 22751 - DNA, 36 bp, Artificial Sequence; identical to SEQ ID NO: 22599
  Description of Artificial Sequence: Synthetic oligonucleotide

SEQ ID NO: 22752 - protein, 12 aa, Artificial Sequence
  Description of Artificial Sequence: Synthetic peptide
LRYNWNFPYFDY

SEQ ID NO: 22753 - DNA, 33 bp, Artificial Sequence; identical to SEQ ID NO: 22607
  Description of Artificial Sequence: Synthetic oligonucleotide

SEQ ID NO: 22754 - protein, 11 aa, Artificial Sequence
  Description of Artificial Sequence: Synthetic peptide
DRSVGYDGLDV

SEQ ID NO: 22755 - DNA, 36 bp, Artificial Sequence
  Description of Artificial Sequence: Synthetic oligonucleotide
cgtttagcactggatggctatgatgcttttgatatc

SEQ ID NO: 22756 - protein, 12 aa, Artificial Sequence
  Description of Artificial Sequence: Synthetic peptide
RLALDGYDAFDI

SEQ ID NO: 22757 - DNA, 33 bp, Artificial Sequence; identical to SEQ ID NO: 22591
  Description of Artificial Sequence: Synthetic oligonucleotide

SEQ ID NO: 22758 - protein, 11 aa, Artificial Sequence
  Description of Artificial Sequence: Synthetic peptide
DQGVGYDGLDV

SEQ ID NO: 22759 - DNA, 51 bp, Artificial Sequence; identical to SEQ ID NO: 22619
  Description of Artificial Sequence: Synthetic oligonucleotide

SEQ ID NO: 22760 - protein, 17 aa, Artificial Sequence
  Description of Artificial Sequence: Synthetic peptide
GDYDGSGSYHYYYGMDV

SEQ ID NO: 22761 - DNA, 51 bp, Artificial Sequence; identical to SEQ ID NO: 22619
  Description of Artificial Sequence: Synthetic oligonucleotide

SEQ ID NO: 22762 - protein, 17 aa, Artificial Sequence
  Description of Artificial Sequence: Synthetic peptide
GDYDGSGSYHYYYGMDV

SEQ ID NO: 22763 - DNA, 51 bp, Artificial Sequence; identical to SEQ ID NO: 22619
  Description of Artificial Sequence: Synthetic oligonucleotide

SEQ ID NO: 22764 - protein, 17 aa, Artificial Sequence
  Description of Artificial Sequence: Synthetic peptide
GDYDGSGSYHYYYGMDV

SEQ ID NO: 22765 - DNA, 33 bp, Artificial Sequence; identical to SEQ ID NO: 22647
  Description of Artificial Sequence: Synthetic oligonucleotide

SEQ ID NO: 22766 - protein, 11 aa, Artificial Sequence
  Description of Artificial Sequence: Synthetic peptide
DGFGGSSYFDY

SEQ ID NO: 22767 - DNA, 51 bp, Artificial Sequence; identical to SEQ ID NO: 22621
  Description of Artificial Sequence: Synthetic oligonucleotide

SEQ ID NO: 22768 - protein, 17 aa, Artificial Sequence
  Description of Artificial Sequence: Synthetic peptide
GDYDGSGSYHFYYGMDV

SEQ ID NO: 22769 - DNA, 51 bp, Artificial Sequence; identical to SEQ ID NO: 22615
  Description of Artificial Sequence: Synthetic oligonucleotide

SEQ ID NO: 22770 - protein, 17 aa, Artificial Sequence
  Description of Artificial Sequence: Synthetic peptide
GDYDGSGSYHYYYGMDV

SEQ ID NO: 22771 - DNA, 36 bp, Artificial Sequence
  Description of Artificial Sequence: Synthetic oligonucleotide
gatctgggtagatacagctatggtttctttgactac

SEQ ID NO: 22772 - protein, 12 aa, Artificial Sequence
  Description of Artificial Sequence: Synthetic peptide
DLGRYSYGFFDY

SEQ ID NO: 22773 - DNA, 27 bp, Artificial Sequence
  Description of Artificial Sequence: Synthetic oligonucleotide
agcagtggctggtacttctttgactac

SEQ ID NO: 22774 - protein, 9 aa, Artificial Sequence
  Description of Artificial Sequence: Synthetic peptide
SSGWYFFDY

SEQ ID NO: 22775 - DNA, 39 bp, Artificial Sequence; identical to SEQ ID NO: 20143
  Description of Artificial Sequence: Synthetic oligonucleotide

SEQ ID NO: 22776 - protein, 13 aa, Artificial Sequence
  Description of Artificial Sequence: Synthetic peptide
GDPYNWNSYAMDV

SEQ ID NO: 22777 - DNA, 33 bp, Artificial Sequence
  Description of Artificial Sequence: Synthetic oligonucleotide
ggagagtataactggaaccacggtatggacgtc

SEQ ID NO: 22778 - protein, 11 aa, Artificial Sequence
  Description of Artificial Sequence: Synthetic peptide
GEYNWNHGMDV

SEQ ID NO: 22779 - DNA, 21 bp, Artificial Sequence
  Description of Artificial Sequence: Synthetic oligonucleotide
gactacggtggtttggactac

SEQ ID NO: 22780 - protein, 7 aa, Artificial Sequence
  Description of Artificial Sequence: Synthetic peptide
DYGGLDY

SEQ ID NO: 22781 - DNA, 51 bp, Artificial Sequence; identical to SEQ ID NO: 22615
  Description of Artificial Sequence: Synthetic oligonucleotide

SEQ ID NO: 22782 - protein, 17 aa, Artificial Sequence
  Description of Artificial Sequence: Synthetic peptide
GDYDGSGSYHYYYGMDV

SEQ ID NO: 22783 - DNA, 33 bp, Artificial Sequence
  Description of Artificial Sequence: Synthetic oligonucleotide
gatcagggcgtgggctacgacggcttggacgtc

SEQ ID NO: 22784 - protein, 11 aa, Artificial Sequence
  Description of Artificial Sequence: Synthetic peptide
DQGVGYDGLDV

SEQ ID NO: 22785 - DNA, 18 bp, Artificial Sequence
  Description of Artificial Sequence: Synthetic oligonucleotide
gactacggtgctgactac

SEQ ID NO: 22786 - protein, 6 aa, Artificial Sequence
  Description of Artificial Sequence: Synthetic peptide
DYGADY

SEQ ID NO: 22787 - DNA, 51 bp, Artificial Sequence; identical to SEQ ID NO: 22619
  Description of Artificial Sequence: Synthetic oligonucleotide

SEQ ID NO: 22788 - protein, 17 aa, Artificial Sequence
  Description of Artificial Sequence: Synthetic peptide
GDYDGSGSYHYYYGMDV

SEQ ID NO: 22789 - DNA, 51 bp, Artificial Sequence; identical to SEQ ID NO: 22615
  Description of Artificial Sequence: Synthetic oligonucleotide

SEQ ID NO: 22790 - protein, 17 aa, Artificial Sequence
  Description of Artificial Sequence: Synthetic peptide
GDYDGSGSYHYYYGMDV

SEQ ID NO: 22791 - DNA, 54 bp, Artificial Sequence
  Description of Artificial Sequence: Synthetic oligonucleotide
gaggattccccttatagtggctacggcttggactactactacggtatggacgtc

SEQ ID NO: 22792 - protein, 18 aa, Artificial Sequence
  Description of Artificial Sequence: Synthetic peptide
EDSPYSGYGLDYYYGMDV

SEQ ID NO: 22793 - DNA, 51 bp, Artificial Sequence
  Description of Artificial Sequence: Synthetic oligonucleotide
ggggattacgatggttcggggagttatcacttctactacggtttggacgtc

SEQ ID NO: 22794 - protein, 17 aa, Artificial Sequence
  Description of Artificial Sequence: Synthetic peptide
GDYDGSGSYHFYYGLDV

SEQ ID NO: 22795 - DNA, 33 bp, Artificial Sequence; identical to SEQ ID NO: 22737
  Description of Artificial Sequence: Synthetic oligonucleotide

SEQ ID NO: 22796 - protein, 11 aa, Artificial Sequence
  Description of Artificial Sequence: Synthetic peptide
AGYNWDNGFDY

SEQ ID NO: 22797 - DNA, 33 bp, Artificial Sequence; identical to SEQ ID NO: 22617
  Description of Artificial Sequence: Synthetic oligonucleotide

SEQ ID NO: 22798 - protein, 11 aa, Artificial Sequence
  Description of Artificial Sequence: Synthetic peptide
DRGVGYYGLDV

SEQ ID NO: 22799 - DNA, 21 bp, Artificial Sequence
  Description of Artificial Sequence: Synthetic oligonucleotide
gcaactatggcccttgactac

SEQ ID NO: 22800 - protein, 7 aa, Artificial Sequence
  Description of Artificial Sequence: Synthetic peptide
ATMALDY

SEQ ID NO: 22801 - DNA, 51 bp, Artificial Sequence; identical to SEQ ID NO: 22621
  Description of Artificial Sequence: Synthetic oligonucleotide

SEQ ID NO: 22802 - protein, 17 aa, Artificial Sequence
  Description of Artificial Sequence: Synthetic peptide
GDYDGSGSYHFYYGMDV

SEQ ID NO: 22803 - DNA, 36 bp, Artificial Sequence
  Description of Artificial Sequence: Synthetic oligonucleotide
gatttcactataactggagctacatattttgactac

SEQ ID NO: 22804 - protein, 12 aa, Artificial Sequence
  Description of Artificial Sequence: Synthetic peptide
DFTITGATYFDY

SEQ ID NO: 22805 - DNA, 33 bp, Artificial Sequence
  Description of Artificial Sequence: Synthetic oligonucleotide
aataggggggtgggttactacggtttggacgtc

SEQ ID NO: 22806 - protein, 11 aa, Artificial Sequence
  Description of Artificial Sequence: Synthetic peptide
NRGVGYYGLDV

SEQ ID NO: 22807 - DNA, 36 bp, Artificial Sequence; identical to SEQ ID NO: 22589
  Description of Artificial Sequence: Synthetic oligonucleotide

SEQ ID NO: 22808 - protein, 12 aa, Artificial Sequence
  Description of Artificial Sequence: Synthetic peptide
DRGYYGYYGMDV

SEQ ID NO: 22809 - DNA, 21 bp, Artificial Sequence
  Description of Artificial Sequence: Synthetic oligonucleotide
ggctacgatattttgactggt

SEQ ID NO: 22810 - protein, 7 aa, Artificial Sequence
  Description of Artificial Sequence: Synthetic peptide
GYDILTG

SEQ ID NO: 22811 - DNA, 36 bp, Artificial Sequence; identical to SEQ ID NO: 22599
  Description of Artificial Sequence: Synthetic oligonucleotide

SEQ ID NO: 22812 - protein, 12 aa, Artificial Sequence
  Description of Artificial Sequence: Synthetic peptide
LRYNWNFPYFDY

SEQ ID NO: 22813 - DNA, 51 bp, Artificial Sequence; identical to SEQ ID NO: 22615
  Description of Artificial Sequence: Synthetic oligonucleotide

SEQ ID NO: 22814 - protein, 17 aa, Artificial Sequence
  Description of Artificial Sequence: Synthetic peptide
GDYDGSGSYHYYYGMDV

SEQ ID NO: 22815 - DNA, 51 bp, Artificial Sequence; identical to SEQ ID NO: 22615
  Description of Artificial Sequence: Synthetic oligonucleotide

SEQ ID NO: 22816 - protein, 17 aa, Artificial Sequence
  Description of Artificial Sequence: Synthetic peptide
GDYDGSGSYHYYYGMDV

SEQ ID NO: 22817 - DNA, 33 bp, Artificial Sequence
  Description of Artificial Sequence: Synthetic oligonucleotide
gatcggtctaagggttacgacggtatggacgtc

SEQ ID NO: 22818 - protein, 11 aa, Artificial Sequence
  Description of Artificial Sequence: Synthetic peptide
DRSKGYDGMDV

SEQ ID NO: 22819 - DNA, 54 bp, Artificial Sequence
  Description of Artificial Sequence: Synthetic oligonucleotide
gaaccccttggttactatggttcggggagttatggggcctacggtatggacgtc

SEQ ID NO: 22820 - protein, 18 aa, Artificial Sequence
  Description of Artificial Sequence: Synthetic peptide
EPLGYYGSGSYGAYGMDV

SEQ ID NO: 22821 - DNA, 21 bp, Artificial Sequence
  Description of Artificial Sequence: Synthetic oligonucleotide
gactacggtgcttttgatatc

SEQ ID NO: 22822 - protein, 7 aa, Artificial Sequence
  Description of Artificial Sequence: Synthetic peptide
DYGAFDI

SEQ ID NO: 22823 - DNA, 42 bp, Artificial Sequence; identical to SEQ ID NO: 22691
  Description of Artificial Sequence: Synthetic oligonucleotide

SEQ ID NO: 22824 - protein, 14 aa, Artificial Sequence
  Description of Artificial Sequence: Synthetic peptide
EEYSSGWFGYGMDV

SEQ ID NO: 22825 - DNA, 33 bp, Artificial Sequence
  Description of Artificial Sequence: Synthetic oligonucleotide
gataggggggtgggttattacggtttggacgtc

SEQ ID NO: 22826 - protein, 11 aa, Artificial Sequence
  Description of Artificial Sequence: Synthetic peptide
DRGVGYYGLDV

SEQ ID NO: 22827 - DNA, 33 bp, Artificial Sequence; identical to SEQ ID NO: 22607
  Description of Artificial Sequence: Synthetic oligonucleotide

SEQ ID NO: 22828 - protein, 11 aa, Artificial Sequence
  Description of Artificial Sequence: Synthetic peptide
DRSVGYDGLDV

SEQ ID NO: 22829 - DNA, 21 bp, Artificial Sequence
  Description of Artificial Sequence: Synthetic oligonucleotide
gactacggtgcttttgatatc

SEQ ID NO: 22830 - protein, 7 aa, Artificial Sequence
  Description of Artificial Sequence: Synthetic peptide
DYGAFDI

SEQ ID NO: 22831 - DNA, 39 bp, Artificial Sequence
  Description of Artificial Sequence: Synthetic oligonucleotide
gattggttcggggaggggaactactacggtatggacgtc

SEQ ID NO: 22832 - protein, 13 aa, Artificial Sequence
  Description of Artificial Sequence: Synthetic peptide
DWFGEGNYYGMDV

SEQ ID NO: 22833 - DNA, 33 bp, Artificial Sequence
  Description of Artificial Sequence: Synthetic oligonucleotide
ggggggtataactggaacaacgggtttgactac

SEQ ID NO: 22834 - protein, 11 aa, Artificial Sequence
  Description of Artificial Sequence: Synthetic peptide
GGYNWNNGFDY

SEQ ID NO: 22835 - DNA, 33 bp, Artificial Sequence; identical to SEQ ID NO: 22591
  Description of Artificial Sequence: Synthetic oligonucleotide

SEQ ID NO: 22836 - protein, 11 aa, Artificial Sequence
  Description of Artificial Sequence: Synthetic peptide
DQGVGYDGLDV

SEQ ID NO: 22837 - DNA, 51 bp, Artificial Sequence; identical to SEQ ID NO: 22621
  Description of Artificial Sequence: Synthetic oligonucleotide

SEQ ID NO: 22838 - protein, 17 aa, Artificial Sequence
  Description of Artificial Sequence: Synthetic peptide
GDYDGSGSYHFYYGMDV

SEQ ID NO: 22839 - DNA, 33 bp, Artificial Sequence; identical to SEQ ID NO: 22617
  Description of Artificial Sequence: Synthetic oligonucleotide

SEQ ID NO: 22840 - protein, 11 aa, Artificial Sequence
  Description of Artificial Sequence: Synthetic peptide
DRGVGYYGLDV

SEQ ID NO: 22841 - DNA, 39 bp, Artificial Sequence
  Description of Artificial Sequence: Synthetic oligonucleotide
gaatggctacaattcaggtactactacggtatggacgtc

SEQ ID NO: 22842 - protein, 13 aa, Artificial Sequence
  Description of Artificial Sequence: Synthetic peptide
EWLQFRYYYGMDV

SEQ ID NO: 22843 - DNA, 33 bp, Artificial Sequence
  Description of Artificial Sequence: Synthetic oligonucleotide
ggggggtataactggaacaatgggtttgactgt

SEQ ID NO: 22844 - protein, 11 aa, Artificial Sequence
  Description of Artificial Sequence: Synthetic peptide
GGYNWNNGFDC

SEQ ID NO: 22845 - DNA, 33 bp, Artificial Sequence
  Description of Artificial Sequence: Synthetic oligonucleotide
ggggggtataactggaaccacggtatggacgtc

SEQ ID NO: 22846 - protein, 11 aa, Artificial Sequence
  Description of Artificial Sequence: Synthetic peptide
GGYNWNHGMDV

SEQ ID NO: 22847 - DNA, 21 bp, Artificial Sequence
  Description of Artificial Sequence: Synthetic oligonucleotide
gaatgggtgggagccgactac

SEQ ID NO: 22848 - protein, 7 aa, Artificial Sequence
  Description of Artificial Sequence: Synthetic peptide
EWVGADY

SEQ ID NO: 22849 - DNA, 33 bp, Artificial Sequence; identical to SEQ ID NO: 22647
  Description of Artificial Sequence: Synthetic oligonucleotide

SEQ ID NO: 22850 - protein, 11 aa, Artificial Sequence
  Description of Artificial Sequence: Synthetic peptide
DGFGGSSYFDY

SEQ ID NO: 22851 - DNA, 21 bp, Artificial Sequence
  Description of Artificial Sequence: Synthetic oligonucleotide
gaatgggtgggagccgactac

SEQ ID NO: 22852 - protein, 7 aa, Artificial Sequence
  Description of Artificial Sequence: Synthetic peptide
EWVGADY

SEQ ID NO: 22853 - DNA, 21 bp, Artificial Sequence
  Description of Artificial Sequence: Synthetic oligonucleotide
gaatgggtgggagccgactac

SEQ ID NO: 22854 - protein, 7 aa, Artificial Sequence
  Description of Artificial Sequence: Synthetic peptide
EWVGADY

SEQ ID NO: 22855 - DNA, 33 bp, Artificial Sequence
  Description of Artificial Sequence: Synthetic oligonucleotide
ggacagcagtggctggtaaacggtgtggacgtc

SEQ ID NO: 22856 - protein, 11 aa, Artificial Sequence
  Description of Artificial Sequence: Synthetic peptide
GQQWLVNGVDV

SEQ ID NO: 22857 - DNA, 45 bp, Artificial Sequence
  Description of Artificial Sequence: Synthetic oligonucleotide
gtggggggtttgactggctcctactactactacggtatggacgtc

SEQ ID NO: 22858 - protein, 15 aa, Artificial Sequence
  Description of Artificial Sequence: Synthetic peptide
VGGLTGSYYYYGMDV

SEQ ID NO: 22859 - DNA, 33 bp, Artificial Sequence; identical to SEQ ID NO: 22617
  Description of Artificial Sequence: Synthetic oligonucleotide

SEQ ID NO: 22860 - protein, 11 aa, Artificial Sequence
  Description of Artificial Sequence: Synthetic peptide
DRGVGYYGLDV

SEQ ID NO: 22861 - DNA, 27 bp, Artificial Sequence
  Description of Artificial Sequence: Synthetic oligonucleotide
agcggtggctggtacgtgttcgacccc

SEQ ID NO: 22862 - protein, 9 aa, Artificial Sequence
  Description of Artificial Sequence: Synthetic peptide
SGGWYVFDP

SEQ ID NO: 22863 - DNA, 45 bp, Artificial Sequence
  Description of Artificial Sequence: Synthetic oligonucleotide
gggggggttcggggagttcccaactactactacgttatggacgtc

SEQ ID NO: 22864 - protein, 15 aa, Artificial Sequence
  Description of Artificial Sequence: Synthetic peptide
GGVRGVPNYYYVMDV

SEQ ID NO: 22865 - DNA, 39 bp, Artificial Sequence; identical to SEQ ID NO: 22831
  Description of Artificial Sequence: Synthetic oligonucleotide

SEQ ID NO: 22866 - protein, 13 aa, Artificial Sequence
  Description of Artificial Sequence: Synthetic peptide
DWFGEGNYYGMDV

SEQ ID NO: 22867 - DNA, 36 bp, Artificial Sequence; identical to SEQ ID NO: 20159
  Description of Artificial Sequence: Synthetic oligonucleotide

SEQ ID NO: 22868 - protein, 12 aa, Artificial Sequence
  Description of Artificial Sequence: Synthetic peptide
MDYSNYYYGMDV

SEQ ID NO: 22869 - DNA, 21 bp, Artificial Sequence
  Description of Artificial Sequence: Synthetic oligonucleotide
gcaactatggcccttgactac

SEQ ID NO: 22870 - protein, 7 aa, Artificial Sequence
  Description of Artificial Sequence: Synthetic peptide
ATMALDY

SEQ ID NO: 22871 - DNA, 39 bp, Artificial Sequence; identical to SEQ ID NO: 20143
  Description of Artificial Sequence: Synthetic oligonucleotide

SEQ ID NO: 22872 - protein, 13 aa, Artificial Sequence
  Description of Artificial Sequence: Synthetic peptide
GDPYNWNSYAMDV

SEQ ID NO: 22873 - DNA, 51 bp, Artificial Sequence; identical to SEQ ID NO: 22683
  Description of Artificial Sequence: Synthetic oligonucleotide

SEQ ID NO: 22874 - protein, 17 aa, Artificial Sequence
  Description of Artificial Sequence: Synthetic peptide
GDYDGSGSYHYYYGLDV

SEQ ID NO: 22875 - DNA, 33 bp, Artificial Sequence; identical to SEQ ID NO: 22591
  Description of Artificial Sequence: Synthetic oligonucleotide

SEQ ID NO: 22876 - protein, 11 aa, Artificial Sequence
  Description of Artificial Sequence: Synthetic peptide
DQGVGYDGLDV

SEQ ID NO: 22877 - DNA, 33 bp, Artificial Sequence
  Description of Artificial Sequence: Synthetic oligonucleotide
gatccctctgtagggtacgacggtatggacgtc

SEQ ID NO: 22878 - protein, 11 aa, Artificial Sequence
  Description of Artificial Sequence: Synthetic peptide
DPSVGYDGMDV

SEQ ID NO: 22879 - DNA, 51 bp, Artificial Sequence; identical to SEQ ID NO: 22683
  Description of Artificial Sequence: Synthetic oligonucleotide

SEQ ID NO: 22880 - protein, 17 aa, Artificial Sequence
  Description of Artificial Sequence: Synthetic peptide
GDYDGSGSYHYYYGLDV

SEQ ID NO: 22881 - DNA, 27 bp, Artificial Sequence
  Description of Artificial Sequence: Synthetic oligonucleotide
agcagtggctggtactactttgactac

SEQ ID NO: 22882 - protein, 9 aa, Artificial Sequence
  Description of Artificial Sequence: Synthetic peptide
SSGWYYFDY

SEQ ID NO: 22883 - DNA, 33 bp, Artificial Sequence; identical to SEQ ID NO: 22591
  Description of Artificial Sequence: Synthetic oligonucleotide

SEQ ID NO: 22884 - protein, 11 aa, Artificial Sequence
  Description of Artificial Sequence: Synthetic peptide
DQGVGYDGLDV

SEQ ID NO: 22885 - DNA, 27 bp, Artificial Sequence
  Description of Artificial Sequence: Synthetic oligonucleotide
agcagtggctggtactactttgactac

SEQ ID NO: 22886 - protein, 9 aa, Artificial Sequence
  Description of Artificial Sequence: Synthetic peptide
SSGWYYFDY

SEQ ID NO: 22887 - DNA, 45 bp, Artificial Sequence
  Description of Artificial Sequence: Synthetic oligonucleotide
gatcggggatatagcaggatagcagtggctggtacctttgactac

SEQ ID NO: 22888 - protein, 15 aa, Artificial Sequence
  Description of Artificial Sequence: Synthetic peptide
DRGYSRIAVAGTFDY

SEQ ID NO: 22889 - DNA, 36 bp, Artificial Sequence; identical to SEQ ID NO: 22599
  Description of Artificial Sequence: Synthetic oligonucleotide

SEQ ID NO: 22890 - protein, 12 aa, Artificial Sequence
  Description of Artificial Sequence: Synthetic peptide
LRYNWNFPYFDY

SEQ ID NO: 22891 - DNA, 36 bp, Artificial Sequence
  Description of Artificial Sequence: Synthetic oligonucleotide
ggcatagcagtggctggctcgcactactttgactac

SEQ ID NO: 22892 - protein, 12 aa, Artificial Sequence
  Description of Artificial Sequence: Synthetic peptide
GIAVAGSHYFDY

SEQ ID NO: 22893 - DNA, 39 bp, Artificial Sequence
  Description of Artificial Sequence: Synthetic oligonucleotide
gaatggctacaatttaggtactactacggtatagacgtc

SEQ ID NO: 22894 - protein, 13 aa, Artificial Sequence
  Description of Artificial Sequence: Synthetic peptide
EWLQFRYYYGIDV

SEQ ID NO: 22895 - DNA, 33 bp, Artificial Sequence; identical to SEQ ID NO: 22607
  Description of Artificial Sequence: Synthetic oligonucleotide

SEQ ID NO: 22896 - protein, 11 aa, Artificial Sequence
  Description of Artificial Sequence: Synthetic peptide
DRSVGYDGLDV

SEQ ID NO: 22897 - DNA, 33 bp, Artificial Sequence; identical to SEQ ID NO: 22591
  Description of Artificial Sequence: Synthetic oligonucleotide

SEQ ID NO: 22898 - protein, 11 aa, Artificial Sequence
  Description of Artificial Sequence: Synthetic peptide
DQGVGYDGLDV

SEQ ID NO: 22899 - DNA, 51 bp, Artificial Sequence; identical to SEQ ID NO: 22615
  Description of Artificial Sequence: Synthetic oligonucleotide

SEQ ID NO: 22900 - protein, 17 aa, Artificial Sequence
  Description of Artificial Sequence: Synthetic peptide
GDYDGSGSYHYYYGMDV

SEQ ID NO: 22901 - DNA, 51 bp, Artificial Sequence; identical to SEQ ID NO: 22615
  Description of Artificial Sequence: Synthetic oligonucleotide

SEQ ID NO: 22902 - protein, 17 aa, Artificial Sequence
  Description of Artificial Sequence: Synthetic peptide
GDYDGSGSYHYYYGMDV

SEQ ID NO: 22903 - DNA, 51 bp, Artificial Sequence
  Description of Artificial Sequence: Synthetic oligonucleotide
ggggattactatggttcggggagttatcacaactactacggtttggacgtc

SEQ ID NO: 22904 - protein, 17 aa, Artificial Sequence
  Description of Artificial Sequence: Synthetic peptide
GDYYGSGSYHNYYGLDV

SEQ ID NO: 22905 - DNA, 33 bp, Artificial Sequence
  Description of Artificial Sequence: Synthetic oligonucleotide
gatcagggcgtgggctactacggtatggacgtc

SEQ ID NO: 22906 - protein, 11 aa, Artificial Sequence
  Description of Artificial Sequence: Synthetic peptide
DQGVGYYGMDV

SEQ ID NO: 22907 - DNA, 39 bp, Artificial Sequence; identical to SEQ ID NO: 22841
  Description of Artificial Sequence: Synthetic oligonucleotide

SEQ ID NO: 22908 - protein, 13 aa, Artificial Sequence
  Description of Artificial Sequence: Synthetic peptide
EWLQFRYYYGMDV

SEQ ID NO: 22909 - DNA, 36 bp, Artificial Sequence; identical to SEQ ID NO: 22599
  Description of Artificial Sequence: Synthetic oligonucleotide

SEQ ID NO: 22910 - protein, 12 aa, Artificial Sequence
  Description of Artificial Sequence: Synthetic peptide
LRYNWNFPYFDY

SEQ ID NO: 22911 - DNA, 51 bp, Artificial Sequence; identical to SEQ ID NO: 22621
  Description of Artificial Sequence: Synthetic oligonucleotide

SEQ ID NO: 22912 - protein, 17 aa, Artificial Sequence
  Description of Artificial Sequence: Synthetic peptide
GDYDGSGSYHFYYGMDV

SEQ ID NO: 22913 - DNA, 51 bp, Artificial Sequence; identical to SEQ ID NO: 22619
  Description of Artificial Sequence: Synthetic oligonucleotide

SEQ ID NO: 22914 - protein, 17 aa, Artificial Sequence
  Description of Artificial Sequence: Synthetic peptide
GDYDGSGSYHYYYGMDV

SEQ ID NO: 22915 - DNA, 18 bp, Artificial Sequence
  Description of Artificial Sequence: Synthetic oligonucleotide
gactacggtgctgactac

SEQ ID NO: 22916 - protein, 6 aa, Artificial Sequence
  Description of Artificial Sequence: Synthetic peptide
DYGADY

SEQ ID NO: 22917 - DNA, 33 bp, Artificial Sequence; identical to SEQ ID NO: 22905
  Description of Artificial Sequence: Synthetic oligonucleotide

SEQ ID NO: 22918 - protein, 11 aa, Artificial Sequence
  Description of Artificial Sequence: Synthetic peptide
DQGVGYYGMDV

SEQ ID NO: 22919 - DNA, 33 bp, Artificial Sequence; identical to SEQ ID NO: 22709
  Description of Artificial Sequence: Synthetic oligonucleotide

SEQ ID NO: 22920 - protein, 11 aa, Artificial Sequence
  Description of Artificial Sequence: Synthetic peptide
AHGVYYYAMDV

SEQ ID NO: 22921 - DNA, 39 bp, Artificial Sequence; identical to SEQ ID NO: 22841
  Description of Artificial Sequence: Synthetic oligonucleotide

SEQ ID NO: 22922 - protein, 13 aa, Artificial Sequence
  Description of Artificial Sequence: Synthetic peptide
EWLQFRYYYGMDV

SEQ ID NO: 22923 - DNA, 51 bp, Artificial Sequence; identical to SEQ ID NO: 22615
  Description of Artificial Sequence: Synthetic oligonucleotide

SEQ ID NO: 22924 - protein, 17 aa, Artificial Sequence
  Description of Artificial Sequence: Synthetic peptide
GDYDGSGSYHYYYGMDV

SEQ ID NO: 22925 - DNA, 51 bp, Artificial Sequence; identical to SEQ ID NO: 22903
  Description of Artificial Sequence: Synthetic oligonucleotide

SEQ ID NO: 22926 - protein, 17 aa, Artificial Sequence
  Description of Artificial Sequence: Synthetic peptide
GDYYGSGSYHNYYGLDV

SEQ ID NO: 22927 - DNA, 36 bp, Artificial Sequence
  Description of Artificial Sequence: Synthetic oligonucleotide
cgtatagcagtggatggctatgatgcttttgatgtc

SEQ ID NO: 22928 - protein, 12 aa, Artificial Sequence
  Description of Artificial Sequence: Synthetic peptide
RIAVDGYDAFDV

SEQ ID NO: 22929 - DNA, 39 bp, Artificial Sequence
  Description of Artificial Sequence: Synthetic oligonucleotide
gaatggctacaatttaggtattactacggtatggacgtc

SEQ ID NO: 22930 - protein, 13 aa, Artificial Sequence
  Description of Artificial Sequence: Synthetic peptide
EWLQFRYYYGMDV

SEQ ID NO: 22931 - DNA, 33 bp, Artificial Sequence
  Description of Artificial Sequence: Synthetic oligonucleotide
gccgggtataactggaacaacggtatggacgtc

SEQ ID NO: 22932 - protein, 11 aa, Artificial Sequence
  Description of Artificial Sequence: Synthetic peptide
AGYNWNNGMDV

SEQ ID NO: 22933 - DNA, 27 bp, Artificial Sequence
  Description of Artificial Sequence: Synthetic oligonucleotide
agcggtggctggtacgtgttcgacccc

SEQ ID NO: 22934 - protein, 9 aa, Artificial Sequence
  Description of Artificial Sequence: Synthetic peptide
SGGWYVFDP

SEQ ID NO: 22935 - DNA, 36 bp, Artificial Sequence; identical to SEQ ID NO: 22589
  Description of Artificial Sequence: Synthetic oligonucleotide

SEQ ID NO: 22936 - protein, 12 aa, Artificial Sequence
  Description of Artificial Sequence: Synthetic peptide
DRGYYGYYGMDV

SEQ ID NO: 22937 - DNA, 33 bp, Artificial Sequence; identical to SEQ ID NO: 20155
  Description of Artificial Sequence: Synthetic oligonucleotide

SEQ ID NO: 22938 - protein, 11 aa, Artificial Sequence
  Description of Artificial Sequence: Synthetic peptide
GTHGYYYGVDV

SEQ ID NO: 22939 - DNA, 51 bp, Artificial Sequence; identical to SEQ ID NO: 22619
  Description of Artificial Sequence: Synthetic oligonucleotide

SEQ ID NO: 22940 - protein, 17 aa, Artificial Sequence
  Description of Artificial Sequence: Synthetic peptide
GDYDGSGSYHYYYGMDV

SEQ ID NO: 22941 - DNA, 18 bp, Artificial Sequence
  Description of Artificial Sequence: Synthetic oligonucleotide
gactacggggcggactac

SEQ ID NO: 22942 - protein, 6 aa, Artificial Sequence
  Description of Artificial Sequence: Synthetic peptide
DYGADY

SEQ ID NO: 22943 - DNA, 18 bp, Artificial Sequence
  Description of Artificial Sequence: Synthetic oligonucleotide
gactacggggcggactac

SEQ ID NO: 22944 - protein, 6 aa, Artificial Sequence
  Description of Artificial Sequence: Synthetic peptide
DYGADY

SEQ ID NO: 22945 - DNA, 21 bp, Artificial Sequence
  Description of Artificial Sequence: Synthetic oligonucleotide
gactacgggggtttagactac

SEQ ID NO: 22946 - protein, 7 aa, Artificial Sequence
  Description of Artificial Sequence: Synthetic peptide
DYGGLDY

SEQ ID NO: 22947 - DNA, 39 bp, Artificial Sequence
  Description of Artificial Sequence: Synthetic oligonucleotide
cacgatttttggagtggttattataagggtatggacgtc

SEQ ID NO: 22948 - protein, 13 aa, Artificial Sequence
  Description of Artificial Sequence: Synthetic peptide
HDFWSGYYKGMDV

SEQ ID NO: 22949 - DNA, 27 bp, Artificial Sequence
  Description of Artificial Sequence: Synthetic oligonucleotide
gatcaacggtactacggtatggacgtc

SEQ ID NO: 22950 - protein, 9 aa, Artificial Sequence
  Description of Artificial Sequence: Synthetic peptide
DQRYYGMDV

SEQ ID NO: 22951 - DNA, 21 bp, Artificial Sequence
  Description of Artificial Sequence: Synthetic oligonucleotide
gactatggtgtctttgattac

SEQ ID NO: 22952 - protein, 7 aa, Artificial Sequence
  Description of Artificial Sequence: Synthetic peptide
DYGVFDY

SEQ ID NO: 22953 - DNA, 33 bp, Artificial Sequence
  Description of Artificial Sequence: Synthetic oligonucleotide
gatcaagggtataactggaactcttttgactac

SEQ ID NO: 22954 - protein, 11 aa, Artificial Sequence
  Description of Artificial Sequence: Synthetic peptide
DQGYNWNSFDY

SEQ ID NO: 22955 - DNA, 18 bp, Artificial Sequence
  Description of Artificial Sequence: Synthetic oligonucleotide
gactacggggcggactac

SEQ ID NO: 22956 - protein, 6 aa, Artificial Sequence
  Description of Artificial Sequence: Synthetic peptide
DYGADY

SEQ ID NO: 22957 - DNA, 33 bp, Artificial Sequence
  Description of Artificial Sequence: Synthetic oligonucleotide
ggatacagctatggttacaactggttcgacccc

SEQ ID NO: 22958 - protein, 11 aa, Artificial Sequence
  Description of Artificial Sequence: Synthetic peptide
GYSYGYNWFDP

SEQ ID NO: 22959 - DNA, 39 bp, Artificial Sequence
  Description of Artificial Sequence: Synthetic oligonucleotide
gggggagctaggagcagtggctggttccactttgactac

SEQ ID NO: 22960 - protein, 13 aa, Artificial Sequence
  Description of Artificial Sequence: Synthetic peptide
GGARSSGWFHFDY

SEQ ID NO: 22961 - DNA, 48 bp, Artificial Sequence
  Description of Artificial Sequence: Synthetic oligonucleotide
ggaaggtatagcagggaggattactactactattatgatatggacgtc

SEQ ID NO: 22962 - protein, 16 aa, Artificial Sequence
  Description of Artificial Sequence: Synthetic peptide
GRYSREDYYYYYDMDV

SEQ ID NO: 22963 - DNA, 27 bp, Artificial Sequence
  Description of Artificial Sequence: Synthetic oligonucleotide
gatcaacggtactacggtatggacgtc

SEQ ID NO: 22964 - protein, 9 aa, Artificial Sequence
  Description of Artificial Sequence: Synthetic peptide
DQRYYGMDV

SEQ ID NO: 22965 - DNA, 27 bp, Artificial Sequence
  Description of Artificial Sequence: Synthetic oligonucleotide
gatcaacggtactacggtatggacgtc

SEQ ID NO: 22966 - protein, 9 aa, Artificial Sequence
  Description of Artificial Sequence: Synthetic peptide
DQRYYGMDV

SEQ ID NO: 22967 - DNA, 39 bp, Artificial Sequence; identical to SEQ ID NO: 22959
  Description of Artificial Sequence: Synthetic oligonucleotide

SEQ ID NO: 22968 - protein, 13 aa, Artificial Sequence
  Description of Artificial Sequence: Synthetic peptide
GGARSSGWFHFDY

SEQ ID NO: 22969 - DNA, 21 bp, Artificial Sequence
  Description of Artificial Sequence: Synthetic oligonucleotide
gactacgggggtttagactac

SEQ ID NO: 22970 - protein, 7 aa, Artificial Sequence
  Description of Artificial Sequence: Synthetic peptide
DYGGLDY

SEQ ID NO: 22971 - DNA, 33 bp, Artificial Sequence
  Description of Artificial Sequence: Synthetic oligonucleotide
aatatagcagcagctgccccttactttgactac

SEQ ID NO: 22972 - protein, 11 aa, Artificial Sequence
  Description of Artificial Sequence: Synthetic peptide
NIAAAAPYFDY

SEQ ID NO: 22973 - DNA, 33 bp, Artificial Sequence
  Description of Artificial Sequence: Synthetic oligonucleotide
gatagaacagttggctacaacggtatggacgtc

SEQ ID NO: 22974 - protein, 11 aa, Artificial Sequence
  Description of Artificial Sequence: Synthetic peptide
DRTVGYNGMDV

SEQ ID NO: 22975 - DNA, 33 bp, Artificial Sequence; identical to SEQ ID NO: 22957
  Description of Artificial Sequence: Synthetic oligonucleotide

SEQ ID NO: 22976 - protein, 11 aa, Artificial Sequence
  Description of Artificial Sequence: Synthetic peptide
GYSYGYNWFDP

SEQ ID NO: 22977 - DNA, 42 bp, Artificial Sequence; identical to SEQ ID NO: 20145
  Description of Artificial Sequence: Synthetic oligonucleotide

SEQ ID NO: 22978 - protein, 14 aa, Artificial Sequence
  Description of Artificial Sequence: Synthetic peptide
ERYSSGLYDYGMDV

SEQ ID NO: 22979 - DNA, 24 bp, Artificial Sequence
  Description of Artificial Sequence: Synthetic oligonucleotide
gaactggggttcctctctgactac

SEQ ID NO: 22980 - protein, 8 aa, Artificial Sequence
  Description of Artificial Sequence: Synthetic peptide
ELGFLSDY

SEQ ID NO: 22981 - DNA, 21 bp, Artificial Sequence
  Description of Artificial Sequence: Synthetic oligonucleotide
gatagggggggtttggacgtc

SEQ ID NO: 22982 - protein, 7 aa, Artificial Sequence
  Description of Artificial Sequence: Synthetic peptide
DRGGLDV

SEQ ID NO: 22983 - DNA, 27 bp, Artificial Sequence
  Description of Artificial Sequence: Synthetic oligonucleotide
agcagtggctggtactactttgactac

SEQ ID NO: 22984 - protein, 9 aa, Artificial Sequence
  Description of Artificial Sequence: Synthetic peptide
SSGWYYFDY

SEQ ID NO: 22985 - DNA, 42 bp, Artificial Sequence
  Description of Artificial Sequence: Synthetic oligonucleotide
gaaccgtatagcagcagctggtacgactacggtatggacgtc

SEQ ID NO: 22986 - protein, 14 aa, Artificial Sequence
  Description of Artificial Sequence: Synthetic peptide
EPYSSSWYDYGMDV

SEQ ID NO: 22987 - DNA, 33 bp, Artificial Sequence; identical to SEQ ID NO: 22957
  Description of Artificial Sequence: Synthetic oligonucleotide

SEQ ID NO: 22988 - protein, 11 aa, Artificial Sequence
  Description of Artificial Sequence: Synthetic peptide
GYSYGYNWFDP

SEQ ID NO: 22989 - DNA, 27 bp, Artificial Sequence
  Description of Artificial Sequence: Synthetic oligonucleotide
gatcaacggtactacggtatggacgtc

SEQ ID NO: 22990 - protein, 9 aa, Artificial Sequence
  Description of Artificial Sequence: Synthetic peptide
DQRYYGMDV

SEQ ID NO: 22991 - DNA, 45 bp, Artificial Sequence
  Description of Artificial Sequence: Synthetic oligonucleotide
gggataagtggaaccggctcctactactactacggtgtggacgtc

SEQ ID NO: 22992 - protein, 15 aa, Artificial Sequence
  Description of Artificial Sequence: Synthetic peptide
GISGTGSYYYYGVDV

SEQ ID NO: 22993 - DNA, 33 bp, Artificial Sequence
  Description of Artificial Sequence: Synthetic oligonucleotide
gatcgaggtgtcggctacgacggtatggacgtc

SEQ ID NO: 22994 - protein, 11 aa, Artificial Sequence
  Description of Artificial Sequence: Synthetic peptide
DRGVGYDGMDV

SEQ ID NO: 22995 - DNA, 33 bp, Artificial Sequence
  Description of Artificial Sequence: Synthetic oligonucleotide
gatctggggatagggtattacggtatggacgtc

SEQ ID NO: 22996 - protein, 11 aa, Artificial Sequence
  Description of Artificial Sequence: Synthetic peptide
DLGIGYYGMDV

SEQ ID NO: 22997 - DNA, 18 bp, Artificial Sequence
  Description of Artificial Sequence: Synthetic oligonucleotide
gactacggggccgactac

SEQ ID NO: 22998 - protein, 6 aa, Artificial Sequence
  Description of Artificial Sequence: Synthetic peptide
DYGADY

SEQ ID NO: 22999 - DNA, 27 bp, Artificial Sequence
  Description of Artificial Sequence: Synthetic oligonucleotide
gtggggcagtggctggcttttgatatc

SEQ ID NO: 23000 - protein, 9 aa, Artificial Sequence
  Description of Artificial Sequence: Synthetic peptide
VGQWLAFDI

SEQ ID NO: 23001 - DNA, 33 bp, Artificial Sequence
  Description of Artificial Sequence: Synthetic oligonucleotide
gatagatcagttggctacgacggtacggacgtc

SEQ ID NO: 23002 - protein, 11 aa, Artificial Sequence
  Description of Artificial Sequence: Synthetic peptide
DRSVGYDGTDV

SEQ ID NO: 23003 - DNA, 27 bp, Artificial Sequence
  Description of Artificial Sequence: Synthetic oligonucleotide
gatcaacggtactacggtatggacgtc

SEQ ID NO: 23004 - protein, 9 aa, Artificial Sequence
  Description of Artificial Sequence: Synthetic peptide
DQRYYGMDV

SEQ ID NO: 23005 - DNA, 33 bp, Artificial Sequence
  Description of Artificial Sequence: Synthetic oligonucleotide
gatatggggatagggtattatggtatggacgtc

SEQ ID NO: 23006 - protein, 11 aa, Artificial Sequence
  Description of Artificial Sequence: Synthetic peptide
DMGIGYYGMDV

SEQ ID NO: 23007 - DNA, 21 bp, Artificial Sequence
  Description of Artificial Sequence: Synthetic oligonucleotide
gactacggtgtctttgactac

SEQ ID NO: 23008 - protein, 7 aa, Artificial Sequence
  Description of Artificial Sequence: Synthetic peptide
DYGVFDY

SEQ ID NO: 23009 - DNA, 39 bp, Artificial Sequence; identical to SEQ ID NO: 22959
  Description of Artificial Sequence: Synthetic oligonucleotide

SEQ ID NO: 23010 - protein, 13 aa, Artificial Sequence
  Description of Artificial Sequence: Synthetic peptide
GGARSSGWFHFDY

SEQ ID NO: 23011 - DNA, 36 bp, Artificial Sequence
  Description of Artificial Sequence: Synthetic oligonucleotide
gatgtgggtacagtgggagctacctactttgactgc

SEQ ID NO: 23012 - protein, 12 aa, Artificial Sequence
  Description of Artificial Sequence: Synthetic peptide
DVGTVGATYFDC

SEQ ID NO: 23013 - DNA, 18 bp, Artificial Sequence
  Description of Artificial Sequence: Synthetic oligonucleotide
gactacggggcggactac

SEQ ID NO: 23014 - protein, 6 aa, Artificial Sequence
  Description of Artificial Sequence: Synthetic peptide
DYGADY

SEQ ID NO: 23015 - DNA, 21 bp, Artificial Sequence
  Description of Artificial Sequence: Synthetic oligonucleotide
gactacggtgtccttgactac

SEQ ID NO: 23016 - protein, 7 aa, Artificial Sequence
  Description of Artificial Sequence: Synthetic peptide
DYGVLDY

SEQ ID NO: 23017 - DNA, 33 bp, Artificial Sequence; identical to SEQ ID NO: 22957
  Description of Artificial Sequence: Synthetic oligonucleotide

SEQ ID NO: 23018 - protein, 11 aa, Artificial Sequence
  Description of Artificial Sequence: Synthetic peptide
GYSYGYNWFDP

SEQ ID NO: 23019 - DNA, 33 bp, Artificial Sequence; identical to SEQ ID NO: 22953
  Description of Artificial Sequence: Synthetic oligonucleotide

SEQ ID NO: 23020 - protein, 11 aa, Artificial Sequence
  Description of Artificial Sequence: Synthetic peptide
DQGYNWNSFDY

SEQ ID NO: 23021 - DNA, 33 bp, Artificial Sequence; identical to SEQ ID NO: 22957
  Description of Artificial Sequence: Synthetic oligonucleotide

SEQ ID NO: 23022 - protein, 11 aa, Artificial Sequence
  Description of Artificial Sequence: Synthetic peptide
GYSYGYNWFDP

SEQ ID NO: 23023 - DNA, 33 bp, Artificial Sequence
  Description of Artificial Sequence: Synthetic oligonucleotide
gatgcgggtattggatactacggtatagacgtc

SEQ ID NO: 23024 - protein, 11 aa, Artificial Sequence
  Description of Artificial Sequence: Synthetic peptide
DAGIGYYGIDV

SEQ ID NO: 23025 - DNA, 24 bp, Artificial Sequence
  Description of Artificial Sequence: Synthetic oligonucleotide
gaactggggttcctctttgactac

SEQ ID NO: 23026 - protein, 8 aa, Artificial Sequence
  Description of Artificial Sequence: Synthetic peptide
ELGFLFDY

SEQ ID NO: 23027 - DNA, 42 bp, Artificial Sequence
  Description of Artificial Sequence: Synthetic oligonucleotide
gaacggtatagcagtggcttgtacgactacggtttggacgtc

SEQ ID NO: 23028 - protein, 14 aa, Artificial Sequence
  Description of Artificial Sequence: Synthetic peptide
ERYSSGLYDYGLDV

SEQ ID NO: 23029 - DNA, 39 bp, Artificial Sequence; identical to SEQ ID NO: 22959
  Description of Artificial Sequence: Synthetic oligonucleotide

SEQ ID NO: 23030 - protein, 13 aa, Artificial Sequence
  Description of Artificial Sequence: Synthetic peptide
GGARSSGWFHFDY

SEQ ID NO: 23031 - DNA, 21 bp, Artificial Sequence
  Description of Artificial Sequence: Synthetic oligonucleotide
gactatggtgtctttgattac

SEQ ID NO: 23032 - protein, 7 aa, Artificial Sequence
  Description of Artificial Sequence: Synthetic peptide
DYGVFDY

SEQ ID NO: 23033 - DNA, 33 bp, Artificial Sequence; identical to SEQ ID NO: 22957
  Description of Artificial Sequence: Synthetic oligonucleotide

SEQ ID NO: 23034 - protein, 11 aa, Artificial Sequence
  Description of Artificial Sequence: Synthetic peptide
GYSYGYNWFDP

SEQ ID NO: 23035 - DNA, 21 bp, Artificial Sequence
  Description of Artificial Sequence: Synthetic oligonucleotide
gactacggtgtccttgactac

SEQ ID NO: 23036 - protein, 7 aa, Artificial Sequence
  Description of Artificial Sequence: Synthetic peptide
DYGVLDY

SEQ ID NO: 23037 - DNA, 33 bp, Artificial Sequence; identical to SEQ ID NO: 22957
  Description of Artificial Sequence: Synthetic oligonucleotide

SEQ ID NO: 23038 - protein, 11 aa, Artificial Sequence
  Description of Artificial Sequence: Synthetic peptide
GYSYGYNWFDP

SEQ ID NO: 23039 - DNA, 24 bp, Artificial Sequence
  Description of Artificial Sequence: Synthetic oligonucleotide
gagacgggtttcttgagcgactac

SEQ ID NO: 23040 - protein, 8 aa, Artificial Sequence
  Description of Artificial Sequence: Synthetic peptide
ETGFLSDY

SEQ ID NO: 23041 - DNA, 42 bp, Artificial Sequence; identical to SEQ ID NO: 23027
  Description of Artificial Sequence: Synthetic oligonucleotide

SEQ ID NO: 23042 - protein, 14 aa, Artificial Sequence
  Description of Artificial Sequence: Synthetic peptide
ERYSSGLYDYGLDV

SEQ ID NO: 23043 - DNA, 21 bp, Artificial Sequence
  Description of Artificial Sequence: Synthetic oligonucleotide
gggttcggtgactgggactac

SEQ ID NO: 23044 - protein, 7 aa, Artificial Sequence
  Description of Artificial Sequence: Synthetic peptide
GFGDWDY

SEQ ID NO: 23045 - DNA, 27 bp, Artificial Sequence
  Description of Artificial Sequence: Synthetic oligonucleotide
gatcaacggtactacggtatggacgtc

SEQ ID NO: 23046 - protein, 9 aa, Artificial Sequence
  Description of Artificial Sequence: Synthetic peptide
DQRYYGMDV

SEQ ID NO: 23047 - DNA, 33 bp, Artificial Sequence; identical to SEQ ID NO: 22957
  Description of Artificial Sequence: Synthetic oligonucleotide

SEQ ID NO: 23048 - protein, 11 aa, Artificial Sequence
  Description of Artificial Sequence: Synthetic peptide
GYSYGYNWFDP

SEQ ID NO: 23049 - DNA, 39 bp, Artificial Sequence
  Description of Artificial Sequence: Synthetic oligonucleotide
gaccggctagtgggagctactaccgatgcttttgatatc

SEQ ID NO: 23050 - protein, 13 aa, Artificial Sequence
  Description of Artificial Sequence: Synthetic peptide
DRLVGATTDAFDI

SEQ ID NO: 23051 - DNA, 42 bp, Artificial Sequence
  Description of Artificial Sequence: Synthetic oligonucleotide
gatcctacggtgacccactactattactacggtatggacgtc

SEQ ID NO: 23052 - protein, 14 aa, Artificial Sequence
  Description of Artificial Sequence: Synthetic peptide
DPTVTHYYYYGMDV

SEQ ID NO: 23053 - DNA, 33 bp, Artificial Sequence
  Description of Artificial Sequence: Synthetic oligonucleotide
gatcggggagtgggctactacggtacggacgtc

SEQ ID NO: 23054 - protein, 11 aa, Artificial Sequence
  Description of Artificial Sequence: Synthetic peptide
DRGVGYYGTDV

SEQ ID NO: 23055 - DNA, 33 bp, Artificial Sequence
  Description of Artificial Sequence: Synthetic oligonucleotide
gatgggagttatggttacgacggtatggacgtc

SEQ ID NO: 23056 - protein, 11 aa, Artificial Sequence
  Description of Artificial Sequence: Synthetic peptide
DGSYGYDGMDV

SEQ ID NO: 23057 - DNA, 33 bp, Artificial Sequence
  Description of Artificial Sequence: Synthetic oligonucleotide
ttagactacagtaactacgggtggttcgacccc

SEQ ID NO: 23058 - protein, 11 aa, Artificial Sequence
  Description of Artificial Sequence: Synthetic peptide
LDYSNYGWFDP

SEQ ID NO: 23059 - DNA, 33 bp, Artificial Sequence
  Description of Artificial Sequence: Synthetic oligonucleotide
gataggacggtgggctatgatggttttgatatc

SEQ ID NO: 23060 - protein, 11 aa, Artificial Sequence
  Description of Artificial Sequence: Synthetic peptide
DRTVGYDGFDI

SEQ ID NO: 23061 - DNA, 33 bp, Artificial Sequence
  Description of Artificial Sequence: Synthetic oligonucleotide
gaccacggtgtcgggtactacggtatggacgtc

SEQ ID NO: 23062 - protein, 11 aa, Artificial Sequence
  Description of Artificial Sequence: Synthetic peptide
DHGVGYYGMDV

SEQ ID NO: 23063 - DNA, 42 bp, Artificial Sequence
  Description of Artificial Sequence: Synthetic oligonucleotide
gatcctacggtgacccactactactactacggtatggacgtc

SEQ ID NO: 23064 - protein, 14 aa, Artificial Sequence
  Description of Artificial Sequence: Synthetic peptide
DPTVTHYYYYGMDV

SEQ ID NO: 23065 - DNA, 33 bp, Artificial Sequence
  Description of Artificial Sequence: Synthetic oligonucleotide
gactacggtgtcgggtactacggtacggacgtc

SEQ ID NO: 23066 - protein, 11 aa, Artificial Sequence
  Description of Artificial Sequence: Synthetic peptide
DYGVGYYGTDV

SEQ ID NO: 23067 - DNA, 33 bp, Artificial Sequence; identical to SEQ ID NO: 23065
  Description of Artificial Sequence: Synthetic oligonucleotide

SEQ ID NO: 23068 - protein, 11 aa, Artificial Sequence
  Description of Artificial Sequence: Synthetic peptide
DYGVGYYGTDV

SEQ ID NO: 23069 - DNA, 33 bp, Artificial Sequence; identical to SEQ ID NO: 23061
  Description of Artificial Sequence: Synthetic oligonucleotide

SEQ ID NO: 23070 - protein, 11 aa, Artificial Sequence
  Description of Artificial Sequence: Synthetic peptide
DHGVGYYGMDV

SEQ ID NO: 23071 - DNA, 36 bp, Artificial Sequence
  Description of Artificial Sequence: Synthetic oligonucleotide
gatcggagtatagtgggagctacctactttgactac

SEQ ID NO: 23072 - protein, 12 aa, Artificial Sequence
  Description of Artificial Sequence: Synthetic peptide
DRSIVGATYFDY

SEQ ID NO: 23073 - DNA, 33 bp, Artificial Sequence
  Description of Artificial Sequence: Synthetic oligonucleotide
gatcggggagtgggctacaacggtatggacgtc

SEQ ID NO: 23074 - protein, 11 aa, Artificial Sequence
  Description of Artificial Sequence: Synthetic peptide
DRGVGYNGMDV

SEQ ID NO: 23075 - DNA, 42 bp, Artificial Sequence
  Description of Artificial Sequence: Synthetic oligonucleotide
gaacgttatagcagtggctggtacgactacggtatggacgtc

SEQ ID NO: 23076 - protein, 14 aa, Artificial Sequence
  Description of Artificial Sequence: Synthetic peptide
ERYSSGWYDYGMDV

SEQ ID NO: 23077 - DNA, 33 bp, Artificial Sequence; identical to SEQ ID NO: 23055
  Description of Artificial Sequence: Synthetic oligonucleotide

SEQ ID NO: 23078 - protein, 11 aa, Artificial Sequence
  Description of Artificial Sequence: Synthetic peptide
DGSYGYDGMDV

SEQ ID NO: 23079 - DNA, 33 bp, Artificial Sequence; identical to SEQ ID NO: 23065
  Description of Artificial Sequence: Synthetic oligonucleotide

SEQ ID NO: 23080 - protein, 11 aa, Artificial Sequence
  Description of Artificial Sequence: Synthetic peptide
DYGVGYYGTDV

SEQ ID NO: 23081 - DNA, 33 bp, Artificial Sequence; identical to SEQ ID NO: 23059
  Description of Artificial Sequence: Synthetic oligonucleotide

SEQ ID NO: 23082 - protein, 11 aa, Artificial Sequence
  Description of Artificial Sequence: Synthetic peptide
DRTVGYDGFDI

SEQ ID NO: 23083 - DNA, 33 bp, Artificial Sequence
  Description of Artificial Sequence: Synthetic oligonucleotide
gactacggtgtcgggtacgacggtatggacgtc

SEQ ID NO: 23084 - protein, 11 aa, Artificial Sequence
  Description of Artificial Sequence: Synthetic peptide
DYGVGYDGMDV

SEQ ID NO: 23085 - DNA, 33 bp, Artificial Sequence; identical to SEQ ID NO: 23055
  Description of Artificial Sequence: Synthetic oligonucleotide

SEQ ID NO: 23086 - protein, 11 aa, Artificial Sequence
  Description of Artificial Sequence: Synthetic peptide
DGSYGYDGMDV

SEQ ID NO: 23087 - DNA, 33 bp, Artificial Sequence; identical to SEQ ID NO: 23065
  Description of Artificial Sequence: Synthetic oligonucleotide

SEQ ID NO: 23088 - protein, 11 aa, Artificial Sequence
  Description of Artificial Sequence: Synthetic peptide
DYGVGYYGTDV

SEQ ID NO: 23089 - DNA, 27 bp, Artificial Sequence
  Description of Artificial Sequence: Synthetic oligonucleotide
gaaaagcctgggagctactacaaatac

SEQ ID NO: 23090 - protein, 9 aa, Artificial Sequence
  Description of Artificial Sequence: Synthetic peptide
EKPGSYYKY

SEQ ID NO: 23091 - DNA, 24 bp, Artificial Sequence
  Description of Artificial Sequence: Synthetic oligonucleotide
gactactactacggtatggacgtc

SEQ ID NO: 23092 - protein, 8 aa, Artificial Sequence
  Description of Artificial Sequence: Synthetic peptide
DYYYGMDV

SEQ ID NO: 23093 - DNA, 33 bp, Artificial Sequence
  Description of Artificial Sequence: Synthetic oligonucleotide
gatcggggagtgggctacgacggaatggacgtc

SEQ ID NO: 23094 - protein, 11 aa, Artificial Sequence
  Description of Artificial Sequence: Synthetic peptide
DRGVGYDGMDV

SEQ ID NO: 23095 - DNA, 33 bp, Artificial Sequence
  Description of Artificial Sequence: Synthetic oligonucleotide
gataggacggtgggctatgatggttgtgatatc

SEQ ID NO: 23096 - protein, 11 aa, Artificial Sequence
  Description of Artificial Sequence: Synthetic peptide
DRTVGYDGCDI

SEQ ID NO: 23097 - DNA, 39 bp, Artificial Sequence
  Description of Artificial Sequence: Synthetic oligonucleotide
gacgggagatacagctatggttacgactggttcgacccc

SEQ ID NO: 23098 - protein, 13 aa, Artificial Sequence
  Description of Artificial Sequence: Synthetic peptide
DGRYSYGYDWFDP

SEQ ID NO: 23099 - DNA, 33 bp, Artificial Sequence; identical to SEQ ID NO: 23065
  Description of Artificial Sequence: Synthetic oligonucleotide

SEQ ID NO: 23100 - protein, 11 aa, Artificial Sequence
  Description of Artificial Sequence: Synthetic peptide
DYGVGYYGTDV

SEQ ID NO: 23101 - DNA, 42 bp, Artificial Sequence
  Description of Artificial Sequence: Synthetic oligonucleotide
gagaggtataccagcagctggtacgactacggtatggacgtc

SEQ ID NO: 23102 - protein, 14 aa, Artificial Sequence
  Description of Artificial Sequence: Synthetic peptide
ERYTSSWYDYGMDV

SEQ ID NO: 23103 - DNA, 42 bp, Artificial Sequence; identical to SEQ ID NO: 23075
  Description of Artificial Sequence: Synthetic oligonucleotide

SEQ ID NO: 23104 - protein, 14 aa, Artificial Sequence
  Description of Artificial Sequence: Synthetic peptide
ERYSSGWYDYGMDV

SEQ ID NO: 23105 - DNA, 42 bp, Artificial Sequence; identical to SEQ ID NO: 23075
  Description of Artificial Sequence: Synthetic oligonucleotide

SEQ ID NO: 23106 - protein, 14 aa, Artificial Sequence
  Description of Artificial Sequence: Synthetic peptide
ERYSSGWYDYGMDV

SEQ ID NO: 23107 - DNA, 42 bp, Artificial Sequence; identical to SEQ ID NO: 23075
  Description of Artificial Sequence: Synthetic oligonucleotide

SEQ ID NO: 23108 - protein, 14 aa, Artificial Sequence
  Description of Artificial Sequence: Synthetic peptide
ERYSSGWYDYGMDV

SEQ ID NO: 23109 - DNA, 33 bp, Artificial Sequence; identical to SEQ ID NO: 23065
  Description of Artificial Sequence: Synthetic oligonucleotide

SEQ ID NO: 23110 - protein, 11 aa, Artificial Sequence
  Description of Artificial Sequence: Synthetic peptide
DYGVGYYGTDV

SEQ ID NO: 23111 - DNA, 33 bp, Artificial Sequence
  Description of Artificial Sequence: Synthetic oligonucleotide
gactgcggtgtcggatactacggtacggacgtc

SEQ ID NO: 23112 - protein, 11 aa, Artificial Sequence
  Description of Artificial Sequence: Synthetic peptide
DCGVGYYGTDV

SEQ ID NO: 23113 - DNA, 39 bp, Artificial Sequence
  Description of Artificial Sequence: Synthetic oligonucleotide
gacgggagatacagctatggtcacgactggttcgacccc

SEQ ID NO: 23114 - protein, 13 aa, Artificial Sequence
  Description of Artificial Sequence: Synthetic peptide
DGRYSYGHDWFDP

SEQ ID NO: 23115 - DNA, 33 bp, Artificial Sequence
  Description of Artificial Sequence: Synthetic oligonucleotide
ttagactacagtaattacgggtggttcgacccc

SEQ ID NO: 23116 - protein, 11 aa, Artificial Sequence
  Description of Artificial Sequence: Synthetic peptide
LDYSNYGWFDP

SEQ ID NO: 23117 - DNA, 42 bp, Artificial Sequence; identical to SEQ ID NO: 23075
  Description of Artificial Sequence: Synthetic oligonucleotide

SEQ ID NO: 23118 - protein, 14 aa, Artificial Sequence
  Description of Artificial Sequence: Synthetic peptide
ERYSSGWYDYGMDV

SEQ ID NO: 23119 - DNA, 33 bp, Artificial Sequence
  Description of Artificial Sequence: Synthetic oligonucleotide
gatcggggagtgggctactacggtatggacgtc

SEQ ID NO: 23120 - protein, 11 aa, Artificial Sequence
  Description of Artificial Sequence: Synthetic peptide
DRGVGYYGMDV

SEQ ID NO: 23121 - DNA, 33 bp, Artificial Sequence; identical to SEQ ID NO: 23057
  Description of Artificial Sequence: Synthetic oligonucleotide

SEQ ID NO: 23122 - protein, 11 aa, Artificial Sequence
  Description of Artificial Sequence: Synthetic peptide
LDYSNYGWFDP

SEQ ID NO: 23123 - DNA, 36 bp, Artificial Sequence
  Description of Artificial Sequence: Synthetic oligonucleotide
gatcccaacatagtgggagctacttggtttgactac

SEQ ID NO: 23124 - protein, 12 aa, Artificial Sequence
  Description of Artificial Sequence: Synthetic peptide
DPNIVGATWFDY

SEQ ID NO: 23125 - DNA, 24 bp, Artificial Sequence
  Description of Artificial Sequence: Synthetic oligonucleotide
tcgggtttagcagtggaggactac

SEQ ID NO: 23126 - protein, 8 aa, Artificial Sequence
  Description of Artificial Sequence: Synthetic peptide
SGLAVEDY

SEQ ID NO: 23127 - DNA, 42 bp, Artificial Sequence; identical to SEQ ID NO: 23075
  Description of Artificial Sequence: Synthetic oligonucleotide

SEQ ID NO: 23128 - protein, 14 aa, Artificial Sequence
  Description of Artificial Sequence: Synthetic peptide
ERYSSGWYDYGMDV

SEQ ID NO: 23129 - DNA, 42 bp, Artificial Sequence; identical to SEQ ID NO: 23075
  Description of Artificial Sequence: Synthetic oligonucleotide

SEQ ID NO: 23130 - protein, 14 aa, Artificial Sequence
  Description of Artificial Sequence: Synthetic peptide
ERYSSGWYDYGMDV

SEQ ID NO: 23131 - DNA, 42 bp, Artificial Sequence
  Description of Artificial Sequence: Synthetic oligonucleotide
gatggctcttatagcagtggctggtactggggttttgactac

SEQ ID NO: 23132 - protein, 14 aa, Artificial Sequence
  Description of Artificial Sequence: Synthetic peptide
DGSYSSGWYWGFDY

SEQ ID NO: 23133 - DNA, 42 bp, Artificial Sequence; identical to SEQ ID NO: 23075
  Description of Artificial Sequence: Synthetic oligonucleotide

SEQ ID NO: 23134 - protein, 14 aa, Artificial Sequence
  Description of Artificial Sequence: Synthetic peptide
ERYSSGWYDYGMDV

SEQ ID NO: 23135 - DNA, 33 bp, Artificial Sequence
  Description of Artificial Sequence: Synthetic oligonucleotide
gactacggtgtcgggtactacggtctggacgtc

SEQ ID NO: 23136 - protein, 11 aa, Artificial Sequence
  Description of Artificial Sequence: Synthetic peptide
DYGVGYYGLDV

SEQ ID NO: 23137 - DNA, 33 bp, Artificial Sequence; identical to SEQ ID NO: 23055
  Description of Artificial Sequence: Synthetic oligonucleotide

SEQ ID NO: 23138 - protein, 11 aa, Artificial Sequence
  Description of Artificial Sequence: Synthetic peptide
DGSYGYDGMDV

SEQ ID NO: 23139 - DNA, 42 bp, Artificial Sequence; identical to SEQ ID NO: 23075
  Description of Artificial Sequence: Synthetic oligonucleotide

SEQ ID NO: 23140 - protein, 14 aa, Artificial Sequence
  Description of Artificial Sequence: Synthetic peptide
ERYSSGWYDYGMDV

SEQ ID NO: 23141 - DNA, 42 bp, Artificial Sequence; identical to SEQ ID NO: 23075
  Description of Artificial Sequence: Synthetic oligonucleotide

SEQ ID NO: 23142 - protein, 14 aa, Artificial Sequence
  Description of Artificial Sequence: Synthetic peptide
ERYSSGWYDYGMDV

SEQ ID NO: 23143 - DNA, 42 bp, Artificial Sequence; identical to SEQ ID NO: 23075
  Description of Artificial Sequence: Synthetic oligonucleotide

SEQ ID NO: 23144 - protein, 14 aa, Artificial Sequence
  Description of Artificial Sequence: Synthetic peptide
ERYSSGWYDYGMDV

SEQ ID NO: 23145 - DNA, 33 bp, Artificial Sequence; identical to SEQ ID NO: 23073
  Description of Artificial Sequence: Synthetic oligonucleotide

SEQ ID NO: 23146 - protein, 11 aa, Artificial Sequence
  Description of Artificial Sequence: Synthetic peptide
DRGVGYNGMDV

SEQ ID NO: 23147 - DNA, 54 bp, Artificial Sequence
  Description of Artificial Sequence: Synthetic oligonucleotide
gaccagcagtggctggtacgtgggagggacaactactactacggtatggacgtc

SEQ ID NO: 23148 - protein, 18 aa, Artificial Sequence
  Description of Artificial Sequence: Synthetic peptide
DQQWLVRGRDNYYYGMDV

SEQ ID NO: 23149 - DNA, 42 bp, Artificial Sequence; identical to SEQ ID NO: 23075
  Description of Artificial Sequence: Synthetic oligonucleotide

SEQ ID NO: 23150 - protein, 14 aa, Artificial Sequence
  Description of Artificial Sequence: Synthetic peptide
ERYSSGWYDYGMDV

SEQ ID NO: 23151 - DNA, 24 bp, Artificial Sequence
  Description of Artificial Sequence: Synthetic oligonucleotide
gatgggaccagctcgtttgactac

SEQ ID NO: 23152 - protein, 8 aa, Artificial Sequence
  Description of Artificial Sequence: Synthetic peptide
DGTSSFDY

SEQ ID NO: 23153 - DNA, 33 bp, Artificial Sequence
  Description of Artificial Sequence: Synthetic oligonucleotide
gatcggacagtgggctacaacggtatggacgtc

SEQ ID NO: 23154 - protein, 11 aa, Artificial Sequence
  Description of Artificial Sequence: Synthetic peptide
DRTVGYNGMDV

SEQ ID NO: 23155 - DNA, 24 bp, Artificial Sequence
  Description of Artificial Sequence: Synthetic oligonucleotide
gatgggaccagctcgtttgactac

SEQ ID NO: 23156 - protein, 8 aa, Artificial Sequence
  Description of Artificial Sequence: Synthetic peptide
DGTSSFDY

SEQ ID NO: 23157 - DNA, 24 bp, Artificial Sequence
  Description of Artificial Sequence: Synthetic oligonucleotide
gactactactacggttttgacgtc

SEQ ID NO: 23158 - protein, 8 aa, Artificial Sequence
  Description of Artificial Sequence: Synthetic peptide
DYYYGFDV

SEQ ID NO: 23159 - DNA, 33 bp, Artificial Sequence
  Description of Artificial Sequence: Synthetic oligonucleotide
gatcgggatgtcgggtacaacggtatggacgtc

SEQ ID NO: 23160 - protein, 11 aa, Artificial Sequence
  Description of Artificial Sequence: Synthetic peptide
DRDVGYNGMDV

SEQ ID NO: 23161 - DNA, 39 bp, Artificial Sequence
  Description of Artificial Sequence: Synthetic oligonucleotide
gacccttatcgtgtagcagtggctggggcctttgactac

SEQ ID NO: 23162 - protein, 13 aa, Artificial Sequence
  Description of Artificial Sequence: Synthetic peptide
DPYRVAVAGAFDY

SEQ ID NO: 23163 - DNA, 21 bp, Artificial Sequence
  Description of Artificial Sequence: Synthetic oligonucleotide
gactacggcgcccttgatttc

SEQ ID NO: 23164 - protein, 7 aa, Artificial Sequence
  Description of Artificial Sequence: Synthetic peptide
DYGALDF

SEQ ID NO: 23165 - DNA, 24 bp, Artificial Sequence
  Description of Artificial Sequence: Synthetic oligonucleotide
gatgggaccagctcgtttgactac

SEQ ID NO: 23166 - protein, 8 aa, Artificial Sequence
  Description of Artificial Sequence: Synthetic peptide
DGTSSFDY

SEQ ID NO: 23167 - DNA, 39 bp, Artificial Sequence; identical to SEQ ID NO: 23161
  Description of Artificial Sequence: Synthetic oligonucleotide

SEQ ID NO: 23168 - protein, 13 aa, Artificial Sequence
  Description of Artificial Sequence: Synthetic peptide
DPYRVAVAGAFDY

SEQ ID NO: 23169 - DNA, 33 bp, Artificial Sequence; identical to SEQ ID NO: 23159
  Description of Artificial Sequence: Synthetic oligonucleotide

SEQ ID NO: 23170 - protein, 11 aa, Artificial Sequence
  Description of Artificial Sequence: Synthetic peptide
DRDVGYNGMDV

SEQ ID NO: 23171 - DNA, 24 bp, Artificial Sequence
  Description of Artificial Sequence: Synthetic oligonucleotide
gatgggaccagctcgtttgactac

SEQ ID NO: 23172 - protein, 8 aa, Artificial Sequence
  Description of Artificial Sequence: Synthetic peptide
DGTSSFDY

SEQ ID NO: 23173 - DNA, 24 bp, Artificial Sequence
  Description of Artificial Sequence: Synthetic oligonucleotide
gactactactacggtatggacgtc

SEQ ID NO: 23174 - protein, 8 aa, Artificial Sequence
  Description of Artificial Sequence: Synthetic peptide
DYYYGMDV

SEQ ID NO: 23175 - DNA, 33 bp, Artificial Sequence; identical to SEQ ID NO: 23159
  Description of Artificial Sequence: Synthetic oligonucleotide

SEQ ID NO: 23176 - protein, 11 aa, Artificial Sequence
  Description of Artificial Sequence: Synthetic peptide
DRDVGYNGMDV

SEQ ID NO: 23177 - DNA, 42 bp, Artificial Sequence
  Description of Artificial Sequence: Synthetic oligonucleotide
ggctcctacgatagtagtggttattaccactacttagaccac

SEQ ID NO: 23178 - protein, 14 aa, Artificial Sequence
  Description of Artificial Sequence: Synthetic peptide
GSYDSSGYYHYLDH

SEQ ID NO: 23179 - DNA, 36 bp, Artificial Sequence
  Description of Artificial Sequence: Synthetic oligonucleotide
gaggggggctactactattactacggtgtggacgtc

SEQ ID NO: 23180 - protein, 12 aa, Artificial Sequence
  Description of Artificial Sequence: Synthetic peptide
EGGYYYYYGVDV

SEQ ID NO: 23181 - DNA, 42 bp, Artificial Sequence
  Description of Artificial Sequence: Synthetic oligonucleotide
gagaggtatagcagcaactggtacgactacggtatggacgtc

SEQ ID NO: 23182 - protein, 14 aa, Artificial Sequence
  Description of Artificial Sequence: Synthetic peptide
ERYSSNWYDYGMDV

SEQ ID NO: 23183 - DNA, 42 bp, Artificial Sequence
  Description of Artificial Sequence: Synthetic oligonucleotide
gattggggtggctacagttcttactactacggtatggacgtc

SEQ ID NO: 23184 - protein, 14 aa, Artificial Sequence
  Description of Artificial Sequence: Synthetic peptide
DWGGYSSYYYGMDV

SEQ ID NO: 23185 - DNA, 27 bp, Artificial Sequence
  Description of Artificial Sequence: Synthetic oligonucleotide
cagggtcgggactggggtgttgactac

SEQ ID NO: 23186 - protein, 9 aa, Artificial Sequence
  Description of Artificial Sequence: Synthetic peptide
QGRDWGVDY

SEQ ID NO: 23187 - DNA, 42 bp, Artificial Sequence; identical to SEQ ID NO: 20499
  Description of Artificial Sequence: Synthetic oligonucleotide

SEQ ID NO: 23188 - protein, 14 aa, Artificial Sequence
  Description of Artificial Sequence: Synthetic peptide
ERYSSSWYDYGMDV

SEQ ID NO: 23189 - DNA, 27 bp, Artificial Sequence
  Description of Artificial Sequence: Synthetic oligonucleotide
tccagtggctggaactggttcgacccc

SEQ ID NO: 23190 - protein, 9 aa, Artificial Sequence
  Description of Artificial Sequence: Synthetic peptide
SSGWNWFDP

SEQ ID NO: 23191 - DNA, 36 bp, Artificial Sequence
  Description of Artificial Sequence: Synthetic oligonucleotide
gtctatagtgcctacgattctcactggttcgacccc

SEQ ID NO: 23192 - protein, 12 aa, Artificial Sequence
  Description of Artificial Sequence: Synthetic peptide
VYSAYDSHWFDP

SEQ ID NO: 23193 - DNA, 42 bp, Artificial Sequence; identical to SEQ ID NO: 23183
  Description of Artificial Sequence: Synthetic oligonucleotide

SEQ ID NO: 23194 - protein, 14 aa, Artificial Sequence
  Description of Artificial Sequence: Synthetic peptide
DWGGYSSYYYGMDV

SEQ ID NO: 23195 - DNA, 27 bp, Artificial Sequence
  Description of Artificial Sequence: Synthetic oligonucleotide
agcagtggctggtactactttgactac

SEQ ID NO: 23196 - protein, 9 aa, Artificial Sequence
  Description of Artificial Sequence: Synthetic peptide
SSGWYYFDY

SEQ ID NO: 23197 - DNA, 27 bp, Artificial Sequence
  Description of Artificial Sequence: Synthetic oligonucleotide
agcagtggctggtacaagtttgactac

SEQ ID NO: 23198 - protein, 9 aa, Artificial Sequence
  Description of Artificial Sequence: Synthetic peptide
SSGWYKFDY

SEQ ID NO: 23199 - DNA, 24 bp, Artificial Sequence
  Description of Artificial Sequence: Synthetic oligonucleotide
gagctaggcttccagtctgactac

SEQ ID NO: 23200 - protein, 8 aa, Artificial Sequence
  Description of Artificial Sequence: Synthetic peptide
ELGFQSDY

SEQ ID NO: 23201 - DNA, 42 bp, Artificial Sequence
  Description of Artificial Sequence: Synthetic oligonucleotide
gattggggtggctacagttcttactacttcggtatggacgtc

SEQ ID NO: 23202 - protein, 14 aa, Artificial Sequence
  Description of Artificial Sequence: Synthetic peptide
DWGGYSSYYFGMDV

SEQ ID NO: 23203 - DNA, 27 bp, Artificial Sequence
  Description of Artificial Sequence: Synthetic oligonucleotide
agcagtggctggtacaagtttgactac

SEQ ID NO: 23204 - protein, 9 aa, Artificial Sequence
  Description of Artificial Sequence: Synthetic peptide
SSGWYKFDY

SEQ ID NO: 23205 - DNA, 42 bp, Artificial Sequence; identical to SEQ ID NO: 23183
  Description of Artificial Sequence: Synthetic oligonucleotide

SEQ ID NO: 23206 - protein, 14 aa, Artificial Sequence
  Description of Artificial Sequence: Synthetic peptide
DWGGYSSYYYGMDV

SEQ ID NO: 23207 - DNA, 42 bp, Artificial Sequence; identical to SEQ ID NO: 21211
  Description of Artificial Sequence: Synthetic oligonucleotide

SEQ ID NO: 23208 - protein, 14 aa, Artificial Sequence
  Description of Artificial Sequence: Synthetic peptide
ERYSSGWYDYGMDV

SEQ ID NO: 23209 - DNA, 45 bp, Artificial Sequence
  Description of Artificial Sequence: Synthetic oligonucleotide
gatttagcagctcgttcttactactactacttcggtatggacgtc

SEQ ID NO: 23210 - protein, 15 aa, Artificial Sequence
  Description of Artificial Sequence: Synthetic peptide
DLAARSYYYYFGMDV

SEQ ID NO: 23211 - DNA, 27 bp, Artificial Sequence
  Description of Artificial Sequence: Synthetic oligonucleotide
agcagtggctggtactggttcgacccc

SEQ ID NO: 23212 - protein, 9 aa, Artificial Sequence
  Description of Artificial Sequence: Synthetic peptide
SSGWYWFDP

SEQ ID NO: 23213 - DNA, 42 bp, Artificial Sequence; identical to SEQ ID NO: 23183
  Description of Artificial Sequence: Synthetic oligonucleotide

SEQ ID NO: 23214 - protein, 14 aa, Artificial Sequence
  Description of Artificial Sequence: Synthetic peptide
DWGGYSSYYYGMDV

SEQ ID NO: 23215 - DNA, 27 bp, Artificial Sequence
  Description of Artificial Sequence: Synthetic oligonucleotide
agcagtggctggtaccgctttgactac

SEQ ID NO: 23216 - protein, 9 aa, Artificial Sequence
  Description of Artificial Sequence: Synthetic peptide
SSGWYRFDY

SEQ ID NO: 23217 - DNA, 24 bp, Artificial Sequence
  Description of Artificial Sequence: Synthetic oligonucleotide
gaagtgggattcactgaggactac

SEQ ID NO: 23218 - protein, 8 aa, Artificial Sequence
  Description of Artificial Sequence: Synthetic peptide
EVGFTEDY

SEQ ID NO: 23219 - DNA, 24 bp, Artificial Sequence
  Description of Artificial Sequence: Synthetic oligonucleotide
gaagtgggattcactgaggactac

SEQ ID NO: 23220 - protein, 8 aa, Artificial Sequence
  Description of Artificial Sequence: Synthetic peptide
EVGFTEDY

SEQ ID NO: 23221 - DNA, 36 bp, Artificial Sequence
  Description of Artificial Sequence: Synthetic oligonucleotide
gaggccggtgactacggctactacggtatggacgtc

SEQ ID NO: 23222 - protein, 12 aa, Artificial Sequence
  Description of Artificial Sequence: Synthetic peptide
EAGDYGYYGMDV

SEQ ID NO: 23223 - DNA, 24 bp, Artificial Sequence
  Description of Artificial Sequence: Synthetic oligonucleotide
gaagtgggatttactgaggactac

SEQ ID NO: 23224 - protein, 8 aa, Artificial Sequence
  Description of Artificial Sequence: Synthetic peptide
EVGFTEDY

SEQ ID NO: 23225 - DNA, 27 bp, Artificial Sequence
  Description of Artificial Sequence: Synthetic oligonucleotide
agcagtggctggaccctttttgactac

SEQ ID NO: 23226 - protein, 9 aa, Artificial Sequence
  Description of Artificial Sequence: Synthetic peptide
SSGWTLFDY

SEQ ID NO: 23227 - DNA, 27 bp, Artificial Sequence
  Description of Artificial Sequence: Synthetic oligonucleotide
agcagtggctggtaccgctttgactac

SEQ ID NO: 23228 - protein, 9 aa, Artificial Sequence
  Description of Artificial Sequence: Synthetic peptide
SSGWYRFDY

SEQ ID NO: 23229 - DNA, 27 bp, Artificial Sequence
  Description of Artificial Sequence: Synthetic oligonucleotide
agcagtggctggtacaagtttgactac

SEQ ID NO: 23230 - protein, 9 aa, Artificial Sequence
  Description of Artificial Sequence: Synthetic peptide
SSGWYKFDY

SEQ ID NO: 23231 - DNA, 27 bp, Artificial Sequence
  Description of Artificial Sequence: Synthetic oligonucleotide
agcagtggctggtacaagtttgactac

SEQ ID NO: 23232 - protein, 9 aa, Artificial Sequence
  Description of Artificial Sequence: Synthetic peptide
SSGWYKFDY

SEQ ID NO: 23233 - DNA, 36 bp, Artificial Sequence
  Description of Artificial Sequence: Synthetic oligonucleotide
gatcactacgatttttggagtggttatcttacccac

SEQ ID NO: 23234 - protein, 12 aa, Artificial Sequence
  Description of Artificial Sequence: Synthetic peptide
DHYDFWSGYLTH

SEQ ID NO: 23235 - DNA, 36 bp, Artificial Sequence
  Description of Artificial Sequence: Synthetic oligonucleotide
gagggtcacgatttttggagtggctttttttgttac

SEQ ID NO: 23236 - protein, 12 aa, Artificial Sequence
  Description of Artificial Sequence: Synthetic peptide
EGHDFWSGFFCY

SEQ ID NO: 23237 - DNA, 42 bp, Artificial Sequence; identical to SEQ ID NO: 20499
  Description of Artificial Sequence: Synthetic oligonucleotide

SEQ ID NO: 23238 - protein, 14 aa, Artificial Sequence
  Description of Artificial Sequence: Synthetic peptide
ERYSSSWYDYGMDV

SEQ ID NO: 23239 - DNA, 27 bp, Artificial Sequence
  Description of Artificial Sequence: Synthetic oligonucleotide
agcagtggctggtacaagtttgactac

SEQ ID NO: 23240 - protein, 9 aa, Artificial Sequence
  Description of Artificial Sequence: Synthetic peptide
SSGWYKFDY

SEQ ID NO: 23241 - DNA, 27 bp, Artificial Sequence
  Description of Artificial Sequence: Synthetic oligonucleotide
agcagtggctggtaccgctttgactac

SEQ ID NO: 23242 - protein, 9 aa, Artificial Sequence
  Description of Artificial Sequence: Synthetic peptide
SSGWYRFDY

SEQ ID NO: 23243 - DNA, 36 bp, Artificial Sequence
  Description of Artificial Sequence: Synthetic oligonucleotide
gagaattacgatttttggagtggttattatggctac

SEQ ID NO: 23244 - protein, 12 aa, Artificial Sequence
  Description of Artificial Sequence: Synthetic peptide
ENYDFWSGYYGY

SEQ ID NO: 23245 - DNA, 42 bp, Artificial Sequence
  Description of Artificial Sequence: Synthetic oligonucleotide
gagaggtataacagcggctggtacgactacggtttggacgtc

SEQ ID NO: 23246 - protein, 14 aa, Artificial Sequence
  Description of Artificial Sequence: Synthetic peptide
ERYNSGWYDYGLDV

SEQ ID NO: 23247 - DNA, 42 bp, Artificial Sequence; identical to SEQ ID NO: 23183
  Description of Artificial Sequence: Synthetic oligonucleotide

SEQ ID NO: 23248 - protein, 14 aa, Artificial Sequence
  Description of Artificial Sequence: Synthetic peptide
DWGGYSSYYYGMDV

SEQ ID NO: 23249 - DNA, 24 bp, Artificial Sequence
  Description of Artificial Sequence: Synthetic oligonucleotide
gaagtgggattcactgaggactac

SEQ ID NO: 23250 - protein, 8 aa, Artificial Sequence
  Description of Artificial Sequence: Synthetic peptide
EVGFTEDY

SEQ ID NO: 23251 - DNA, 42 bp, Artificial Sequence; identical to SEQ ID NO: 23183
  Description of Artificial Sequence: Synthetic oligonucleotide

SEQ ID NO: 23252 - protein, 14 aa, Artificial Sequence
  Description of Artificial Sequence: Synthetic peptide
DWGGYSSYYYGMDV

SEQ ID NO: 23253 - DNA, 42 bp, Artificial Sequence; identical to SEQ ID NO: 23183
  Description of Artificial Sequence: Synthetic oligonucleotide

SEQ ID NO: 23254 - protein, 14 aa, Artificial Sequence
  Description of Artificial Sequence: Synthetic peptide
DWGGYSSYYYGMDV

SEQ ID NO: 23255 - DNA, 42 bp, Artificial Sequence; identical to SEQ ID NO: 23183
  Description of Artificial Sequence: Synthetic oligonucleotide

SEQ ID NO: 23256 - protein, 14 aa, Artificial Sequence
  Description of Artificial Sequence: Synthetic peptide
DWGGYSSYYYGMDV

SEQ ID NO: 23257 - DNA, 27 bp, Artificial Sequence
  Description of Artificial Sequence: Synthetic oligonucleotide
agcagtggctggtactactttgactac

SEQ ID NO: 23258 - protein, 9 aa, Artificial Sequence
  Description of Artificial Sequence: Synthetic peptide
SSGWYYFDY

SEQ ID NO: 23259 - DNA, 42 bp, Artificial Sequence; identical to SEQ ID NO: 23183
  Description of Artificial Sequence: Synthetic oligonucleotide

SEQ ID NO: 23260 - protein, 14 aa, Artificial Sequence
  Description of Artificial Sequence: Synthetic peptide
DWGGYSSYYYGMDV

SEQ ID NO: 23261 - DNA, 42 bp, Artificial Sequence
  Description of Artificial Sequence: Synthetic oligonucleotide
gagctgtatagcagcagctggtacgactacggtttggacgtc

SEQ ID NO: 23262 - protein, 14 aa, Artificial Sequence
  Description of Artificial Sequence: Synthetic peptide
ELYSSSWYDYGLDV

SEQ ID NO: 23263 - DNA, 27 bp, Artificial Sequence
  Description of Artificial Sequence: Synthetic oligonucleotide
agcagtggctggtactactttgactac

SEQ ID NO: 23264 - protein, 9 aa, Artificial Sequence
  Description of Artificial Sequence: Synthetic peptide
SSGWYYFDY

SEQ ID NO: 23265 - DNA, 42 bp, Artificial Sequence; identical to SEQ ID NO: 23183
  Description of Artificial Sequence: Synthetic oligonucleotide

SEQ ID NO: 23266 - protein, 14 aa, Artificial Sequence
  Description of Artificial Sequence: Synthetic peptide
DWGGYSSYYYGMDV

SEQ ID NO: 23267 - DNA, 42 bp, Artificial Sequence; identical to SEQ ID NO: 23183
  Description of Artificial Sequence: Synthetic oligonucleotide

SEQ ID NO: 23268 - protein, 14 aa, Artificial Sequence
  Description of Artificial Sequence: Synthetic peptide
DWGGYSSYYYGMDV

SEQ ID NO: 23269 - DNA, 42 bp, Artificial Sequence; identical to SEQ ID NO: 23183
  Description of Artificial Sequence: Synthetic oligonucleotide

SEQ ID NO: 23270 - protein, 14 aa, Artificial Sequence
  Description of Artificial Sequence: Synthetic peptide
DWGGYSSYYYGMDV

SEQ ID NO: 23271 - DNA, 24 bp, Artificial Sequence
  Description of Artificial Sequence: Synthetic oligonucleotide
gaagtgggattcactgaggactac

SEQ ID NO: 23272 - protein, 8 aa, Artificial Sequence
  Description of Artificial Sequence: Synthetic peptide
EVGFTEDY

SEQ ID NO: 23273 - DNA, 21 bp, Artificial Sequence
  Description of Artificial Sequence: Synthetic oligonucleotide
gatcaactatggtttgactac

SEQ ID NO: 23274 - protein, 7 aa, Artificial Sequence
  Description of Artificial Sequence: Synthetic peptide
DQLWFDY

SEQ ID NO: 23275 - DNA, 24 bp, Artificial Sequence
  Description of Artificial Sequence: Synthetic oligonucleotide
gaagtgggattcactgaggactac

SEQ ID NO: 23276 - protein, 8 aa, Artificial Sequence
  Description of Artificial Sequence: Synthetic peptide
EVGFTEDY

SEQ ID NO: 23277 - DNA, 27 bp, Artificial Sequence
  Description of Artificial Sequence: Synthetic oligonucleotide
agcagtggctggtacaagtttgactac

SEQ ID NO: 23278 - protein, 9 aa, Artificial Sequence
  Description of Artificial Sequence: Synthetic peptide
SSGWYKFDY

SEQ ID NO: 23279 - DNA, 27 bp, Artificial Sequence
  Description of Artificial Sequence: Synthetic oligonucleotide
agcagtggctggtaccgctttgactac

SEQ ID NO: 23280 - protein, 9 aa, Artificial Sequence
  Description of Artificial Sequence: Synthetic peptide
SSGWYRFDY

SEQ ID NO: 23281 - DNA, 42 bp, Artificial Sequence; identical to SEQ ID NO: 23183
  Description of Artificial Sequence: Synthetic oligonucleotide

SEQ ID NO: 23282 - protein, 14 aa, Artificial Sequence
  Description of Artificial Sequence: Synthetic peptide
DWGGYSSYYYGMDV

SEQ ID NO: 23283 - DNA, 27 bp, Artificial Sequence
  Description of Artificial Sequence: Synthetic oligonucleotide
agcagtggctggtactggttcgacccc

SEQ ID NO: 23284 - protein, 9 aa, Artificial Sequence
  Description of Artificial Sequence: Synthetic peptide
SSGWYWFDP

SEQ ID NO: 23285 - DNA, 27 bp, Artificial Sequence
  Description of Artificial Sequence: Synthetic oligonucleotide
agcagtggctggtactactttgactac

SEQ ID NO: 23286 - protein, 9 aa, Artificial Sequence
  Description of Artificial Sequence: Synthetic peptide
SSGWYYFDY

SEQ ID NO: 23287 - DNA, 12 bp, Artificial Sequence
  Description of Artificial Sequence: Synthetic oligonucleotide
ttaggggtctac

SEQ ID NO: 23288 - protein, 4 aa, Artificial Sequence
  Description of Artificial Sequence: Synthetic peptide
LGVY

SEQ ID NO: 23289 - DNA, 24 bp, Artificial Sequence
  Description of Artificial Sequence: Synthetic oligonucleotide
gaagtgggattcactgaggactac

SEQ ID NO: 23290 - protein, 8 aa, Artificial Sequence
  Description of Artificial Sequence: Synthetic peptide
EVGFTEDY

SEQ ID NO: 23291 - DNA, 36 bp, Artificial Sequence
  Description of Artificial Sequence: Synthetic oligonucleotide
tggcgaggtaaccccactgactacggtatggacgtc

SEQ ID NO: 23292 - protein, 12 aa, Artificial Sequence
  Description of Artificial Sequence: Synthetic peptide
WRGNPTDYGMDV

SEQ ID NO: 23293 - DNA, 36 bp, Artificial Sequence; identical to SEQ ID NO: 23291
  Description of Artificial Sequence: Synthetic oligonucleotide

SEQ ID NO: 23294 - protein, 12 aa, Artificial Sequence
  Description of Artificial Sequence: Synthetic peptide
WRGNPTDYGMDV

SEQ ID NO: 23295 - DNA, 36 bp, Artificial Sequence; identical to SEQ ID NO: 23291
  Description of Artificial Sequence: Synthetic oligonucleotide

SEQ ID NO: 23296 - protein, 12 aa, Artificial Sequence
  Description of Artificial Sequence: Synthetic peptide
WRGNPTDYGMDV

SEQ ID NO: 23297 - DNA, 48 bp, Artificial Sequence
  Description of Artificial Sequence: Synthetic oligonucleotide
gataggagtgggagctacgggtacttctactactacggtttggacgtc

SEQ ID NO: 23298 - protein, 16 aa, Artificial Sequence
  Description of Artificial Sequence: Synthetic peptide
DRSGSYGYFYYYGLDV

SEQ ID NO: 23299 - DNA, 60 bp, Artificial Sequence
  Description of Artificial Sequence: Synthetic oligonucleotide
gcggatattgtattagtaccagctgctatcccttataattactacttcgctatggacgtc

SEQ ID NO: 23300 - protein, 20 aa, Artificial Sequence
  Description of Artificial Sequence: Synthetic peptide
ADIVLVPAAIPYNYYFAMDV

SEQ ID NO: 23301 - DNA, 36 bp, Artificial Sequence; identical to SEQ ID NO: 23291
  Description of Artificial Sequence: Synthetic oligonucleotide

SEQ ID NO: 23302 - protein, 12 aa, Artificial Sequence
  Description of Artificial Sequence: Synthetic peptide
WRGNPTDYGMDV

SEQ ID NO: 23303 - DNA, 57 bp, Artificial Sequence
  Description of Artificial Sequence: Synthetic oligonucleotide
gatcgggactctggttcggggagttacccctactactactactacggtatggacgtc

SEQ ID NO: 23304 - protein, 19 aa, Artificial Sequence
  Description of Artificial Sequence: Synthetic peptide
DRDSGSGSYPYYYYYGMDV

SEQ ID NO: 23305 - DNA, 51 bp, Artificial Sequence
  Description of Artificial Sequence: Synthetic oligonucleotide
gatcgtgactacggtgaccccccctactactactactacggtatggacgtc

SEQ ID NO: 23306 - protein, 17 aa, Artificial Sequence
  Description of Artificial Sequence: Synthetic peptide
DRDYGDPPYYYYYGMDV

SEQ ID NO: 23307 - DNA, 51 bp, Artificial Sequence; identical to SEQ ID NO: 20121
  Description of Artificial Sequence: Synthetic oligonucleotide

SEQ ID NO: 23308 - protein, 17 aa, Artificial Sequence
  Description of Artificial Sequence: Synthetic peptide
DRVEGSGTPYYYYGMDV

SEQ ID NO: 23309 - DNA, 60 bp, Artificial Sequence
  Description of Artificial Sequence: Synthetic oligonucleotide
gatcgggattattgtagtggtggtacttgtccttactactactactacggtatggacgtc

SEQ ID NO: 23310 - protein, 20 aa, Artificial Sequence
  Description of Artificial Sequence: Synthetic peptide
DRDYCSGGTCPYYYYYGMDV

SEQ ID NO: 23311 - DNA, 60 bp, Artificial Sequence
  Description of Artificial Sequence: Synthetic oligonucleotide
gatcgggattattgtagtggtggtagctgcccttactactactactacggtatggacgtc

SEQ ID NO: 23312 - protein, 20 aa, Artificial Sequence
  Description of Artificial Sequence: Synthetic peptide
DRDYCSGGSCPYYYYYGMDV

SEQ ID NO: 23313 - DNA, 36 bp, Artificial Sequence; identical to SEQ ID NO: 23291
  Description of Artificial Sequence: Synthetic oligonucleotide

SEQ ID NO: 23314 - protein, 12 aa, Artificial Sequence
  Description of Artificial Sequence: Synthetic peptide
WRGNPTDYGMDV

SEQ ID NO: 23315 - DNA, 36 bp, Artificial Sequence; identical to SEQ ID NO: 23291
  Description of Artificial Sequence: Synthetic oligonucleotide

SEQ ID NO: 23316 - protein, 12 aa, Artificial Sequence
  Description of Artificial Sequence: Synthetic peptide
WRGNPTDYGMDV

SEQ ID NO: 23317 - DNA, 39 bp, Artificial Sequence
  Description of Artificial Sequence: Synthetic oligonucleotide
gattggggtggctacgattcgagtggctggttcgacccc

SEQ ID NO: 23318 - protein, 13 aa, Artificial Sequence
  Description of Artificial Sequence: Synthetic peptide
DWGGYDSSGWFDP

SEQ ID NO: 23319 - DNA, 48 bp, Artificial Sequence; identical to SEQ ID NO: 23297
  Description of Artificial Sequence: Synthetic oligonucleotide

SEQ ID NO: 23320 - protein, 16 aa, Artificial Sequence
  Description of Artificial Sequence: Synthetic peptide
DRSGSYGYFYYYGLDV

SEQ ID NO: 23321 - DNA, 48 bp, Artificial Sequence; identical to SEQ ID NO: 23297
  Description of Artificial Sequence: Synthetic oligonucleotide

SEQ ID NO: 23322 - protein, 16 aa, Artificial Sequence
  Description of Artificial Sequence: Synthetic peptide
DRSGSYGYFYYYGLDV

SEQ ID NO: 23323 - DNA, 36 bp, Artificial Sequence; identical to SEQ ID NO: 23291
  Description of Artificial Sequence: Synthetic oligonucleotide

SEQ ID NO: 23324 - protein, 12 aa, Artificial Sequence
  Description of Artificial Sequence: Synthetic peptide
WRGNPTDYGMDV

SEQ ID NO: 23325 - DNA, 51 bp, Artificial Sequence; identical to SEQ ID NO: 23305
  Description of Artificial Sequence: Synthetic oligonucleotide

SEQ ID NO: 23326 - protein, 17 aa, Artificial Sequence
  Description of Artificial Sequence: Synthetic peptide
DRDYGDPPYYYYYGMDV

SEQ ID NO: 23327 - DNA, 60 bp, Artificial Sequence; identical to SEQ ID NO: 23309
  Description of Artificial Sequence: Synthetic oligonucleotide

SEQ ID NO: 23328 - protein, 20 aa, Artificial Sequence
  Description of Artificial Sequence: Synthetic peptide
DRDYCSGGTCPYYYYYGMDV

SEQ ID NO: 23329 - DNA, 36 bp, Artificial Sequence; identical to SEQ ID NO: 23291
  Description of Artificial Sequence: Synthetic oligonucleotide

SEQ ID NO: 23330 - protein, 12 aa, Artificial Sequence
  Description of Artificial Sequence: Synthetic peptide
WRGNPTDYGMDV

SEQ ID NO: 23331 - DNA, 48 bp, Artificial Sequence; identical to SEQ ID NO: 23297
  Description of Artificial Sequence: Synthetic oligonucleotide

SEQ ID NO: 23332 - protein, 16 aa, Artificial Sequence
  Description of Artificial Sequence: Synthetic peptide
DRSGSYGYFYYYGLDV

SEQ ID NO: 23333 - DNA, 36 bp, Artificial Sequence
  Description of Artificial Sequence: Synthetic oligonucleotide
gggatgtatagcagtggctggtacgtctttgactac

SEQ ID NO: 23334 - protein, 12 aa, Artificial Sequence
  Description of Artificial Sequence: Synthetic peptide
GMYSSGWYVFDY

SEQ ID NO: 23335 - DNA, 36 bp, Artificial Sequence; identical to SEQ ID NO: 23291
  Description of Artificial Sequence: Synthetic oligonucleotide

SEQ ID NO: 23336 - protein, 12 aa, Artificial Sequence
  Description of Artificial Sequence: Synthetic peptide
WRGNPTDYGMDV

SEQ ID NO: 23337 - DNA, 33 bp, Artificial Sequence
  Description of Artificial Sequence: Synthetic oligonucleotide
acggcagtggctggtactgggtggttcgacccc

SEQ ID NO: 23338 - protein, 11 aa, Artificial Sequence
  Description of Artificial Sequence: Synthetic peptide
TAVAGTGWFDP

SEQ ID NO: 23339 - DNA, 36 bp, Artificial Sequence; identical to SEQ ID NO: 23291
  Description of Artificial Sequence: Synthetic oligonucleotide

SEQ ID NO: 23340 - protein, 12 aa, Artificial Sequence
  Description of Artificial Sequence: Synthetic peptide
WRGNPTDYGMDV

SEQ ID NO: 23341 - DNA, 51 bp, Artificial Sequence; identical to SEQ ID NO: 23305
  Description of Artificial Sequence: Synthetic oligonucleotide

SEQ ID NO: 23342 - protein, 17 aa, Artificial Sequence
  Description of Artificial Sequence: Synthetic peptide
DRDYGDPPYYYYYGMDV

SEQ ID NO: 23343 - DNA, 60 bp, Artificial Sequence
  Description of Artificial Sequence: Synthetic oligonucleotide
gatcgggattattgtagtggtggtacctgcccttactactactactacggtatggacgtc

SEQ ID NO: 23344 - protein, 20 aa, Artificial Sequence
  Description of Artificial Sequence: Synthetic peptide
DRDYCSGGTCPYYYYYGMDV

SEQ ID NO: 23345 - DNA, 36 bp, Artificial Sequence; identical to SEQ ID NO: 23291
  Description of Artificial Sequence: Synthetic oligonucleotide

SEQ ID NO: 23346 - protein, 12 aa, Artificial Sequence
  Description of Artificial Sequence: Synthetic peptide
WRGNPTDYGMDV

SEQ ID NO: 23347 - DNA, 48 bp, Artificial Sequence; identical to SEQ ID NO: 23297
  Description of Artificial Sequence: Synthetic oligonucleotide

SEQ ID NO: 23348 - protein, 16 aa, Artificial Sequence
  Description of Artificial Sequence: Synthetic peptide
DRSGSYGYFYYYGLDV

SEQ ID NO: 23349 - DNA, 36 bp, Artificial Sequence; identical to SEQ ID NO: 23291
  Description of Artificial Sequence: Synthetic oligonucleotide

SEQ ID NO: 23350 - protein, 12 aa, Artificial Sequence
  Description of Artificial Sequence: Synthetic peptide
WRGNPTDYGMDV

SEQ ID NO: 23351 - DNA, 60 bp, Artificial Sequence
  Description of Artificial Sequence: Synthetic oligonucleotide
gatcgggattattgtagtggtactagctgcccttactactactactacggtatggacgtc

SEQ ID NO: 23352 - protein, 20 aa, Artificial Sequence
  Description of Artificial Sequence: Synthetic peptide
DRDYCSGTSCPYYYYYGMDV

SEQ ID NO: 23353 - DNA, 36 bp, Artificial Sequence; identical to SEQ ID NO: 23291
  Description of Artificial Sequence: Synthetic oligonucleotide

SEQ ID NO: 23354 - protein, 12 aa, Artificial Sequence
  Description of Artificial Sequence: Synthetic peptide
WRGNPTDYGMDV

SEQ ID NO: 23355 - DNA, 60 bp, Artificial Sequence
  Description of Artificial Sequence: Synthetic oligonucleotide
gatgaccgatcttgtagtagaaccagctgcccttactactactactacggtttggacgtc

SEQ ID NO: 23356 - protein, 20 aa, Artificial Sequence
  Description of Artificial Sequence: Synthetic peptide
DDRSCSRTSCPYYYYYGLDV

SEQ ID NO: 23357 - DNA, 36 bp, Artificial Sequence; identical to SEQ ID NO: 23291
  Description of Artificial Sequence: Synthetic oligonucleotide

SEQ ID NO: 23358 - protein, 12 aa, Artificial Sequence
  Description of Artificial Sequence: Synthetic peptide
WRGNPTDYGMDV

SEQ ID NO: 23359 - DNA, 36 bp, Artificial Sequence; identical to SEQ ID NO: 23291
  Description of Artificial Sequence: Synthetic oligonucleotide

SEQ ID NO: 23360 - protein, 12 aa, Artificial Sequence
  Description of Artificial Sequence: Synthetic peptide
WRGNPTDYGMDV

SEQ ID NO: 23361 - DNA, 60 bp, Artificial Sequence; identical to SEQ ID NO: 23355
  Description of Artificial Sequence: Synthetic oligonucleotide

SEQ ID NO: 23362 - protein, 20 aa, Artificial Sequence
  Description of Artificial Sequence: Synthetic peptide
DDRSCSRTSCPYYYYYGLDV

SEQ ID NO: 23363 - DNA, 36 bp, Artificial Sequence; identical to SEQ ID NO: 23291
  Description of Artificial Sequence: Synthetic oligonucleotide

SEQ ID NO: 23364 - protein, 12 aa, Artificial Sequence
  Description of Artificial Sequence: Synthetic peptide
WRGNPTDYGMDV

SEQ ID NO: 23365 - DNA, 36 bp, Artificial Sequence
  Description of Artificial Sequence: Synthetic oligonucleotide
tggcgaggtaaccccactgactccggtatggacgtc

SEQ ID NO: 23366 - protein, 12 aa, Artificial Sequence
  Description of Artificial Sequence: Synthetic peptide
WRGNPTDSGMDV

SEQ ID NO: 23367 - DNA, 60 bp, Artificial Sequence
  Description of Artificial Sequence: Synthetic oligonucleotide
gatgaccgatcttgtagtagtaccagctgcccttactactactactacggtttggacgtc

SEQ ID NO: 23368 - protein, 20 aa, Artificial Sequence
  Description of Artificial Sequence: Synthetic peptide
DDRSCSSTSCPYYYYYGLDV

SEQ ID NO: 23369 - DNA, 60 bp, Artificial Sequence; identical to SEQ ID NO: 23355
  Description of Artificial Sequence: Synthetic oligonucleotide

SEQ ID NO: 23370 - protein, 20 aa, Artificial Sequence
  Description of Artificial Sequence: Synthetic peptide
DDRSCSRTSCPYYYYYGLDV

SEQ ID NO: 23371 - DNA, 51 bp, Artificial Sequence; identical to SEQ ID NO: 20121
  Description of Artificial Sequence: Synthetic oligonucleotide

SEQ ID NO: 23372 - protein, 17 aa, Artificial Sequence
  Description of Artificial Sequence: Synthetic peptide
DRVEGSGTPYYYYGMDV

SEQ ID NO: 23373 - DNA, 60 bp, Artificial Sequence
  Description of Artificial Sequence: Synthetic oligonucleotide
gatcgggattattgtagtggtggtagctgtccttactactactactacggtatggacgtc

SEQ ID NO: 23374 - protein, 20 aa, Artificial Sequence
  Description of Artificial Sequence: Synthetic peptide
DRDYCSGGSCPYYYYYGMDV

SEQ ID NO: 23375 - DNA, 60 bp, Artificial Sequence; identical to SEQ ID NO: 23311
  Description of Artificial Sequence: Synthetic oligonucleotide

SEQ ID NO: 23376 - protein, 20 aa, Artificial Sequence
  Description of Artificial Sequence: Synthetic peptide
DRDYCSGGSCPYYYYYGMDV

SEQ ID NO: 23377 - DNA, 36 bp, Artificial Sequence; identical to SEQ ID NO: 23291
  Description of Artificial Sequence: Synthetic oligonucleotide

SEQ ID NO: 23378 - protein, 12 aa, Artificial Sequence
  Description of Artificial Sequence: Synthetic peptide
WRGNPTDYGMDV

SEQ ID NO: 23379 - DNA, 60 bp, Artificial Sequence
  Description of Artificial Sequence: Synthetic oligonucleotide
gaggattcctattgtagtggtaccagctgcccctactactactactacggtatggacgtc

SEQ ID NO: 23380 - protein, 20 aa, Artificial Sequence
  Description of Artificial Sequence: Synthetic peptide
EDSYCSGTSCPYYYYYGMDV

SEQ ID NO: 23381 - DNA, 36 bp, Artificial Sequence; identical to SEQ ID NO: 23291
  Description of Artificial Sequence: Synthetic oligonucleotide

SEQ ID NO: 23382 - protein, 12 aa, Artificial Sequence
  Description of Artificial Sequence: Synthetic peptide
WRGNPTDYGMDV

SEQ ID NO: 23383 - DNA, 60 bp, Artificial Sequence
  Description of Artificial Sequence: Synthetic oligonucleotide
gatcgggattattgtagtggtggtagttgcccttactactactactacggtatggacgtc

SEQ ID NO: 23384 - protein, 20 aa, Artificial Sequence
  Description of Artificial Sequence: Synthetic peptide
DRDYCSGGSCPYYYYYGMDV

SEQ ID NO: 23385 - DNA, 39 bp, Artificial Sequence; identical to SEQ ID NO: 23317
  Description of Artificial Sequence: Synthetic oligonucleotide

SEQ ID NO: 23386 - protein, 13 aa, Artificial Sequence
  Description of Artificial Sequence: Synthetic peptide
DWGGYDSSGWFDP

SEQ ID NO: 23387 - DNA, 48 bp, Artificial Sequence
  Description of Artificial Sequence: Synthetic oligonucleotide
caggccatagcaagtcgagggaggtactactactacggtatggacgtc

SEQ ID NO: 23388 - protein, 16 aa, Artificial Sequence
  Description of Artificial Sequence: Synthetic peptide
QAIASRGRYYYYGMDV

SEQ ID NO: 23389 - DNA, 42 bp, Artificial Sequence
  Description of Artificial Sequence: Synthetic oligonucleotide
gatacggagagatggctaccatactcctacggtatggacgtc

SEQ ID NO: 23390 - protein, 14 aa, Artificial Sequence
  Description of Artificial Sequence: Synthetic peptide
DTERWLPYSYGMDV

SEQ ID NO: 23391 - DNA, 63 bp, Artificial Sequence
  Description of Artificial Sequence: Synthetic oligonucleotide
gatcgggttttttgtagtagtaccagctgcctctcttactactactactacggtatggacgtc

SEQ ID NO: 23392 - protein, 21 aa, Artificial Sequence
  Description of Artificial Sequence: Synthetic peptide
DRVFCSSTSCLSYYYYYGMDV

SEQ ID NO: 23393 - DNA, 36 bp, Artificial Sequence; identical to SEQ ID NO: 23291
  Description of Artificial Sequence: Synthetic oligonucleotide

SEQ ID NO: 23394 - protein, 12 aa, Artificial Sequence
  Description of Artificial Sequence: Synthetic peptide
WRGNPTDYGMDV

SEQ ID NO: 23395 - DNA, 51 bp, Artificial Sequence; identical to SEQ ID NO: 23305
  Description of Artificial Sequence: Synthetic oligonucleotide

SEQ ID NO: 23396 - protein, 17 aa, Artificial Sequence
  Description of Artificial Sequence: Synthetic peptide
DRDYGDPPYYYYYGMDV

SEQ ID NO: 23397 - DNA, 48 bp, Artificial Sequence
  Description of Artificial Sequence: Synthetic oligonucleotide
gataggagtgggagctacgggtacttctactactacggtatggacgtc

SEQ ID NO: 23398 - protein, 16 aa, Artificial Sequence
  Description of Artificial Sequence: Synthetic peptide
DRSGSYGYFYYYGMDV

SEQ ID NO: 23399 - DNA, 60 bp, Artificial Sequence
  Description of Artificial Sequence: Synthetic oligonucleotide
gatcgggttttttgtagtggtaccagctgcccttactactactactacggtatggacgtc

SEQ ID NO: 23400 - protein, 20 aa, Artificial Sequence
  Description of Artificial Sequence: Synthetic peptide
DRVFCSGTSCPYYYYYGMDV

SEQ ID NO: 23401 - DNA, 60 bp, Artificial Sequence
  Description of Artificial Sequence: Synthetic oligonucleotide
gatcgggtttcttgtagtagtaccagctgcccttactactactactacggtatggacgtc

SEQ ID NO: 23402 - protein, 20 aa, Artificial Sequence
  Description of Artificial Sequence: Synthetic peptide
DRVSCSSTSCPYYYYYGMDV

SEQ ID NO: 23403 - DNA, 60 bp, Artificial Sequence; identical to SEQ ID NO: 23401
  Description of Artificial Sequence: Synthetic oligonucleotide

SEQ ID NO: 23404 - protein, 20 aa, Artificial Sequence
  Description of Artificial Sequence: Synthetic peptide
DRVSCSSTSCPYYYYYGMDV

SEQ ID NO: 23405 - DNA, 60 bp, Artificial Sequence; identical to SEQ ID NO: 23401
  Description of Artificial Sequence: Synthetic oligonucleotide

SEQ ID NO: 23406 - protein, 20 aa, Artificial Sequence
  Description of Artificial Sequence: Synthetic peptide
DRVSCSSTSCPYYYYYGMDV

SEQ ID NO: 23407 - DNA, 36 bp, Artificial Sequence
  Description of Artificial Sequence: Synthetic oligonucleotide
gtcgggtatagcggtggctggtacatctttgactac

SEQ ID NO: 23408 - protein, 12 aa, Artificial Sequence
  Description of Artificial Sequence: Synthetic peptide
VGYSGGWYIFDY

SEQ ID NO: 23409 - DNA, 60 bp, Artificial Sequence; identical to SEQ ID NO: 23399
  Description of Artificial Sequence: Synthetic oligonucleotide

SEQ ID NO: 23410 - protein, 20 aa, Artificial Sequence
  Description of Artificial Sequence: Synthetic peptide
DRVFCSGTSCPYYYYYGMDV

SEQ ID NO: 23411 - DNA, 60 bp, Artificial Sequence
  Description of Artificial Sequence: Synthetic oligonucleotide
tcgaattgtagtagtgccaactgctatacggtggggttctactactacggtttggacgtc

SEQ ID NO: 23412 - protein, 20 aa, Artificial Sequence
  Description of Artificial Sequence: Synthetic peptide
SNCSSANCYTVGFYYYGLDV

SEQ ID NO: 23413 - DNA, 60 bp, Artificial Sequence
  Description of Artificial Sequence: Synthetic oligonucleotide
tcgaattgtagtagtgccaactgctatacggtggggttctactactacggtatggacgtc

SEQ ID NO: 23414 - protein, 20 aa, Artificial Sequence
  Description of Artificial Sequence: Synthetic peptide
SNCSSANCYTVGFYYYGMDV

SEQ ID NO: 23415 - DNA, 63 bp, Artificial Sequence
  Description of Artificial Sequence: Synthetic oligonucleotide
gatgatagatattgtagtagtcccacctgccatccttactactactactacggtctggacgtc

SEQ ID NO: 23416 - protein, 21 aa, Artificial Sequence
  Description of Artificial Sequence: Synthetic peptide
DDRYCSSPTCHPYYYYYGLDV

SEQ ID NO: 23417 - DNA, 60 bp, Artificial Sequence
  Description of Artificial Sequence: Synthetic oligonucleotide
gatcagtacaaccggaacgacggaccaccagcttactactactactacggtttggacgtc

SEQ ID NO: 23418 - protein, 20 aa, Artificial Sequence
  Description of Artificial Sequence: Synthetic peptide
DQYNRNDGPPAYYYYYGLDV

SEQ ID NO: 23419 - DNA, 60 bp, Artificial Sequence
  Description of Artificial Sequence: Synthetic oligonucleotide
gatcagtacaaccggaacgacggaccaccagcttactactactactacggtatggacgtc

SEQ ID NO: 23420 - protein, 20 aa, Artificial Sequence
  Description of Artificial Sequence: Synthetic peptide
DQYNRNDGPPAYYYYYGMDV

SEQ ID NO: 23421 - DNA, 42 bp, Artificial Sequence
  Description of Artificial Sequence: Synthetic oligonucleotide
ggggatacagctggggttacctattactacggtatggacgtc

SEQ ID NO: 23422 - protein, 14 aa, Artificial Sequence
  Description of Artificial Sequence: Synthetic peptide
GDTAGVTYYYGMDV

SEQ ID NO: 23423 - DNA, 66 bp, Artificial Sequence
  Description of Artificial Sequence: Synthetic oligonucleotide
gagggggctacgtattaccatggttcggggagttattatccggctactaactacggtatggacgtc

SEQ ID NO: 23424 - protein, 22 aa, Artificial Sequence
  Description of Artificial Sequence: Synthetic peptide
EGATYYHGSGSYYPATNYGMDV

SEQ ID NO: 23425 - DNA, 39 bp, Artificial Sequence
  Description of Artificial Sequence: Synthetic oligonucleotide
cccctttacgatatgggactctactacgatatggacgtc

SEQ ID NO: 23426 - protein, 13 aa, Artificial Sequence
  Description of Artificial Sequence: Synthetic peptide
PLYDMGLYYDMDV

SEQ ID NO: 23427 - DNA, 63 bp, Artificial Sequence
  Description of Artificial Sequence: Synthetic oligonucleotide
gatcgggtttattgtagtagtaccagctgccatccctattactactactacgctatggacgtc

SEQ ID NO: 23428 - protein, 21 aa, Artificial Sequence
  Description of Artificial Sequence: Synthetic peptide
DRVYCSSTSCHPYYYYYAMDV

SEQ ID NO: 23429 - DNA, 60 bp, Artificial Sequence
  Description of Artificial Sequence: Synthetic oligonucleotide
gatcagtacaacaggaacgacggaccaccagcttactactactactacggtttggacgtc

SEQ ID NO: 23430 - protein, 20 aa, Artificial Sequence
  Description of Artificial Sequence: Synthetic peptide
DQYNRNDGPPAYYYYYGLDV

SEQ ID NO: 23431 - DNA, 42 bp, Artificial Sequence; identical to SEQ ID NO: 23421
  Description of Artificial Sequence: Synthetic oligonucleotide

SEQ ID NO: 23432 - protein, 14 aa, Artificial Sequence
  Description of Artificial Sequence: Synthetic peptide
GDTAGVTYYYGMDV

SEQ ID NO: 23433 - DNA, 18 bp, Artificial Sequence
  Description of Artificial Sequence: Synthetic oligonucleotide
ggttgggagttaaactac

SEQ ID NO: 23434 - protein, 6 aa, Artificial Sequence
  Description of Artificial Sequence: Synthetic peptide
GWELNY

SEQ ID NO: 23435 - DNA, 63 bp, Artificial Sequence
  Description of Artificial Sequence: Synthetic oligonucleotide
gaccgtacgtattactctggttcggggagccccccctactactactactacggtatggacgtc

SEQ ID NO: 23436 - protein, 21 aa, Artificial Sequence
  Description of Artificial Sequence: Synthetic peptide
DRTYYSGSGSPPYYYYYGMDV

SEQ ID NO: 23437 - DNA, 18 bp, Artificial Sequence
  Description of Artificial Sequence: Synthetic oligonucleotide
ggctgggagttaaactac

SEQ ID NO: 23438 - protein, 6 aa, Artificial Sequence
  Description of Artificial Sequence: Synthetic peptide
GWELNY

SEQ ID NO: 23439 - DNA, 18 bp, Artificial Sequence
  Description of Artificial Sequence: Synthetic oligonucleotide
ggctgggaattaaactac

SEQ ID NO: 23440 - protein, 6 aa, Artificial Sequence
  Description of Artificial Sequence: Synthetic peptide
GWELNY

SEQ ID NO: 23441 - DNA, 42 bp, Artificial Sequence
  Description of Artificial Sequence: Synthetic oligonucleotide
gatgaaaggcagtggctgccggccccctacggtatggacgtc

SEQ ID NO: 23442 - protein, 14 aa, Artificial Sequence
  Description of Artificial Sequence: Synthetic peptide
DERQWLPAPYGMDV

SEQ ID NO: 23443 - DNA, 48 bp, Artificial Sequence
  Description of Artificial Sequence: Synthetic oligonucleotide
gataaggcagctgggaggaatgacttctactactacggtatggacgtc

SEQ ID NO: 23444 - protein, 16 aa, Artificial Sequence
  Description of Artificial Sequence: Synthetic peptide
DKAAGRNDFYYYGMDV

SEQ ID NO: 23445 - DNA, 60 bp, Artificial Sequence; identical to SEQ ID NO: 23429
  Description of Artificial Sequence: Synthetic oligonucleotide

SEQ ID NO: 23446 - protein, 20 aa, Artificial Sequence
  Description of Artificial Sequence: Synthetic peptide
DQYNRNDGPPAYYYYYGLDV

SEQ ID NO: 23447 - DNA, 48 bp, Artificial Sequence; identical to SEQ ID NO: 23443
  Description of Artificial Sequence: Synthetic oligonucleotide

SEQ ID NO: 23448 - protein, 16 aa, Artificial Sequence
  Description of Artificial Sequence: Synthetic peptide
DKAAGRNDFYYYGMDV

SEQ ID NO: 23449 - DNA, 33 bp, Artificial Sequence
  Description of Artificial Sequence: Synthetic oligonucleotide
gatatccggaactactactacggtttggacgtc

SEQ ID NO: 23450 - protein, 11 aa, Artificial Sequence
  Description of Artificial Sequence: Synthetic peptide
DIRNYYYGLDV

SEQ ID NO: 23451 - DNA, 54 bp, Artificial Sequence
  Description of Artificial Sequence: Synthetic oligonucleotide
gaccgtcattacgatttccacgttccctactattactattacggtatggacgtc

SEQ ID NO: 23452 - protein, 18 aa, Artificial Sequence
  Description of Artificial Sequence: Synthetic peptide
DRHYDFHVPYYYYYGMDV

SEQ ID NO: 23453 - DNA, 36 bp, Artificial Sequence
  Description of Artificial Sequence: Synthetic oligonucleotide
gatagtaggaaggggttctactacggtctggacgtc

SEQ ID NO: 23454 - protein, 12 aa, Artificial Sequence
  Description of Artificial Sequence: Synthetic peptide
DSRKGFYYGLDV

SEQ ID NO: 23455 - DNA, 42 bp, Artificial Sequence
  Description of Artificial Sequence: Synthetic oligonucleotide
ggggggcccccgttctctacggtgactatgtactttgactac

SEQ ID NO: 23456 - protein, 14 aa, Artificial Sequence
  Description of Artificial Sequence: Synthetic peptide
GGPPFSTVTMYFDY

SEQ ID NO: 23457 - DNA, 27 bp, Artificial Sequence
  Description of Artificial Sequence: Synthetic oligonucleotide
aaagcagcagctgttgcttttgatatc

SEQ ID NO: 23458 - protein, 9 aa, Artificial Sequence
  Description of Artificial Sequence: Synthetic peptide
KAAAVAFDI

SEQ ID NO: 23459 - DNA, 63 bp, Artificial Sequence
  Description of Artificial Sequence: Synthetic oligonucleotide
gggttttattactatggttcggggagtcatgtcccttaccactactactacggtttggacgtc

SEQ ID NO: 23460 - protein, 21 aa, Artificial Sequence
  Description of Artificial Sequence: Synthetic peptide
GFYYYGSGSHVPYHYYYGLDV

SEQ ID NO: 23461 - DNA, 42 bp, Artificial Sequence
  Description of Artificial Sequence: Synthetic oligonucleotide
ggggggcccccgttttctacggtgactatgtacttcgactac

SEQ ID NO: 23462 - protein, 14 aa, Artificial Sequence
  Description of Artificial Sequence: Synthetic peptide
GGPPFSTVTMYFDY

SEQ ID NO: 23463 - DNA, 39 bp, Artificial Sequence; identical to SEQ ID NO: 22947
  Description of Artificial Sequence: Synthetic oligonucleotide

SEQ ID NO: 23464 - protein, 13 aa, Artificial Sequence
  Description of Artificial Sequence: Synthetic peptide
HDFWSGYYKGMDV

SEQ ID NO: 23465 - DNA, 42 bp, Artificial Sequence
  Description of Artificial Sequence: Synthetic oligonucleotide
gaccgctataactggaactacccctactggtacttcgatctc

SEQ ID NO: 23466 - protein, 14 aa, Artificial Sequence
  Description of Artificial Sequence: Synthetic peptide
DRYNWNYPYWYFDL

SEQ ID NO: 23467 - DNA, 39 bp, Artificial Sequence; identical to SEQ ID NO: 22947
  Description of Artificial Sequence: Synthetic oligonucleotide

SEQ ID NO: 23468 - protein, 13 aa, Artificial Sequence
  Description of Artificial Sequence: Synthetic peptide
HDFWSGYYKGMDV

SEQ ID NO: 23469 - DNA, 63 bp, Artificial Sequence
  Description of Artificial Sequence: Synthetic oligonucleotide
gatcgggtctattgtagtagttccagctgctcatattactactactactacggtatggacgtc

SEQ ID NO: 23470 - protein, 21 aa, Artificial Sequence
  Description of Artificial Sequence: Synthetic peptide
DRVYCSSSSCSYYYYYYGMDV

SEQ ID NO: 23471 - DNA, 30 bp, Artificial Sequence
  Description of Artificial Sequence: Synthetic oligonucleotide
ggggactggaactacgagggttttgactac

SEQ ID NO: 23472 - protein, 10 aa, Artificial Sequence
  Description of Artificial Sequence: Synthetic peptide
GDWNYEGFDY

SEQ ID NO: 23473 - DNA, 39 bp, Artificial Sequence
  Description of Artificial Sequence: Synthetic oligonucleotide
gatgggtatagcagtggctggttcaactggttcgacccc

SEQ ID NO: 23474 - protein, 13 aa, Artificial Sequence
  Description of Artificial Sequence: Synthetic peptide
DGYSSGWFNWFDP

SEQ ID NO: 23475 - DNA, 39 bp, Artificial Sequence; identical to SEQ ID NO: 22947
  Description of Artificial Sequence: Synthetic oligonucleotide

SEQ ID NO: 23476 - protein, 13 aa, Artificial Sequence
  Description of Artificial Sequence: Synthetic peptide
HDFWSGYYKGMDV

SEQ ID NO: 23477 - DNA, 39 bp, Artificial Sequence; identical to SEQ ID NO: 22947
  Description of Artificial Sequence: Synthetic oligonucleotide

SEQ ID NO: 23478 - protein, 13 aa, Artificial Sequence
  Description of Artificial Sequence: Synthetic peptide
HDFWSGYYKGMDV

SEQ ID NO: 23479 - DNA, 39 bp, Artificial Sequence; identical to SEQ ID NO: 22947
  Description of Artificial Sequence: Synthetic oligonucleotide

SEQ ID NO: 23480 - protein, 13 aa, Artificial Sequence
  Description of Artificial Sequence: Synthetic peptide
HDFWSGYYKGMDV

SEQ ID NO: 23481 - DNA, 24 bp, Artificial Sequence
  Description of Artificial Sequence: Synthetic oligonucleotide
gtcacaggtatagcagctccctac

SEQ ID NO: 23482 - protein, 8 aa, Artificial Sequence
  Description of Artificial Sequence: Synthetic peptide
VTGIAAPY

SEQ ID NO: 23483 - DNA, 24 bp, Artificial Sequence
  Description of Artificial Sequence: Synthetic oligonucleotide
gcagtggctgtctcctttgactac

SEQ ID NO: 23484 - protein, 8 aa, Artificial Sequence
  Description of Artificial Sequence: Synthetic peptide
AVAVSFDY

SEQ ID NO: 23485 - DNA, 24 bp, Artificial Sequence
  Description of Artificial Sequence: Synthetic oligonucleotide
gtcacaggtatagcagctccctac

SEQ ID NO: 23486 - protein, 8 aa, Artificial Sequence
  Description of Artificial Sequence: Synthetic peptide
VTGIAAPY

SEQ ID NO: 23487 - DNA, 24 bp, Artificial Sequence
  Description of Artificial Sequence: Synthetic oligonucleotide
cttatagcagtggcctttgactcc

SEQ ID NO: 23488 - protein, 8 aa, Artificial Sequence
  Description of Artificial Sequence: Synthetic peptide
LIAVAFDS

SEQ ID NO: 23489 - DNA, 24 bp, Artificial Sequence
  Description of Artificial Sequence: Synthetic oligonucleotide
acctatagtgggagttttgactac

SEQ ID NO: 23490 - protein, 8 aa, Artificial Sequence
  Description of Artificial Sequence: Synthetic peptide
TYSGSFDY

SEQ ID NO: 23491 - DNA, 45 bp, Artificial Sequence
  Description of Artificial Sequence: Synthetic oligonucleotide
gatgactatggttcggggagtcccctatactacggtatggacgtc

SEQ ID NO: 23492 - protein, 15 aa, Artificial Sequence
  Description of Artificial Sequence: Synthetic peptide
DDYGSGSPLYYGMDV

SEQ ID NO: 23493 - DNA, 45 bp, Artificial Sequence
  Description of Artificial Sequence: Synthetic oligonucleotide
ggggacctcccatacagctcgggctactactacggtatggacgtc

SEQ ID NO: 23494 - protein, 15 aa, Artificial Sequence
  Description of Artificial Sequence: Synthetic peptide
GDLPYSSGYYYGMDV

SEQ ID NO: 23495 - DNA, 66 bp, Artificial Sequence
  Description of Artificial Sequence: Synthetic oligonucleotide
gatgagggacgtggatatggtggctacgagaggggatattactactactactacggtatggacgtc

SEQ ID NO: 23496 - protein, 22 aa, Artificial Sequence
  Description of Artificial Sequence: Synthetic peptide
DEGRGYGGYERGYYYYYYGMDV

SEQ ID NO: 23497 - DNA, 42 bp, Artificial Sequence
  Description of Artificial Sequence: Synthetic oligonucleotide
ggggatacagctatggtcctctactactacggtatggacgtc

SEQ ID NO: 23498 - protein, 14 aa, Artificial Sequence
  Description of Artificial Sequence: Synthetic peptide
GDTAMVLYYYGMDV

SEQ ID NO: 23499 - DNA, 42 bp, Artificial Sequence
  Description of Artificial Sequence: Synthetic oligonucleotide
gcggatacacctatggtcctttacttctacggtatggacgtc

SEQ ID NO: 23500 - protein, 14 aa, Artificial Sequence
  Description of Artificial Sequence: Synthetic peptide
ADTPMVLYFYGMDV

SEQ ID NO: 23501 - DNA, 60 bp, Artificial Sequence
  Description of Artificial Sequence: Synthetic oligonucleotide
gatagggactattgtagtagttccagctgcccttactactactactacggtatggacgtc

SEQ ID NO: 23502 - protein, 20 aa, Artificial Sequence
  Description of Artificial Sequence: Synthetic peptide
DRDYCSSSSCPYYYYYGMDV

SEQ ID NO: 23503 - DNA, 24 bp, Artificial Sequence
  Description of Artificial Sequence: Synthetic oligonucleotide
gtcacatatatagcagctccctac

SEQ ID NO: 23504 - protein, 8 aa, Artificial Sequence
  Description of Artificial Sequence: Synthetic peptide
VTYIAAPY

SEQ ID NO: 23505 - DNA, 42 bp, Artificial Sequence; identical to SEQ ID NO: 23499
  Description of Artificial Sequence: Synthetic oligonucleotide

SEQ ID NO: 23506 - protein, 14 aa, Artificial Sequence
  Description of Artificial Sequence: Synthetic peptide
ADTPMVLYFYGMDV

SEQ ID NO: 23507 - DNA, 24 bp, Artificial Sequence
  Description of Artificial Sequence: Synthetic oligonucleotide
cttatagcagtggcctttgactcc

SEQ ID NO: 23508 - protein, 8 aa, Artificial Sequence
  Description of Artificial Sequence: Synthetic peptide
LIAVAFDS

SEQ ID NO: 23509 - DNA, 24 bp, Artificial Sequence
  Description of Artificial Sequence: Synthetic oligonucleotide
gtcacaggtatagcagctccctac

SEQ ID NO: 23510 - protein, 8 aa, Artificial Sequence
  Description of Artificial Sequence: Synthetic peptide
VTGIAAPY

SEQ ID NO: 23511 - DNA, 27 bp, Artificial Sequence
  Description of Artificial Sequence: Synthetic oligonucleotide
aaagctacctgggtggcttttgatatc

SEQ ID NO: 23512 - protein, 9 aa, Artificial Sequence
  Description of Artificial Sequence: Synthetic peptide
KATWVAFDI

SEQ ID NO: 23513 - DNA, 27 bp, Artificial Sequence
  Description of Artificial Sequence: Synthetic oligonucleotide
aaagctacctgggtggcttttgatatc

SEQ ID NO: 23514 - protein, 9 aa, Artificial Sequence
  Description of Artificial Sequence: Synthetic peptide
KATWVAFDI

SEQ ID NO: 23515 - DNA, 27 bp, Artificial Sequence
  Description of Artificial Sequence: Synthetic oligonucleotide
aaagctacctgggtggcttttgatatc

SEQ ID NO: 23516 - protein, 9 aa, Artificial Sequence
  Description of Artificial Sequence: Synthetic peptide
KATWVAFDI

SEQ ID NO: 23517 - DNA, 27 bp, Artificial Sequence
  Description of Artificial Sequence: Synthetic oligonucleotide
aaaactacctgggtggcttttgatatc

SEQ ID NO: 23518 - protein, 9 aa, Artificial Sequence
  Description of Artificial Sequence: Synthetic peptide
KTTWVAFDI

SEQ ID NO: 23519 - DNA, 27 bp, Artificial Sequence
  Description of Artificial Sequence: Synthetic oligonucleotide
aaagctacctgggtggcttttgatatc

SEQ ID NO: 23520 - protein, 9 aa, Artificial Sequence
  Description of Artificial Sequence: Synthetic peptide
KATWVAFDI

SEQ ID NO: 23521 - DNA, 51 bp, Artificial Sequence
  Description of Artificial Sequence: Synthetic oligonucleotide
gatcaccgttactatgatagtagtggttattactctgatgcttttgatatc

SEQ ID NO: 23522 - protein, 17 aa, Artificial Sequence
  Description of Artificial Sequence: Synthetic peptide
DHRYYDSSGYYSDAFDI

SEQ ID NO: 23523 - DNA, 51 bp, Artificial Sequence; identical to SEQ ID NO: 23521
  Description of Artificial Sequence: Synthetic oligonucleotide

SEQ ID NO: 23524 - protein, 17 aa, Artificial Sequence
  Description of Artificial Sequence: Synthetic peptide
DHRYYDSSGYYSDAFDI

SEQ ID NO: 23525 - DNA, 45 bp, Artificial Sequence
  Description of Artificial Sequence: Synthetic oligonucleotide
gcgtattattatggttcggggagttattataatgaatttgatatg

SEQ ID NO: 23526 - protein, 15 aa, Artificial Sequence
  Description of Artificial Sequence: Synthetic peptide
AYYYGSGSYYNEFDM

SEQ ID NO: 23527 - DNA, 27 bp, Artificial Sequence
  Description of Artificial Sequence: Synthetic oligonucleotide
aaagctacctgggtggcttttgatatc

SEQ ID NO: 23528 - protein, 9 aa, Artificial Sequence
  Description of Artificial Sequence: Synthetic peptide
KATWVAFDI

SEQ ID NO: 23529 - DNA, 45 bp, Artificial Sequence
  Description of Artificial Sequence: Synthetic oligonucleotide
acgtatttctatggttcggggagttattataacggctttgactac

SEQ ID NO: 23530 - protein, 15 aa, Artificial Sequence
  Description of Artificial Sequence: Synthetic peptide
TYFYGSGSYYNGFDY

SEQ ID NO: 23531 - DNA, 36 bp, Artificial Sequence
  Description of Artificial Sequence: Synthetic oligonucleotide
gatagagggcatagagggttctacggtatggacgtc

SEQ ID NO: 23532 - protein, 12 aa, Artificial Sequence
  Description of Artificial Sequence: Synthetic peptide
DRGHRGFYGMDV

SEQ ID NO: 23533 - DNA, 45 bp, Artificial Sequence
  Description of Artificial Sequence: Synthetic oligonucleotide
gcgtattattatggttcggggagttattataatgaatctgatatg

SEQ ID NO: 23534 - protein, 15 aa, Artificial Sequence
  Description of Artificial Sequence: Synthetic peptide
AYYYGSGSYYNESDM

SEQ ID NO: 23535 - DNA, 45 bp, Artificial Sequence
  Description of Artificial Sequence: Synthetic oligonucleotide
acgtattactatgggtcggggagttattataacggctttgactac

SEQ ID NO: 23536 - protein, 15 aa, Artificial Sequence
  Description of Artificial Sequence: Synthetic peptide
TYYYGSGSYYNGFDY

SEQ ID NO: 23537 - DNA, 45 bp, Artificial Sequence
  Description of Artificial Sequence: Synthetic oligonucleotide
gcgtattactatggttcggggacttatcataacgaatttgactac

SEQ ID NO: 23538 - protein, 15 aa, Artificial Sequence
  Description of Artificial Sequence: Synthetic peptide
AYYYGSGTYHNEFDY

SEQ ID NO: 23539 - DNA, 45 bp, Artificial Sequence
  Description of Artificial Sequence: Synthetic oligonucleotide
acgtattactatggttcggggagttattataacggctttgactac

SEQ ID NO: 23540 - protein, 15 aa, Artificial Sequence
  Description of Artificial Sequence: Synthetic peptide
TYYYGSGSYYNGFDY

SEQ ID NO: 23541 - DNA, 27 bp, Artificial Sequence
  Description of Artificial Sequence: Synthetic oligonucleotide
aaagctacctgggtggcttttgatatc

SEQ ID NO: 23542 - protein, 9 aa, Artificial Sequence
  Description of Artificial Sequence: Synthetic peptide
KATWVAFDI

SEQ ID NO: 23543 - DNA, 27 bp, Artificial Sequence
  Description of Artificial Sequence: Synthetic oligonucleotide
gagactggaacctgggcttttgatatc

SEQ ID NO: 23544 - protein, 9 aa, Artificial Sequence
  Description of Artificial Sequence: Synthetic peptide
ETGTWAFDI

SEQ ID NO: 23545 - DNA, 27 bp, Artificial Sequence
  Description of Artificial Sequence: Synthetic oligonucleotide
aaaactacctgggtggcttttgatatc

SEQ ID NO: 23546 - protein, 9 aa, Artificial Sequence
  Description of Artificial Sequence: Synthetic peptide
KTTWVAFDI

SEQ ID NO: 23547 - DNA, 24 bp, Artificial Sequence
  Description of Artificial Sequence: Synthetic oligonucleotide
cttatagcagtggcctttgactac

SEQ ID NO: 23548 - protein, 8 aa, Artificial Sequence
  Description of Artificial Sequence: Synthetic peptide
LIAVAFDY

SEQ ID NO: 23549 - DNA, 60 bp, Artificial Sequence
  Description of Artificial Sequence: Synthetic oligonucleotide
gatcgagattattgtagtggtaccagctgcccttattattactactacggtatggacgtc

SEQ ID NO: 23550 - protein, 20 aa, Artificial Sequence
  Description of Artificial Sequence: Synthetic peptide
DRDYCSGTSCPYYYYYGMDV

SEQ ID NO: 23551 - DNA, 24 bp, Artificial Sequence
  Description of Artificial Sequence: Synthetic oligonucleotide
cttatagcagtggcctttgactac

SEQ ID NO: 23552 - protein, 8 aa, Artificial Sequence
  Description of Artificial Sequence: Synthetic peptide
LIAVAFDY

SEQ ID NO: 23553 - DNA, 27 bp, Artificial Sequence
  Description of Artificial Sequence: Synthetic oligonucleotide
gattcaccagtggctggtactgactac

SEQ ID NO: 23554 - protein, 9 aa, Artificial Sequence
  Description of Artificial Sequence: Synthetic peptide
DSPVAGTDY

SEQ ID NO: 23555 - DNA, 60 bp, Artificial Sequence
  Description of Artificial Sequence: Synthetic oligonucleotide
gatcgagattattgtagtagtaccagctgcccttattattactactacggtatggacgtc

SEQ ID NO: 23556 - protein, 20 aa, Artificial Sequence
  Description of Artificial Sequence: Synthetic peptide
DRDYCSSTSCPYYYYYGMDV

SEQ ID NO: 23557 - DNA, 60 bp, Artificial Sequence
  Description of Artificial Sequence: Synthetic oligonucleotide
gatcgagattattgtagtagtaccagctgcccttactactactactacggtatggacgtc

SEQ ID NO: 23558 - protein, 20 aa, Artificial Sequence
  Description of Artificial Sequence: Synthetic peptide
DRDYCSSTSCPYYYYYGMDV

SEQ ID NO: 23559 - DNA, 27 bp, Artificial Sequence
  Description of Artificial Sequence: Synthetic oligonucleotide
gatgcccccgacttcggtatggacgtc

SEQ ID NO: 23560 - protein, 9 aa, Artificial Sequence
  Description of Artificial Sequence: Synthetic peptide
DAPDFGMDV

SEQ ID NO: 23561 - DNA, 60 bp, Artificial Sequence; identical to SEQ ID NO: 23555
  Description of Artificial Sequence: Synthetic oligonucleotide

SEQ ID NO: 23562 - protein, 20 aa, Artificial Sequence
  Description of Artificial Sequence: Synthetic peptide
DRDYCSSTSCPYYYYYGMDV

SEQ ID NO: 23563 - DNA, 60 bp, Artificial Sequence; identical to SEQ ID NO: 23555
  Description of Artificial Sequence: Synthetic oligonucleotide

SEQ ID NO: 23564 - protein, 20 aa, Artificial Sequence
  Description of Artificial Sequence: Synthetic peptide
DRDYCSSTSCPYYYYYGMDV

SEQ ID NO: 23565 - DNA, 24 bp, Artificial Sequence
  Description of Artificial Sequence: Synthetic oligonucleotide
cttatagcagtggcctgtgactac

SEQ ID NO: 23566 - protein, 8 aa, Artificial Sequence
  Description of Artificial Sequence: Synthetic peptide
LIAVACDY

SEQ ID NO: 23567 - DNA, 60 bp, Artificial Sequence; identical to SEQ ID NO: 23555
  Description of Artificial Sequence: Synthetic oligonucleotide

SEQ ID NO: 23568 - protein, 20 aa, Artificial Sequence
  Description of Artificial Sequence: Synthetic peptide
DRDYCSSTSCPYYYYYGMDV

SEQ ID NO: 23569 - DNA, 36 bp, Artificial Sequence; identical to SEQ ID NO: 23291
  Description of Artificial Sequence: Synthetic oligonucleotide

SEQ ID NO: 23570 - protein, 12 aa, Artificial Sequence
  Description of Artificial Sequence: Synthetic peptide
WRGNPTDYGMDV

SEQ ID NO: 23571 - DNA, 60 bp, Artificial Sequence; identical to SEQ ID NO: 23311
  Description of Artificial Sequence: Synthetic oligonucleotide

SEQ ID NO: 23572 - protein, 20 aa, Artificial Sequence
  Description of Artificial Sequence: Synthetic peptide
DRDYCSGGSCPYYYYYGMDV

SEQ ID NO: 23573 - DNA, 63 bp, Artificial Sequence
  Description of Artificial Sequence: Synthetic oligonucleotide
ggagattattactatgatagtagtggtcaccagccttactactactactacggtatggacgtc

SEQ ID NO: 23574 - protein, 21 aa, Artificial Sequence
  Description of Artificial Sequence: Synthetic peptide
GDYYYDSSGHQPYYYYYGMDV

SEQ ID NO: 23575 - DNA, 27 bp, Artificial Sequence
  Description of Artificial Sequence: Synthetic oligonucleotide
aaatcgcagctcgtctactttgactac

SEQ ID NO: 23576 - protein, 9 aa, Artificial Sequence
  Description of Artificial Sequence: Synthetic peptide
KSQLVYFDY

SEQ ID NO: 23577 - DNA, 60 bp, Artificial Sequence
  Description of Artificial Sequence: Synthetic oligonucleotide
gaaaggacgtattgtagtggtaccacctgcccctactactactactacggtctgggcgtc

SEQ ID NO: 23578 - protein, 20 aa, Artificial Sequence
  Description of Artificial Sequence: Synthetic peptide
ERTYCSGTTCPYYYYYGLGV

SEQ ID NO: 23579 - DNA, 24 bp, Artificial Sequence
  Description of Artificial Sequence: Synthetic oligonucleotide
gagaatttttggagtggtgactac

SEQ ID NO: 23580 - protein, 8 aa, Artificial Sequence
  Description of Artificial Sequence: Synthetic peptide
ENFWSGDY

SEQ ID NO: 23581 - DNA, 42 bp, Artificial Sequence; identical to SEQ ID NO: 23455
  Description of Artificial Sequence: Synthetic oligonucleotide

SEQ ID NO: 23582 - protein, 14 aa, Artificial Sequence
  Description of Artificial Sequence: Synthetic peptide
GGPPFSTVTMYFDY

SEQ ID NO: 23583 - DNA, 42 bp, Artificial Sequence; identical to SEQ ID NO: 23455
  Description of Artificial Sequence: Synthetic oligonucleotide

SEQ ID NO: 23584 - protein, 14 aa, Artificial Sequence
  Description of Artificial Sequence: Synthetic peptide
GGPPFSTVTMYFDY

SEQ ID NO: 23585 - DNA, 24 bp, Artificial Sequence
  Description of Artificial Sequence: Synthetic oligonucleotide
attatagcagtggccttccagcat

SEQ ID NO: 23586 - protein, 8 aa, Artificial Sequence
  Description of Artificial Sequence: Synthetic peptide
IIAVAFQH

SEQ ID NO: 23587 - DNA, 27 bp, Artificial Sequence
  Description of Artificial Sequence: Synthetic oligonucleotide
aaagcagcagctgttgcttttgatatc

SEQ ID NO: 23588 - protein, 9 aa, Artificial Sequence
  Description of Artificial Sequence: Synthetic peptide
KAAAVAFDI

SEQ ID NO: 23589 - DNA, 27 bp, Artificial Sequence
  Description of Artificial Sequence: Synthetic oligonucleotide
gattccccactacgaggctttgactac

SEQ ID NO: 23590 - protein, 9 aa, Artificial Sequence
  Description of Artificial Sequence: Synthetic peptide
DSPLRGFDY

SEQ ID NO: 23591 - DNA, 24 bp, Artificial Sequence
  Description of Artificial Sequence: Synthetic oligonucleotide
acgtatagcgggggtatggacgtc

SEQ ID NO: 23592 - protein, 8 aa, Artificial Sequence
  Description of Artificial Sequence: Synthetic peptide
TYSGGMDV

SEQ ID NO: 23593 - DNA, 24 bp, Artificial Sequence
  Description of Artificial Sequence: Synthetic oligonucleotide
gatccgggtggcctctttgactac

SEQ ID NO: 23594 - protein, 8 aa, Artificial Sequence
  Description of Artificial Sequence: Synthetic peptide
DPGGLFDY

SEQ ID NO: 23595 - DNA, 48 bp, Artificial Sequence
  Description of Artificial Sequence: Synthetic oligonucleotide
gataactggaactacggcgatcactactactacttcggtatggacgtc

SEQ ID NO: 23596 - protein, 16 aa, Artificial Sequence
  Description of Artificial Sequence: Synthetic peptide
DNWNYGDHYYYFGMDV

SEQ ID NO: 23597 - DNA, 30 bp, Artificial Sequence
  Description of Artificial Sequence: Synthetic oligonucleotide
tggtactactactactacggtatggacgtc

SEQ ID NO: 23598 - protein, 10 aa, Artificial Sequence
  Description of Artificial Sequence: Synthetic peptide
WYYYYYGMDV

SEQ ID NO: 23599 - DNA, 51 bp, Artificial Sequence
  Description of Artificial Sequence: Synthetic oligonucleotide
gatctggataagaggaactttccttattactactactacggtatggacgtc

SEQ ID NO: 23600 - protein, 17 aa, Artificial Sequence
  Description of Artificial Sequence: Synthetic peptide
DLDKRNFPYYYYYGMDV

SEQ ID NO: 23601 - DNA, 48 bp, Artificial Sequence
  Description of Artificial Sequence: Synthetic oligonucleotide
gataactggaactacggcgattactactactactacggtatggacgtc

SEQ ID NO: 23602 - protein, 16 aa, Artificial Sequence
  Description of Artificial Sequence: Synthetic peptide
DNWNYGDYYYYYGMDV

SEQ ID NO: 23603 - DNA, 45 bp, Artificial Sequence; identical to SEQ ID NO: 20187
  Description of Artificial Sequence: Synthetic oligonucleotide

SEQ ID NO: 23604 - protein, 15 aa, Artificial Sequence
  Description of Artificial Sequence: Synthetic peptide
DRAVAGNYFYYGMDV

SEQ ID NO: 23605 - DNA, 24 bp, Artificial Sequence
  Description of Artificial Sequence: Synthetic oligonucleotide
acgtatagcgggggtatggacgtc

SEQ ID NO: 23606 - protein, 8 aa, Artificial Sequence
  Description of Artificial Sequence: Synthetic peptide
TYSGGMDV

SEQ ID NO: 23607 - DNA, 30 bp, Artificial Sequence; identical to SEQ ID NO: 23597
  Description of Artificial Sequence: Synthetic oligonucleotide

SEQ ID NO: 23608 - protein, 10 aa, Artificial Sequence
  Description of Artificial Sequence: Synthetic peptide
WYYYYYGMDV

SEQ ID NO: 23609 - DNA, 24 bp, Artificial Sequence
  Description of Artificial Sequence: Synthetic oligonucleotide
gatccgggtggcctctttgactac

SEQ ID NO: 23610 - protein, 8 aa, Artificial Sequence
  Description of Artificial Sequence: Synthetic peptide
DPGGLFDY

SEQ ID NO: 23611 - DNA, 48 bp, Artificial Sequence
  Description of Artificial Sequence: Synthetic oligonucleotide
gataactggaactacggcgatcactactactattacggaatggacgtc

SEQ ID NO: 23612 - protein, 16 aa, Artificial Sequence
  Description of Artificial Sequence: Synthetic peptide
DNWNYGDHYYYYGMDV

SEQ ID NO: 23613 - DNA, 24 bp, Artificial Sequence
  Description of Artificial Sequence: Synthetic oligonucleotide
acgtatagcgggggtatggacgtc

SEQ ID NO: 23614 - protein, 8 aa, Artificial Sequence
  Description of Artificial Sequence: Synthetic peptide
TYSGGMDV

SEQ ID NO: 23615 - DNA, 27 bp, Artificial Sequence
  Description of Artificial Sequence: Synthetic oligonucleotide
gatagcagctcgcggggtatggacgtc

SEQ ID NO: 23616 - protein, 9 aa, Artificial Sequence
  Description of Artificial Sequence: Synthetic peptide
DSSSRGMDV

SEQ ID NO: 23617 - DNA, 30 bp, Artificial Sequence
  Description of Artificial Sequence: Synthetic oligonucleotide
aagggagtgggaaccatccactttgactac

SEQ ID NO: 23618 - protein, 10 aa, Artificial Sequence
  Description of Artificial Sequence: Synthetic peptide
KGVGTIHFDY

SEQ ID NO: 23619 - DNA, 27 bp, Artificial Sequence
  Description of Artificial Sequence: Synthetic oligonucleotide
gatagcagctcgcggggtatggacgtc

SEQ ID NO: 23620 - protein, 9 aa, Artificial Sequence
  Description of Artificial Sequence: Synthetic peptide
DSSSRGMDV

SEQ ID NO: 23621 - DNA, 48 bp, Artificial Sequence
  Description of Artificial Sequence: Synthetic oligonucleotide
gataactggaactacggcgatcactactactactacggtatggacgtc

SEQ ID NO: 23622 - protein, 16 aa, Artificial Sequence
  Description of Artificial Sequence: Synthetic peptide
DNWNYGDHYYYYGMDV

SEQ ID NO: 23623 - DNA, 48 bp, Artificial Sequence
  Description of Artificial Sequence: Synthetic oligonucleotide
gataactggaactacggcgatcactactactattacggtatggacgtc

SEQ ID NO: 23624 - protein, 16 aa, Artificial Sequence
  Description of Artificial Sequence: Synthetic peptide
DNWNYGDHYYYYGMDV

SEQ ID NO: 23625 - DNA, 39 bp, Artificial Sequence
  Description of Artificial Sequence: Synthetic oligonucleotide
gaagggtatagcagtggcttttacagggggtttgacaac

SEQ ID NO: 23626 - protein, 13 aa, Artificial Sequence
  Description of Artificial Sequence: Synthetic peptide
EGYSSGFYRGFDN

SEQ ID NO: 23627 - DNA, 54 bp, Artificial Sequence
  Description of Artificial Sequence: Synthetic oligonucleotide
gatcgggtgggaggtactagtcctccttactactactactacggtatggacgtc

SEQ ID NO: 23628 - protein, 18 aa, Artificial Sequence
  Description of Artificial Sequence: Synthetic peptide
DRVGGTSPPYYYYYGMDV

SEQ ID NO: 23629 - DNA, 39 bp, Artificial Sequence
  Description of Artificial Sequence: Synthetic oligonucleotide
gatttctatgatagtggtggagaagggtggttcgacccc

SEQ ID NO: 23630 - protein, 13 aa, Artificial Sequence
  Description of Artificial Sequence: Synthetic peptide
DFYDSGGEGWFDP

SEQ ID NO: 23631 - DNA, 51 bp, Artificial Sequence; identical to SEQ ID NO: 23599
  Description of Artificial Sequence: Synthetic oligonucleotide

SEQ ID NO: 23632 - protein, 17 aa, Artificial Sequence
  Description of Artificial Sequence: Synthetic peptide
DLDKRNFPYYYYYGMDV

SEQ ID NO: 23633 - DNA, 27 bp, Artificial Sequence
  Description of Artificial Sequence: Synthetic oligonucleotide
gacgatcccctctacggaatggacgtc

SEQ ID NO: 23634 - protein, 9 aa, Artificial Sequence
  Description of Artificial Sequence: Synthetic peptide
DDPLYGMDV

SEQ ID NO: 23635 - DNA, 18 bp, Artificial Sequence
  Description of Artificial Sequence: Synthetic oligonucleotide
gggtgggagctaaactac

SEQ ID NO: 23636 - protein, 6 aa, Artificial Sequence
  Description of Artificial Sequence: Synthetic peptide
GWELNY

SEQ ID NO: 23637 - DNA, 27 bp, Artificial Sequence
  Description of Artificial Sequence: Synthetic oligonucleotide
gactccccggtgacaggatttgactat

SEQ ID NO: 23638 - protein, 9 aa, Artificial Sequence
  Description of Artificial Sequence: Synthetic peptide
DSPVTGFDY

SEQ ID NO: 23639 - DNA, 27 bp, Artificial Sequence
  Description of Artificial Sequence: Synthetic oligonucleotide
gatagctccctctacggtatggacgtc

SEQ ID NO: 23640 - protein, 9 aa, Artificial Sequence
  Description of Artificial Sequence: Synthetic peptide
DSSLYGMDV

SEQ ID NO: 23641 - DNA, 18 bp, Artificial Sequence
  Description of Artificial Sequence: Synthetic oligonucleotide
ggatgggagctaaactac

SEQ ID NO: 23642 - protein, 6 aa, Artificial Sequence
  Description of Artificial Sequence: Synthetic peptide
GWELNY

SEQ ID NO: 23643 - DNA, 24 bp, Artificial Sequence
  Description of Artificial Sequence: Synthetic oligonucleotide
gatcccggtggtatctttgactac

SEQ ID NO: 23644 - protein, 8 aa, Artificial Sequence
  Description of Artificial Sequence: Synthetic peptide
DPGGIFDY

SEQ ID NO: 23645 - DNA, 45 bp, Artificial Sequence; identical to SEQ ID NO: 20187
  Description of Artificial Sequence: Synthetic oligonucleotide

SEQ ID NO: 23646 - protein, 15 aa, Artificial Sequence
  Description of Artificial Sequence: Synthetic peptide
DRAVAGNYFYYGMDV

SEQ ID NO: 23647 - DNA, 27 bp, Artificial Sequence
  Description of Artificial Sequence: Synthetic oligonucleotide
gatcactccctctacggtatggacgtc

SEQ ID NO: 23648 - protein, 9 aa, Artificial Sequence
  Description of Artificial Sequence: Synthetic peptide
DHSLYGMDV

SEQ ID NO: 23649 - DNA, 51 bp, Artificial Sequence; identical to SEQ ID NO: 23599
  Description of Artificial Sequence: Synthetic oligonucleotide

SEQ ID NO: 23650 - protein, 17 aa, Artificial Sequence
  Description of Artificial Sequence: Synthetic peptide
DLDKRNFPYYYYYGMDV

SEQ ID NO: 23651 - DNA, 27 bp, Artificial Sequence
  Description of Artificial Sequence: Synthetic oligonucleotide
gatggggctcggcacggtatggacgtc

SEQ ID NO: 23652 - protein, 9 aa, Artificial Sequence
  Description of Artificial Sequence: Synthetic peptide
DGARHGMDV

SEQ ID NO: 23653 - DNA, 51 bp, Artificial Sequence; identical to SEQ ID NO: 23599
  Description of Artificial Sequence: Synthetic oligonucleotide

SEQ ID NO: 23654 - protein, 17 aa, Artificial Sequence
  Description of Artificial Sequence: Synthetic peptide
DLDKRNFPYYYYYGMDV

SEQ ID NO: 23655 - DNA, 30 bp, Artificial Sequence
  Description of Artificial Sequence: Synthetic oligonucleotide
gatagtcgatattttgactggtttgactac

SEQ ID NO: 23656 - protein, 10 aa, Artificial Sequence
  Description of Artificial Sequence: Synthetic peptide
DSRYFDWFDY

SEQ ID NO: 23657 - DNA, 18 bp, Artificial Sequence
  Description of Artificial Sequence: Synthetic oligonucleotide
gggtgggagctaaacaac

SEQ ID NO: 23658 - protein, 6 aa, Artificial Sequence
  Description of Artificial Sequence: Synthetic peptide
GWELNN

SEQ ID NO: 23659 - DNA, 45 bp, Artificial Sequence
  Description of Artificial Sequence: Synthetic oligonucleotide
gcctattactatggttcggggacttattataacgagttcgactac

SEQ ID NO: 23660 - protein, 15 aa, Artificial Sequence
  Description of Artificial Sequence: Synthetic peptide
AYYYGSGTYYNEFDY

SEQ ID NO: 23661 - DNA, 45 bp, Artificial Sequence; identical to SEQ ID NO: 20187
  Description of Artificial Sequence: Synthetic oligonucleotide

SEQ ID NO: 23662 - protein, 15 aa, Artificial Sequence
  Description of Artificial Sequence: Synthetic peptide
DRAVAGNYFYYGMDV

SEQ ID NO: 23663 - DNA, 39 bp, Artificial Sequence
  Description of Artificial Sequence: Synthetic oligonucleotide
gattactatgatactagtggagaagggtggttcgacccc

SEQ ID NO: 23664 - protein, 13 aa, Artificial Sequence
  Description of Artificial Sequence: Synthetic peptide
DYYDTSGEGWFDP

SEQ ID NO: 23665 - DNA, 45 bp, Artificial Sequence
  Description of Artificial Sequence: Synthetic oligonucleotide
gagatagcagtggctgggaactacttctactacggtatgggcgtc

SEQ ID NO: 23666 - protein, 15 aa, Artificial Sequence
  Description of Artificial Sequence: Synthetic peptide
EIAVAGNYFYYGMGV

SEQ ID NO: 23667 - DNA, 48 bp, Artificial Sequence
  Description of Artificial Sequence: Synthetic oligonucleotide
gaaagggggagtagccacagatggggggactactacggaatggacgtc

SEQ ID NO: 23668 - protein, 16 aa, Artificial Sequence
  Description of Artificial Sequence: Synthetic peptide
ERGSSHRWGDYYGMDV

SEQ ID NO: 23669 - DNA, 27 bp, Artificial Sequence
  Description of Artificial Sequence: Synthetic oligonucleotide
gacgatcccctctacggaatggacgtc

SEQ ID NO: 23670 - protein, 9 aa, Artificial Sequence
  Description of Artificial Sequence: Synthetic peptide
DDPLYGMDV

SEQ ID NO: 23671 - DNA, 39 bp, Artificial Sequence
  Description of Artificial Sequence: Synthetic oligonucleotide
gattactatgatagtagtggagaagggtggttcgacccc

SEQ ID NO: 23672 - protein, 13 aa, Artificial Sequence
  Description of Artificial Sequence: Synthetic peptide
DYYDSSGEGWFDP

SEQ ID NO: 23673 - DNA, 39 bp, Artificial Sequence
  Description of Artificial Sequence: Synthetic oligonucleotide
gaagggtttagcagtggcttttacagggggtttgacaac

SEQ ID NO: 23674 - protein, 13 aa, Artificial Sequence
  Description of Artificial Sequence: Synthetic peptide
EGFSSGFYRGFDN

SEQ ID NO: 23675 - DNA, 27 bp, Artificial Sequence
  Description of Artificial Sequence: Synthetic oligonucleotide
gatagcagctcgcggggtatggacgtc

SEQ ID NO: 23676 - protein, 9 aa, Artificial Sequence
  Description of Artificial Sequence: Synthetic peptide
DSSSRGMDV

SEQ ID NO: 23677 - DNA, 39 bp, Artificial Sequence
  Description of Artificial Sequence: Synthetic oligonucleotide
gaagggtatagcagtggcttttacaggggatttgccaac

SEQ ID NO: 23678 - protein, 13 aa, Artificial Sequence
  Description of Artificial Sequence: Synthetic peptide
EGYSSGFYRGFAN

SEQ ID NO: 23679 - DNA, 48 bp, Artificial Sequence; identical to SEQ ID NO: 23667
  Description of Artificial Sequence: Synthetic oligonucleotide

SEQ ID NO: 23680 - protein, 16 aa, Artificial Sequence
  Description of Artificial Sequence: Synthetic peptide
ERGSSHRWGDYYGMDV

SEQ ID NO: 23681 - DNA, 27 bp, Artificial Sequence
  Description of Artificial Sequence: Synthetic oligonucleotide
gatggagcagctctgggtatggacgtc

SEQ ID NO: 23682 - protein, 9 aa, Artificial Sequence
  Description of Artificial Sequence: Synthetic peptide
DGAALGMDV

SEQ ID NO: 23683 - DNA, 30 bp, Artificial Sequence; identical to SEQ ID NO: 23617
  Description of Artificial Sequence: Synthetic oligonucleotide

SEQ ID NO: 23684 - protein, 10 aa, Artificial Sequence
  Description of Artificial Sequence: Synthetic peptide
KGVGTIHFDY

SEQ ID NO: 23685 - DNA, 27 bp, Artificial Sequence
  Description of Artificial Sequence: Synthetic oligonucleotide
gatggagcagctctgggtatggacgtc

SEQ ID NO: 23686 - protein, 9 aa, Artificial Sequence
  Description of Artificial Sequence: Synthetic peptide
DGAALGMDV

SEQ ID NO: 23687 - DNA, 27 bp, Artificial Sequence
  Description of Artificial Sequence: Synthetic oligonucleotide
gatgcagcagcccacggcatggacgtc

SEQ ID NO: 23688 - protein, 9 aa, Artificial Sequence
  Description of Artificial Sequence: Synthetic peptide
DAAAHGMDV

SEQ ID NO: 23689 - DNA, 24 bp, Artificial Sequence
  Description of Artificial Sequence: Synthetic oligonucleotide
gatcctggggggctctttgactac

SEQ ID NO: 23690 - protein, 8 aa, Artificial Sequence
  Description of Artificial Sequence: Synthetic peptide
DPGGLFDY

SEQ ID NO: 23691 - DNA, 27 bp, Artificial Sequence
  Description of Artificial Sequence: Synthetic oligonucleotide
gaaagtgggagctatgctctttatatc

SEQ ID NO: 23692 - protein, 9 aa, Artificial Sequence
  Description of Artificial Sequence: Synthetic peptide
ESGSYALYI

SEQ ID NO: 23693 - DNA, 24 bp, Artificial Sequence
  Description of Artificial Sequence: Synthetic oligonucleotide
gatcctgggggcctctttgactac

SEQ ID NO: 23694 - protein, 8 aa, Artificial Sequence
  Description of Artificial Sequence: Synthetic peptide
DPGGLFDY

SEQ ID NO: 23695 - DNA, 27 bp, Artificial Sequence
  Description of Artificial Sequence: Synthetic oligonucleotide
gaaagtgggagctatgctctttatatc

SEQ ID NO: 23696 - protein, 9 aa, Artificial Sequence
  Description of Artificial Sequence: Synthetic peptide
ESGSYALYI

SEQ ID NO: 23697 - DNA, 27 bp, Artificial Sequence
  Description of Artificial Sequence: Synthetic oligonucleotide
gagggtgggagctaccaccttgactac

SEQ ID NO: 23698 - protein, 9 aa, Artificial Sequence
  Description of Artificial Sequence: Synthetic peptide
EGGSYHLDY

SEQ ID NO: 23699 - DNA, 27 bp, Artificial Sequence
  Description of Artificial Sequence: Synthetic oligonucleotide
gatgatgggagctactactttgactac

SEQ ID NO: 23700 - protein, 9 aa, Artificial Sequence
  Description of Artificial Sequence: Synthetic peptide
DDGSYYFDY

SEQ ID NO: 23701 - DNA, 27 bp, Artificial Sequence
  Description of Artificial Sequence: Synthetic oligonucleotide
gagggtgggagctaccaccttgactac

SEQ ID NO: 23702 - protein, 9 aa, Artificial Sequence
  Description of Artificial Sequence: Synthetic peptide
EGGSYHLDY

SEQ ID NO: 23703 - DNA, 27 bp, Artificial Sequence
  Description of Artificial Sequence: Synthetic oligonucleotide
gatgagccattgaccggtatggacgtc

SEQ ID NO: 23704 - protein, 9 aa, Artificial Sequence
  Description of Artificial Sequence: Synthetic peptide
DEPLTGMDV

SEQ ID NO: 23705 - DNA, 21 bp, Artificial Sequence
  Description of Artificial Sequence: Synthetic oligonucleotide
gggtatgactcgttcgccccc

SEQ ID NO: 23706 - protein, 7 aa, Artificial Sequence
  Description of Artificial Sequence: Synthetic peptide
GYDSFAP

SEQ ID NO: 23707 - DNA, 30 bp, Artificial Sequence
  Description of Artificial Sequence: Synthetic oligonucleotide
ggggactggaaccccgagggtttggacgtc

SEQ ID NO: 23708 - protein, 10 aa, Artificial Sequence
  Description of Artificial Sequence: Synthetic peptide
GDWNPEGLDV

SEQ ID NO: 23709 - DNA, 30 bp, Artificial Sequence
  Description of Artificial Sequence: Synthetic oligonucleotide
ggggactggaaccccgagggtatggacgtc

SEQ ID NO: 23710 - protein, 10 aa, Artificial Sequence
  Description of Artificial Sequence: Synthetic peptide
GDWNPEGMDV

SEQ ID NO: 23711 - DNA, 30 bp, Artificial Sequence; identical to SEQ ID NO: 23707
  Description of Artificial Sequence: Synthetic oligonucleotide

SEQ ID NO: 23712 - protein, 10 aa, Artificial Sequence
  Description of Artificial Sequence: Synthetic peptide
GDWNPEGLDV

SEQ ID NO: 23713 - DNA, 27 bp, Artificial Sequence
  Description of Artificial Sequence: Synthetic oligonucleotide
gatcctgggagctacgggttcgacccc

SEQ ID NO: 23714 - protein, 9 aa, Artificial Sequence
  Description of Artificial Sequence: Synthetic peptide
DPGSYGFDP

SEQ ID NO: 23715 - DNA, 33 bp, Artificial Sequence
  Description of Artificial Sequence: Synthetic oligonucleotide
ggcctctctgtctactactacggtatgggcgtc

SEQ ID NO: 23716 - protein, 11 aa, Artificial Sequence
  Description of Artificial Sequence: Synthetic peptide
GLSVYYYGMGV

SEQ ID NO: 23717 - DNA, 30 bp, Artificial Sequence; identical to SEQ ID NO: 23707
  Description of Artificial Sequence: Synthetic oligonucleotide

SEQ ID NO: 23718 - protein, 10 aa, Artificial Sequence
  Description of Artificial Sequence: Synthetic peptide
GDWNPEGLDV

SEQ ID NO: 23719 - DNA, 27 bp, Artificial Sequence
  Description of Artificial Sequence: Synthetic oligonucleotide
gatgggccattgagcggtatggacgtc

SEQ ID NO: 23720 - protein, 9 aa, Artificial Sequence
  Description of Artificial Sequence: Synthetic peptide
DGPLSGMDV

SEQ ID NO: 23721 - DNA, 27 bp, Artificial Sequence
  Description of Artificial Sequence: Synthetic oligonucleotide
gattcagcagtgtacaatatggacgtc

SEQ ID NO: 23722 - protein, 9 aa, Artificial Sequence
  Description of Artificial Sequence: Synthetic peptide
DSAVYNMDV

SEQ ID NO: 23723 - DNA, 27 bp, Artificial Sequence
  Description of Artificial Sequence: Synthetic oligonucleotide
gattcagcagtgtacggtatggacgtc

SEQ ID NO: 23724 - protein, 9 aa, Artificial Sequence
  Description of Artificial Sequence: Synthetic peptide
DSAVYGMDV

SEQ ID NO: 23725 - DNA, 30 bp, Artificial Sequence; identical to SEQ ID NO: 23709
  Description of Artificial Sequence: Synthetic oligonucleotide

SEQ ID NO: 23726 - protein, 10 aa, Artificial Sequence
  Description of Artificial Sequence: Synthetic peptide
GDWNPEGMDV

SEQ ID NO: 23727 - DNA, 30 bp, Artificial Sequence; identical to SEQ ID NO: 23709
  Description of Artificial Sequence: Synthetic oligonucleotide

SEQ ID NO: 23728 - protein, 10 aa, Artificial Sequence
  Description of Artificial Sequence: Synthetic peptide
GDWNPEGMDV

SEQ ID NO: 23729 - DNA, 30 bp, Artificial Sequence; identical to SEQ ID NO: 23707
  Description of Artificial Sequence: Synthetic oligonucleotide

SEQ ID NO: 23730 - protein, 10 aa, Artificial Sequence
  Description of Artificial Sequence: Synthetic peptide
GDWNPEGLDV

SEQ ID NO: 23731 - DNA, 30 bp, Artificial Sequence
  Description of Artificial Sequence: Synthetic oligonucleotide
ggagactggaaccccgagggtttggacgtc

SEQ ID NO: 23732 - protein, 10 aa, Artificial Sequence
  Description of Artificial Sequence: Synthetic peptide
GDWNPEGLDV

SEQ ID NO: 23733 - DNA, 27 bp, Artificial Sequence
  Description of Artificial Sequence: Synthetic oligonucleotide
gattcagcagtgtacggtatggacgtc

SEQ ID NO: 23734 - protein, 9 aa, Artificial Sequence
  Description of Artificial Sequence: Synthetic peptide
DSAVYGMDV

SEQ ID NO: 23735 - DNA, 27 bp, Artificial Sequence
  Description of Artificial Sequence: Synthetic oligonucleotide
gatagcagctcctacggtatggacgtc

SEQ ID NO: 23736 - protein, 9 aa, Artificial Sequence
  Description of Artificial Sequence: Synthetic peptide
DSSSYGMDV

SEQ ID NO: 23737 - DNA, 30 bp, Artificial Sequence; identical to SEQ ID NO: 23709
  Description of Artificial Sequence: Synthetic oligonucleotide

SEQ ID NO: 23738 - protein, 10 aa, Artificial Sequence
  Description of Artificial Sequence: Synthetic peptide
GDWNPEGMDV

SEQ ID NO: 23739 - DNA, 30 bp, Artificial Sequence; identical to SEQ ID NO: 23709
  Description of Artificial Sequence: Synthetic oligonucleotide

SEQ ID NO: 23740 - protein, 10 aa, Artificial Sequence
  Description of Artificial Sequence: Synthetic peptide
GDWNPEGMDV

SEQ ID NO: 23741 - DNA, 27 bp, Artificial Sequence
  Description of Artificial Sequence: Synthetic oligonucleotide
gattcagcagtgtacaatatggacgtc

SEQ ID NO: 23742 - protein, 9 aa, Artificial Sequence
  Description of Artificial Sequence: Synthetic peptide
DSAVYNMDV

SEQ ID NO: 23743 - DNA, 21 bp, Artificial Sequence
  Description of Artificial Sequence: Synthetic oligonucleotide
gggtatgattcgttcgccccc

SEQ ID NO: 23744 - protein, 7 aa, Artificial Sequence
  Description of Artificial Sequence: Synthetic peptide
GYDSFAP

SEQ ID NO: 23745 - DNA, 27 bp, Artificial Sequence
  Description of Artificial Sequence: Synthetic oligonucleotide
gatagcagctcctacggtatggacgtc

SEQ ID NO: 23746 - protein, 9 aa, Artificial Sequence
  Description of Artificial Sequence: Synthetic peptide
DSSSYGMDV

SEQ ID NO: 23747 - DNA, 33 bp, Artificial Sequence
  Description of Artificial Sequence: Synthetic oligonucleotide
gcaaggggatatcactacagtatctttgactac

SEQ ID NO: 23748 - protein, 11 aa, Artificial Sequence
  Description of Artificial Sequence: Synthetic peptide
ARGYHYSIFDY

SEQ ID NO: 23749 - DNA, 27 bp, Artificial Sequence
  Description of Artificial Sequence: Synthetic oligonucleotide
gatggggctgcggagggtatggacgtc

SEQ ID NO: 23750 - protein, 9 aa, Artificial Sequence
  Description of Artificial Sequence: Synthetic peptide
DGAAEGMDV

SEQ ID NO: 23751 - DNA, 27 bp, Artificial Sequence
  Description of Artificial Sequence: Synthetic oligonucleotide
gattcagcagtgtacggtatggacgtc

SEQ ID NO: 23752 - protein, 9 aa, Artificial Sequence
  Description of Artificial Sequence: Synthetic peptide
DSAVYGMDV

SEQ ID NO: 23753 - DNA, 24 bp, Artificial Sequence
  Description of Artificial Sequence: Synthetic oligonucleotide
gatccgggggggatctttgactac

SEQ ID NO: 23754 - protein, 8 aa, Artificial Sequence
  Description of Artificial Sequence: Synthetic peptide
DPGGIFDY

SEQ ID NO: 23755 - DNA, 30 bp, Artificial Sequence; identical to SEQ ID NO: 23709
  Description of Artificial Sequence: Synthetic oligonucleotide

SEQ ID NO: 23756 - protein, 10 aa, Artificial Sequence
  Description of Artificial Sequence: Synthetic peptide
GDWNPEGMDV

SEQ ID NO: 23757 - DNA, 27 bp, Artificial Sequence
  Description of Artificial Sequence: Synthetic oligonucleotide
gattcagcagtgtacggtatggacgtc

SEQ ID NO: 23758 - protein, 9 aa, Artificial Sequence
  Description of Artificial Sequence: Synthetic peptide
DSAVYGMDV

SEQ ID NO: 23759 - DNA, 30 bp, Artificial Sequence; identical to SEQ ID NO: 23707
  Description of Artificial Sequence: Synthetic oligonucleotide

SEQ ID NO: 23760 - protein, 10 aa, Artificial Sequence
  Description of Artificial Sequence: Synthetic peptide
GDWNPEGLDV

SEQ ID NO: 23761 - DNA, 27 bp, Artificial Sequence
  Description of Artificial Sequence: Synthetic oligonucleotide
gattcagcagtgtacggtatggacgtc

SEQ ID NO: 23762 - protein, 9 aa, Artificial Sequence
  Description of Artificial Sequence: Synthetic peptide
DSAVYGMDV

SEQ ID NO: 23763 - DNA, 27 bp, Artificial Sequence
  Description of Artificial Sequence: Synthetic oligonucleotide
gatggggctgcggagggtttggacgtc

SEQ ID NO: 23764 - protein, 9 aa, Artificial Sequence
  Description of Artificial Sequence: Synthetic peptide
DGAAEGLDV

SEQ ID NO: 23765 - DNA, 30 bp, Artificial Sequence
  Description of Artificial Sequence: Synthetic oligonucleotide
gatctgggactgggatacttctttgactac

SEQ ID NO: 23766 - protein, 10 aa, Artificial Sequence
  Description of Artificial Sequence: Synthetic peptide
DLGLGYFFDY

SEQ ID NO: 23767 - DNA, 30 bp, Artificial Sequence; identical to SEQ ID NO: 23709
  Description of Artificial Sequence: Synthetic oligonucleotide

SEQ ID NO: 23768 - protein, 10 aa, Artificial Sequence
  Description of Artificial Sequence: Synthetic peptide
GDWNPEGMDV

SEQ ID NO: 23769 - DNA, 33 bp, Artificial Sequence
  Description of Artificial Sequence: Synthetic oligonucleotide
ggcctatctgtctactactacggtatggacgtc

SEQ ID NO: 23770 - protein, 11 aa, Artificial Sequence
  Description of Artificial Sequence: Synthetic peptide
GLSVYYYGMDV

SEQ ID NO: 23771 - DNA, 33 bp, Artificial Sequence
  Description of Artificial Sequence: Synthetic oligonucleotide
ggcctctctgtctactactacggtatggacgtc

SEQ ID NO: 23772 - protein, 11 aa, Artificial Sequence
  Description of Artificial Sequence: Synthetic peptide
GLSVYYYGMDV

SEQ ID NO: 23773 - DNA, 30 bp, Artificial Sequence
  Description of Artificial Sequence: Synthetic oligonucleotide
tggtactactattactacggtatggacgtc

SEQ ID NO: 23774 - protein, 10 aa, Artificial Sequence
  Description of Artificial Sequence: Synthetic peptide
WYYYYYGMDV

SEQ ID NO: 23775 - DNA, 33 bp, Artificial Sequence; identical to SEQ ID NO: 23769
  Description of Artificial Sequence: Synthetic oligonucleotide

SEQ ID NO: 23776 - protein, 11 aa, Artificial Sequence
  Description of Artificial Sequence: Synthetic peptide
GLSVYYYGMDV

SEQ ID NO: 23777 - DNA, 30 bp, Artificial Sequence; identical to SEQ ID NO: 23709
  Description of Artificial Sequence: Synthetic oligonucleotide

SEQ ID NO: 23778 - protein, 10 aa, Artificial Sequence
  Description of Artificial Sequence: Synthetic peptide
GDWNPEGMDV

SEQ ID NO: 23779 - DNA, 30 bp, Artificial Sequence; identical to SEQ ID NO: 23709
  Description of Artificial Sequence: Synthetic oligonucleotide

SEQ ID NO: 23780 - protein, 10 aa, Artificial Sequence
  Description of Artificial Sequence: Synthetic peptide
GDWNPEGMDV

SEQ ID NO: 23781 - DNA, 30 bp, Artificial Sequence; identical to SEQ ID NO: 23709
  Description of Artificial Sequence: Synthetic oligonucleotide

SEQ ID NO: 23782 - protein, 10 aa, Artificial Sequence
  Description of Artificial Sequence: Synthetic peptide
GDWNPEGMDV

SEQ ID NO: 23783 - DNA, 57 bp, Artificial Sequence
  Description of Artificial Sequence: Synthetic oligonucleotide
gaggggggcctaggatattgtagtagtaccagctgctatggaggctggttcgacccc

SEQ ID NO: 23784 - protein, 19 aa, Artificial Sequence
  Description of Artificial Sequence: Synthetic peptide
EGGLGYCSSTSCYGGWFDP

SEQ ID NO: 23785 - DNA, 39 bp, Artificial Sequence
  Description of Artificial Sequence: Synthetic oligonucleotide
ggagcgtttgattacttctactactacgctatggacgtc

SEQ ID NO: 23786 - protein, 13 aa, Artificial Sequence
  Description of Artificial Sequence: Synthetic peptide
GAFDYFYYYAMDV

SEQ ID NO: 23787 - DNA, 63 bp, Artificial Sequence
  Description of Artificial Sequence: Synthetic oligonucleotide
gataaccactattgtagtagtaccagctgctccccatactactactacttcggtatggacgtc

SEQ ID NO: 23788 - protein, 21 aa, Artificial Sequence
  Description of Artificial Sequence: Synthetic peptide
DNHYCSSTSCSPYYYYFGMDV

SEQ ID NO: 23789 - DNA, 60 bp, Artificial Sequence
  Description of Artificial Sequence: Synthetic oligonucleotide
gatcgggaatattgtactagtaccagctgcccttactactactactacggtatggacgtc

SEQ ID NO: 23790 - protein, 20 aa, Artificial Sequence
  Description of Artificial Sequence: Synthetic peptide
DREYCTSTSCPYYYYYGMDV

SEQ ID NO: 23791 - DNA, 45 bp, Artificial Sequence
  Description of Artificial Sequence: Synthetic oligonucleotide
gggacttactatggttcggggagttattttaacgaacttgactcc

SEQ ID NO: 23792 - protein, 15 aa, Artificial Sequence
  Description of Artificial Sequence: Synthetic peptide
GTYYGSGSYFNELDS

SEQ ID NO: 23793 - DNA, 45 bp, Artificial Sequence
  Description of Artificial Sequence: Synthetic oligonucleotide
ggatattactatggttcggggagttattataactggttcgactcc

SEQ ID NO: 23794 - protein, 15 aa, Artificial Sequence
  Description of Artificial Sequence: Synthetic peptide
GYYYGSGSYYNWFDS

SEQ ID NO: 23795 - DNA, 39 bp, Artificial Sequence
  Description of Artificial Sequence: Synthetic oligonucleotide
ggagcgtttgattactactactactacgctttggacgtc

SEQ ID NO: 23796 - protein, 13 aa, Artificial Sequence
  Description of Artificial Sequence: Synthetic peptide
GAFDYYYYYALDV

SEQ ID NO: 23797 - DNA, 45 bp, Artificial Sequence; identical to SEQ ID NO: 23791
  Description of Artificial Sequence: Synthetic oligonucleotide

SEQ ID NO: 23798 - protein, 15 aa, Artificial Sequence
  Description of Artificial Sequence: Synthetic peptide
GTYYGSGSYFNELDS

SEQ ID NO: 23799 - DNA, 39 bp, Artificial Sequence
  Description of Artificial Sequence: Synthetic oligonucleotide
ggagcgtttgattacttctactactacggtatggacgtc

SEQ ID NO: 23800 - protein, 13 aa, Artificial Sequence
  Description of Artificial Sequence: Synthetic peptide
GAFDYFYYYGMDV

SEQ ID NO: 23801 - DNA, 57 bp, Artificial Sequence; identical to SEQ ID NO: 20751
  Description of Artificial Sequence: Synthetic oligonucleotide

SEQ ID NO: 23802 - protein, 19 aa, Artificial Sequence
  Description of Artificial Sequence: Synthetic peptide
EYCGGDCYSPYYYYYGMDV

SEQ ID NO: 23803 - DNA, 39 bp, Artificial Sequence; identical to SEQ ID NO: 23799
  Description of Artificial Sequence: Synthetic oligonucleotide

SEQ ID NO: 23804 - protein, 13 aa, Artificial Sequence
  Description of Artificial Sequence: Synthetic peptide
GAFDYFYYYGMDV

SEQ ID NO: 23805 - DNA, 27 bp, Artificial Sequence
  Description of Artificial Sequence: Synthetic oligonucleotide
aggggacagcagctggccctcgactac

SEQ ID NO: 23806 - protein, 9 aa, Artificial Sequence
  Description of Artificial Sequence: Synthetic peptide
RGQQLALDY

SEQ ID NO: 23807 - DNA, 39 bp, Artificial Sequence
  Description of Artificial Sequence: Synthetic oligonucleotide
agagagacgtataactggaactacgaagggtttgactac

SEQ ID NO: 23808 - protein, 13 aa, Artificial Sequence
  Description of Artificial Sequence: Synthetic peptide
RETYNWNYEGFDY

SEQ ID NO: 23809 - DNA, 18 bp, Artificial Sequence
  Description of Artificial Sequence: Synthetic oligonucleotide
gtgactgcttttgactac

SEQ ID NO: 23810 - protein, 6 aa, Artificial Sequence
  Description of Artificial Sequence: Synthetic peptide
VTAFDY

SEQ ID NO: 23811 - DNA, 18 bp, Artificial Sequence
  Description of Artificial Sequence: Synthetic oligonucleotide
actggggtctttgactac

SEQ ID NO: 23812 - protein, 6 aa, Artificial Sequence
  Description of Artificial Sequence: Synthetic peptide
TGVFDY

SEQ ID NO: 23813 - DNA, 18 bp, Artificial Sequence
  Description of Artificial Sequence: Synthetic oligonucleotide
gtggcctcctttgactac

SEQ ID NO: 23814 - protein, 6 aa, Artificial Sequence
  Description of Artificial Sequence: Synthetic peptide
VASFDY

SEQ ID NO: 23815 - DNA, 24 bp, Artificial Sequence
  Description of Artificial Sequence: Synthetic oligonucleotide
acctatagtgggagcctggacgtc

SEQ ID NO: 23816 - protein, 8 aa, Artificial Sequence
  Description of Artificial Sequence: Synthetic peptide
TYSGSLDV

SEQ ID NO: 23817 - DNA, 36 bp, Artificial Sequence; identical to SEQ ID NO: 21545
  Description of Artificial Sequence: Synthetic oligonucleotide

SEQ ID NO: 23818 - protein, 12 aa, Artificial Sequence
  Description of Artificial Sequence: Synthetic peptide
FFGVVGVGCFDY

SEQ ID NO: 23819 - DNA, 24 bp, Artificial Sequence
  Description of Artificial Sequence: Synthetic oligonucleotide
gggggttcgagggggttcgacccc

SEQ ID NO: 23820 - protein, 8 aa, Artificial Sequence
  Description of Artificial Sequence: Synthetic peptide
GGSRGFDP

SEQ ID NO: 23821 - DNA, 36 bp, Artificial Sequence
  Description of Artificial Sequence: Synthetic oligonucleotide
gttatagcagtggctggagggcactttttcgacccc

SEQ ID NO: 23822 - protein, 12 aa, Artificial Sequence
  Description of Artificial Sequence: Synthetic peptide
VIAVAGGHFFDP

SEQ ID NO: 23823 - DNA, 24 bp, Artificial Sequence
  Description of Artificial Sequence: Synthetic oligonucleotide
gatgggagcagtggctttgactac

SEQ ID NO: 23824 - protein, 8 aa, Artificial Sequence
  Description of Artificial Sequence: Synthetic peptide
DGSSGFDY

SEQ ID NO: 23825 - DNA, 48 bp, Artificial Sequence; identical to SEQ ID NO: 21761
  Description of Artificial Sequence: Synthetic oligonucleotide

SEQ ID NO: 23826 - protein, 16 aa, Artificial Sequence
  Description of Artificial Sequence: Synthetic peptide
EFPYSGSYLYYYGMDV

SEQ ID NO: 23827 - DNA, 36 bp, Artificial Sequence; identical to SEQ ID NO: 23291
  Description of Artificial Sequence: Synthetic oligonucleotide

SEQ ID NO: 23828 - protein, 12 aa, Artificial Sequence
  Description of Artificial Sequence: Synthetic peptide
WRGNPTDYGMDV

SEQ ID NO: 23829 - DNA, 36 bp, Artificial Sequence; identical to SEQ ID NO: 23291
  Description of Artificial Sequence: Synthetic oligonucleotide

SEQ ID NO: 23830 - protein, 12 aa, Artificial Sequence
  Description of Artificial Sequence: Synthetic peptide
WRGNPTDYGMDV

SEQ ID NO: 23831 - DNA, 51 bp, Artificial Sequence; identical to SEQ ID NO: 20121
  Description of Artificial Sequence: Synthetic oligonucleotide

SEQ ID NO: 23832 - protein, 17 aa, Artificial Sequence
  Description of Artificial Sequence: Synthetic peptide
DRVEGSGTPYYYYGMDV

SEQ ID NO: 23833 - DNA, 51 bp, Artificial Sequence; identical to SEQ ID NO: 20121
  Description of Artificial Sequence: Synthetic oligonucleotide

SEQ ID NO: 23834 - protein, 17 aa, Artificial Sequence
  Description of Artificial Sequence: Synthetic peptide
DRVEGSGTPYYYYGMDV

SEQ ID NO: 23835 - DNA, 60 bp, Artificial Sequence
  Description of Artificial Sequence: Synthetic oligonucleotide
gatcgggattattgtagtggtggtaactgcccttactactactactacggtatggacgtc

SEQ ID NO: 23836 - protein, 20 aa, Artificial Sequence
  Description of Artificial Sequence: Synthetic peptide
DRDYCSGGNCPYYYYYGMDV

SEQ ID NO: 23837 - DNA, 39 bp, Artificial Sequence
  Description of Artificial Sequence: Synthetic oligonucleotide
gggggggctacggtgactacgtggggggtctttgactac

SEQ ID NO: 23838 - protein, 13 aa, Artificial Sequence
  Description of Artificial Sequence: Synthetic peptide
GGATVTTWGVFDY

SEQ ID NO: 23839 - DNA, 36 bp, Artificial Sequence; identical to SEQ ID NO: 23453
  Description of Artificial Sequence: Synthetic oligonucleotide

SEQ ID NO: 23840 - protein, 12 aa, Artificial Sequence
  Description of Artificial Sequence: Synthetic peptide
DSRKGFYYGLDV

SEQ ID NO: 23841 - DNA, 39 bp, Artificial Sequence; identical to SEQ ID NO: 22457
  Description of Artificial Sequence: Synthetic oligonucleotide

SEQ ID NO: 23842 - protein, 13 aa, Artificial Sequence
  Description of Artificial Sequence: Synthetic peptide
GGTTVATWGVFDY

SEQ ID NO: 23843 - DNA, 39 bp, Artificial Sequence; identical to SEQ ID NO: 22457
  Description of Artificial Sequence: Synthetic oligonucleotide

SEQ ID NO: 23844 - protein, 13 aa, Artificial Sequence
  Description of Artificial Sequence: Synthetic peptide
GGTTVATWGVFDY

SEQ ID NO: 23845 - DNA, 57 bp, Artificial Sequence
  Description of Artificial Sequence: Synthetic oligonucleotide
gcatattgtggtggtgactgctatttcccccatctccattactacggtatggacgtc

SEQ ID NO: 23846 - protein, 19 aa, Artificial Sequence
  Description of Artificial Sequence: Synthetic peptide
AYCGGDCYFPHLHYYGMDV

SEQ ID NO: 23847 - DNA, 39 bp, Artificial Sequence; identical to SEQ ID NO: 22521
  Description of Artificial Sequence: Synthetic oligonucleotide

SEQ ID NO: 23848 - protein, 13 aa, Artificial Sequence
  Description of Artificial Sequence: Synthetic peptide
GGTTVTTWGVFDY

SEQ ID NO: 23849 - DNA, 33 bp, Artificial Sequence; identical to SEQ ID NO: 22817
  Description of Artificial Sequence: Synthetic oligonucleotide

SEQ ID NO: 23850 - protein, 11 aa, Artificial Sequence
  Description of Artificial Sequence: Synthetic peptide
DRSKGYDGMDV

SEQ ID NO: 23851 - DNA, 24 bp, Artificial Sequence
  Description of Artificial Sequence: Synthetic oligonucleotide
gaagtgggttggcttgatgactac

SEQ ID NO: 23852 - protein, 8 aa, Artificial Sequence
  Description of Artificial Sequence: Synthetic peptide
EVGWLDDY

SEQ ID NO: 23853 - DNA, 45 bp, Artificial Sequence
  Description of Artificial Sequence: Synthetic oligonucleotide
gctggtggaactacggggagctactactacaacggtatggacgtc

SEQ ID NO: 23854 - protein, 15 aa, Artificial Sequence
  Description of Artificial Sequence: Synthetic peptide
AGGTTGSYYYNGMDV

SEQ ID NO: 23855 - DNA, 42 bp, Artificial Sequence; identical to SEQ ID NO: 20145
  Description of Artificial Sequence: Synthetic oligonucleotide

SEQ ID NO: 23856 - protein, 14 aa, Artificial Sequence
  Description of Artificial Sequence: Synthetic peptide
ERYSSGLYDYGMDV

SEQ ID NO: 23857 - DNA, 42 bp, Artificial Sequence; identical to SEQ ID NO: 20145
  Description of Artificial Sequence: Synthetic oligonucleotide

SEQ ID NO: 23858 - protein, 14 aa, Artificial Sequence
  Description of Artificial Sequence: Synthetic peptide
ERYSSGLYDYGMDV

SEQ ID NO: 23859 - DNA, 27 bp, Artificial Sequence
  Description of Artificial Sequence: Synthetic oligonucleotide
gattcccctgacagggggtttgactac

SEQ ID NO: 23860 - protein, 9 aa, Artificial Sequence
  Description of Artificial Sequence: Synthetic peptide
DSPDRGFDY

SEQ ID NO: 23861 - DNA, 36 bp, Artificial Sequence; identical to SEQ ID NO: 20457
  Description of Artificial Sequence: Synthetic oligonucleotide

SEQ ID NO: 23862 - protein, 12 aa, Artificial Sequence
  Description of Artificial Sequence: Synthetic peptide
RGYSYGGYGMDV

SEQ ID NO: 23863 - DNA, 48 bp, Artificial Sequence; identical to SEQ ID NO: 21761
  Description of Artificial Sequence: Synthetic oligonucleotide

SEQ ID NO: 23864 - protein, 16 aa, Artificial Sequence
  Description of Artificial Sequence: Synthetic peptide
EFPYSGSYLYYYGMDV

SEQ ID NO: 23865 - DNA, 27 bp, Artificial Sequence
  Description of Artificial Sequence: Synthetic oligonucleotide
agtagtggctggtactggttcgacccc

SEQ ID NO: 23866 - protein, 9 aa, Artificial Sequence
  Description of Artificial Sequence: Synthetic peptide
SSGWYWFDP

SEQ ID NO: 23867 - DNA, 21 bp, Artificial Sequence
  Description of Artificial Sequence: Synthetic oligonucleotide
gactacggcggtatggacgtc

SEQ ID NO: 23868 - protein, 7 aa, Artificial Sequence
  Description of Artificial Sequence: Synthetic peptide
DYGGMDV

SEQ ID NO: 23869 - DNA, 39 bp, Artificial Sequence
  Description of Artificial Sequence: Synthetic oligonucleotide
gatcggttagtgggagctacggttgatgcttttgatatc

SEQ ID NO: 23870 - protein, 13 aa, Artificial Sequence
  Description of Artificial Sequence: Synthetic peptide
DRLVGATVDAFDI

SEQ ID NO: 23871 - DNA, 21 bp, Artificial Sequence
  Description of Artificial Sequence: Synthetic oligonucleotide
gactacggcggtatggacgtc

SEQ ID NO: 23872 - protein, 7 aa, Artificial Sequence
  Description of Artificial Sequence: Synthetic peptide
DYGGMDV

SEQ ID NO: 23873 - DNA, 21 bp, Artificial Sequence
  Description of Artificial Sequence: Synthetic oligonucleotide
gactacggcggtatggacgtc

SEQ ID NO: 23874 - protein, 7 aa, Artificial Sequence
  Description of Artificial Sequence: Synthetic peptide
DYGGMDV

SEQ ID NO: 23875 - DNA, 24 bp, Artificial Sequence
  Description of Artificial Sequence: Synthetic oligonucleotide
cttatagcagtggcctttgactac

SEQ ID NO: 23876 - protein, 8 aa, Artificial Sequence
  Description of Artificial Sequence: Synthetic peptide
LIAVAFDY

SEQ ID NO: 23877 - DNA, 21 bp, Artificial Sequence
  Description of Artificial Sequence: Synthetic oligonucleotide
gactacggtgggcttgactac

SEQ ID NO: 23878 - protein, 7 aa, Artificial Sequence
  Description of Artificial Sequence: Synthetic peptide
DYGGLDY

SEQ ID NO: 23879 - DNA, 21 bp, Artificial Sequence
  Description of Artificial Sequence: Synthetic oligonucleotide
gactacggcggtatggacgtc

SEQ ID NO: 23880 - protein, 7 aa, Artificial Sequence
  Description of Artificial Sequence: Synthetic peptide
DYGGMDV

SEQ ID NO: 23881 - DNA, 27 bp, Artificial Sequence
  Description of Artificial Sequence: Synthetic oligonucleotide
cttgactctaactggggtcttgactac

SEQ ID NO: 23882 - protein, 9 aa, Artificial Sequence
  Description of Artificial Sequence: Synthetic peptide
LDSNWGLDY

SEQ ID NO: 23883 - DNA, 21 bp, Artificial Sequence
  Description of Artificial Sequence: Synthetic oligonucleotide
gactacggcggtatggacgtc

SEQ ID NO: 23884 - protein, 7 aa, Artificial Sequence
  Description of Artificial Sequence: Synthetic peptide
DYGGMDV

SEQ ID NO: 23885 - DNA, 27 bp, Artificial Sequence
  Description of Artificial Sequence: Synthetic oligonucleotide
accagtggctggaacttctttgactac

SEQ ID NO: 23886 - protein, 9 aa, Artificial Sequence
  Description of Artificial Sequence: Synthetic peptide
TSGWNFFDY

SEQ ID NO: 23887 - DNA, 27 bp, Artificial Sequence
  Description of Artificial Sequence: Synthetic oligonucleotide
tccagtggctggtactggttcgacccc

SEQ ID NO: 23888 - protein, 9 aa, Artificial Sequence
  Description of Artificial Sequence: Synthetic peptide
SSGWYWFDP

SEQ ID NO: 23889 - DNA, 27 bp, Artificial Sequence
  Description of Artificial Sequence: Synthetic oligonucleotide
agcagtggctggtactggttcgacccc

SEQ ID NO: 23890 - protein, 9 aa, Artificial Sequence
  Description of Artificial Sequence: Synthetic peptide
SSGWYWFDP

SEQ ID NO: 23891 - DNA, 21 bp, Artificial Sequence
  Description of Artificial Sequence: Synthetic oligonucleotide
gactacggcggtatggacgtc

SEQ ID NO: 23892 - protein, 7 aa, Artificial Sequence
  Description of Artificial Sequence: Synthetic peptide
DYGGMDV

SEQ ID NO: 23893 - DNA, 51 bp, Artificial Sequence; identical to SEQ ID NO: 21773
  Description of Artificial Sequence: Synthetic oligonucleotide

SEQ ID NO: 23894 - protein, 17 aa, Artificial Sequence
  Description of Artificial Sequence: Synthetic peptide
VLDYGDSLGYYYYGMDV

SEQ ID NO: 23895 - DNA, 24 bp, Artificial Sequence
  Description of Artificial Sequence: Synthetic oligonucleotide
cttatagcagtggcctttgactac

SEQ ID NO: 23896 - protein, 8 aa, Artificial Sequence
  Description of Artificial Sequence: Synthetic peptide
LIAVAFDY

SEQ ID NO: 23897 - DNA, 27 bp, Artificial Sequence
  Description of Artificial Sequence: Synthetic oligonucleotide
tccagtggctggtactggttcgacccc

SEQ ID NO: 23898 - protein, 9 aa, Artificial Sequence
  Description of Artificial Sequence: Synthetic peptide
SSGWYWFDP

SEQ ID NO: 23899 - DNA, 21 bp, Artificial Sequence
  Description of Artificial Sequence: Synthetic oligonucleotide
gtgggagctactacggactac

SEQ ID NO: 23900 - protein, 7 aa, Artificial Sequence
  Description of Artificial Sequence: Synthetic peptide
VGATTDY

SEQ ID NO: 23901 - DNA, 30 bp, Artificial Sequence; identical to SEQ ID NO: 23709
  Description of Artificial Sequence: Synthetic oligonucleotide

SEQ ID NO: 23902 - protein, 10 aa, Artificial Sequence
  Description of Artificial Sequence: Synthetic peptide
GDWNPEGMDV

SEQ ID NO: 23903 - DNA, 27 bp, Artificial Sequence
  Description of Artificial Sequence: Synthetic oligonucleotide
agcagtggctggtactactttgactac

SEQ ID NO: 23904 - protein, 9 aa, Artificial Sequence
  Description of Artificial Sequence: Synthetic peptide
SSGWYYFDY

SEQ ID NO: 23905 - DNA, 27 bp, Artificial Sequence
  Description of Artificial Sequence: Synthetic oligonucleotide
agcagtggctggtactactttgactac

SEQ ID NO: 23906 - protein, 9 aa, Artificial Sequence
  Description of Artificial Sequence: Synthetic peptide
SSGWYYFDY

SEQ ID NO: 23907 - DNA, 27 bp, Artificial Sequence
  Description of Artificial Sequence: Synthetic oligonucleotide
agcagtggctggtactactttgactac

SEQ ID NO: 23908 - protein, 9 aa, Artificial Sequence
  Description of Artificial Sequence: Synthetic peptide
SSGWYYFDY

SEQ ID NO: 23909 - DNA, 27 bp, Artificial Sequence
  Description of Artificial Sequence: Synthetic oligonucleotide
agcagtggctggtactactttgactac

SEQ ID NO: 23910 - protein, 9 aa, Artificial Sequence
  Description of Artificial Sequence: Synthetic peptide
SSGWYYFDY

SEQ ID NO: 23911 - DNA, 27 bp, Artificial Sequence
  Description of Artificial Sequence: Synthetic oligonucleotide
agcagtggctggtactactttgactac

SEQ ID NO: 23912 - protein, 9 aa, Artificial Sequence
  Description of Artificial Sequence: Synthetic peptide
SSGWYYFDY

SEQ ID NO: 23913 - DNA, 27 bp, Artificial Sequence
  Description of Artificial Sequence: Synthetic oligonucleotide
agcagtggctggtactactttgactac

SEQ ID NO: 23914 - protein, 9 aa, Artificial Sequence
  Description of Artificial Sequence: Synthetic peptide
SSGWYYFDY

SEQ ID NO: 23915 - DNA, 27 bp, Artificial Sequence
  Description of Artificial Sequence: Synthetic oligonucleotide
agcagtggctggtactactttgactac

SEQ ID NO: 23916 - protein, 9 aa, Artificial Sequence
  Description of Artificial Sequence: Synthetic peptide
SSGWYYFDY

SEQ ID NO: 23917 - DNA, 27 bp, Artificial Sequence
  Description of Artificial Sequence: Synthetic oligonucleotide
agcagtggctggtactactttgactac

SEQ ID NO: 23918 - protein, 9 aa, Artificial Sequence
  Description of Artificial Sequence: Synthetic peptide
SSGWYYFDY

SEQ ID NO: 23919 - DNA, 27 bp, Artificial Sequence
  Description of Artificial Sequence: Synthetic oligonucleotide
agcagtggctggtactactttgactac

SEQ ID NO: 23920 - protein, 9 aa, Artificial Sequence
  Description of Artificial Sequence: Synthetic peptide
SSGWYYFDY

SEQ ID NO: 23921 - DNA, 27 bp, Artificial Sequence
  Description of Artificial Sequence: Synthetic oligonucleotide
agcagtggctggtactactttgactac

SEQ ID NO: 23922 - protein, 9 aa, Artificial Sequence
  Description of Artificial Sequence: Synthetic peptide
SSGWYYFDY

SEQ ID NO: 23923 - DNA, 27 bp, Artificial Sequence
  Description of Artificial Sequence: Synthetic oligonucleotide
agcagtggctggtactactttgactac

SEQ ID NO: 23924 - protein, 9 aa, Artificial Sequence
  Description of Artificial Sequence: Synthetic peptide
SSGWYYFDY

SEQ ID NO: 23925 - DNA, 27 bp, Artificial Sequence
  Description of Artificial Sequence: Synthetic oligonucleotide
agcagtggctggtactactttgactac

SEQ ID NO: 23926 - protein, 9 aa, Artificial Sequence
  Description of Artificial Sequence: Synthetic peptide
SSGWYYFDY

SEQ ID NO: 23927 - DNA, 27 bp, Artificial Sequence
  Description of Artificial Sequence: Synthetic oligonucleotide
agcagtggctggtactactttgactac

SEQ ID NO: 23928 - protein, 9 aa, Artificial Sequence
  Description of Artificial Sequence: Synthetic peptide
SSGWYYFDY

SEQ ID NO: 23929 - DNA, 27 bp, Artificial Sequence
  Description of Artificial Sequence: Synthetic oligonucleotide
agcagtggctggtactactttgactac

SEQ ID NO: 23930 - protein, 9 aa, Artificial Sequence
  Description of Artificial Sequence: Synthetic peptide
SSGWYYFDY

SEQ ID NO: 23931 - DNA, 27 bp, Artificial Sequence
  Description of Artificial Sequence: Synthetic oligonucleotide
agcagtggctggtactactttgactac

SEQ ID NO: 23932 - protein, 9 aa, Artificial Sequence
  Description of Artificial Sequence: Synthetic peptide
SSGWYYFDY

SEQ ID NO: 23933 - DNA, 27 bp, Artificial Sequence
  Description of Artificial Sequence: Synthetic oligonucleotide
agcagtggctggtactactttgactac

SEQ ID NO: 23934 - protein, 9 aa, Artificial Sequence
  Description of Artificial Sequence: Synthetic peptide
SSGWYYFDY

SEQ ID NO: 23935 - DNA, 27 bp, Artificial Sequence
  Description of Artificial Sequence: Synthetic oligonucleotide
agcagtggctggtactactttgactac

SEQ ID NO: 23936 - protein, 9 aa, Artificial Sequence
  Description of Artificial Sequence: Synthetic peptide
SSGWYYFDY

SEQ ID NO: 23937 - DNA, 27 bp, Artificial Sequence
  Description of Artificial Sequence: Synthetic oligonucleotide
agcagtggctggtactactttgactac

SEQ ID NO: 23938 - protein, 9 aa, Artificial Sequence
  Description of Artificial Sequence: Synthetic peptide
SSGWYYFDY

SEQ ID NO: 23939 - DNA, 27 bp, Artificial Sequence
  Description of Artificial Sequence: Synthetic oligonucleotide
agcagtggctggtactactttgactac

SEQ ID NO: 23940 - protein, 9 aa, Artificial Sequence
  Description of Artificial Sequence: Synthetic peptide
SSGWYYFDY

SEQ ID NO: 23941 - DNA, 27 bp, Artificial Sequence
  Description of Artificial Sequence: Synthetic oligonucleotide
agcagtggctggtactactttgactac

SEQ ID NO: 23942 - protein, 9 aa, Artificial Sequence
  Description of Artificial Sequence: Synthetic peptide
SSGWYYFDY

SEQ ID NO: 23943 - DNA, 27 bp, Artificial Sequence
  Description of Artificial Sequence: Synthetic oligonucleotide
agcagtggctggtactactttgactac

SEQ ID NO: 23944 - protein, 9 aa, Artificial Sequence
  Description of Artificial Sequence: Synthetic peptide
SSGWYYFDY

SEQ ID NO: 23945 - DNA, 27 bp, Artificial Sequence
  Description of Artificial Sequence: Synthetic oligonucleotide
agcagtggctggtactactttgactac

SEQ ID NO: 23946 - protein, 9 aa, Artificial Sequence
  Description of Artificial Sequence: Synthetic peptide
SSGWYYFDY

SEQ ID NO: 23947 - DNA, 27 bp, Artificial Sequence
  Description of Artificial Sequence: Synthetic oligonucleotide
agcagtggctggtactactttgactac

SEQ ID NO: 23948 - protein, 9 aa, Artificial Sequence
  Description of Artificial Sequence: Synthetic peptide
SSGWYYFDY

SEQ ID NO: 23949 - DNA, 27 bp, Artificial Sequence
  Description of Artificial Sequence: Synthetic oligonucleotide
agcagtggctggtactactttgactac

SEQ ID NO: 23950 - protein, 9 aa, Artificial Sequence
  Description of Artificial Sequence: Synthetic peptide
SSGWYYFDY

SEQ ID NO: 23951 - DNA, 27 bp, Artificial Sequence
  Description of Artificial Sequence: Synthetic oligonucleotide
agcagtggctggtactactttgactac

SEQ ID NO: 23952 - protein, 9 aa, Artificial Sequence
  Description of Artificial Sequence: Synthetic peptide
SSGWYYFDY

SEQ ID NO: 23953 - DNA, 27 bp, Artificial Sequence
  Description of Artificial Sequence: Synthetic oligonucleotide
agcagtggctggtactactttgactac

SEQ ID NO: 23954 - protein, 9 aa, Artificial Sequence
  Description of Artificial Sequence: Synthetic peptide
SSGWYYFDY

SEQ ID NO: 23955 - DNA, 27 bp, Artificial Sequence
  Description of Artificial Sequence: Synthetic oligonucleotide
agcagtggctggtactactttgactac

SEQ ID NO: 23956 - protein, 9 aa, Artificial Sequence
  Description of Artificial Sequence: Synthetic peptide
SSGWYYFDY

SEQ ID NO: 23957 - DNA, 27 bp, Artificial Sequence
  Description of Artificial Sequence: Synthetic oligonucleotide
agcagtggctggtactactttgactac

SEQ ID NO: 23958 - protein, 9 aa, Artificial Sequence
  Description of Artificial Sequence: Synthetic peptide
SSGWYYFDY

SEQ ID NO: 23959 - DNA, 27 bp, Artificial Sequence
  Description of Artificial Sequence: Synthetic oligonucleotide
agcagtggctggtactactttgactac

SEQ ID NO: 23960 - protein, 9 aa, Artificial Sequence
  Description of Artificial Sequence: Synthetic peptide
SSGWYYFDY

SEQ ID NO: 23961 - DNA, 27 bp, Artificial Sequence
  Description of Artificial Sequence: Synthetic oligonucleotide
agcagtggctggtactactttgactac

SEQ ID NO: 23962 - protein, 9 aa, Artificial Sequence
  Description of Artificial Sequence: Synthetic peptide
SSGWYYFDY

SEQ ID NO: 23963 - DNA, 24 bp, Artificial Sequence
  Description of Artificial Sequence: Synthetic oligonucleotide
gatggtaccagctcgtttgactac

SEQ ID NO: 23964 - protein, 8 aa, Artificial Sequence
  Description of Artificial Sequence: Synthetic peptide
DGTSSFDY

SEQ ID NO: 23965 - DNA, 24 bp, Artificial Sequence
  Description of Artificial Sequence: Synthetic oligonucleotide
gatggtaccagctcgtttgactac

SEQ ID NO: 23966 - protein, 8 aa, Artificial Sequence
  Description of Artificial Sequence: Synthetic peptide
DGTSSFDY

SEQ ID NO: 23967 - DNA, 24 bp, Artificial Sequence
  Description of Artificial Sequence: Synthetic oligonucleotide
gatggtaccagctcgtttgactac

SEQ ID NO: 23968 - protein, 8 aa, Artificial Sequence
  Description of Artificial Sequence: Synthetic peptide
DGTSSFDY

SEQ ID NO: 23969 - DNA, 24 bp, Artificial Sequence
  Description of Artificial Sequence: Synthetic oligonucleotide
gatgctaccagctcgtttgactac

SEQ ID NO: 23970 - protein, 8 aa, Artificial Sequence
  Description of Artificial Sequence: Synthetic peptide
DATSSFDY

SEQ ID NO: 23971 - DNA, 24 bp, Artificial Sequence
  Description of Artificial Sequence: Synthetic oligonucleotide
agtggtaccagctcgtttgactac

SEQ ID NO: 23972 - protein, 8 aa, Artificial Sequence
  Description of Artificial Sequence: Synthetic peptide
SGTSSFDY

SEQ ID NO: 23973 - DNA, 24 bp, Artificial Sequence
  Description of Artificial Sequence: Synthetic oligonucleotide
agtggtaccagctcgtttgactac

SEQ ID NO: 23974 - protein, 8 aa, Artificial Sequence
  Description of Artificial Sequence: Synthetic peptide
SGTSSFDY

SEQ ID NO: 23975 - DNA, 24 bp, Artificial Sequence
  Description of Artificial Sequence: Synthetic oligonucleotide
gatgctaccagctcgtttgactac

SEQ ID NO: 23976 - protein, 8 aa, Artificial Sequence
  Description of Artificial Sequence: Synthetic peptide
DATSSFDY

SEQ ID NO: 23977 - DNA, 24 bp, Artificial Sequence
  Description of Artificial Sequence: Synthetic oligonucleotide
gatgctaccagctcgtttgactac

SEQ ID NO: 23978 - protein, 8 aa, Artificial Sequence
  Description of Artificial Sequence: Synthetic peptide
DATSSFDY

SEQ ID NO: 23979 - DNA, 42 bp, Artificial Sequence; identical to SEQ ID NO: 21005
  Description of Artificial Sequence: Synthetic oligonucleotide

SEQ ID NO: 23980 - protein, 14 aa, Artificial Sequence
  Description of Artificial Sequence: Synthetic peptide
EVYSSGWYDYGMDV

SEQ ID NO: 23981 - DNA, 42 bp, Artificial Sequence; identical to SEQ ID NO: 21005
  Description of Artificial Sequence: Synthetic oligonucleotide

SEQ ID NO: 23982 - protein, 14 aa, Artificial Sequence
  Description of Artificial Sequence: Synthetic peptide
EVYSSGWYDYGMDV

SEQ ID NO: 23983 - DNA, 42 bp, Artificial Sequence; identical to SEQ ID NO: 21005
  Description of Artificial Sequence: Synthetic oligonucleotide

SEQ ID NO: 23984 - protein, 14 aa, Artificial Sequence
  Description of Artificial Sequence: Synthetic peptide
EVYSSGWYDYGMDV

SEQ ID NO: 23985 - DNA, 42 bp, Artificial Sequence; identical to SEQ ID NO: 21005
  Description of Artificial Sequence: Synthetic oligonucleotide

SEQ ID NO: 23986 - protein, 14 aa, Artificial Sequence
  Description of Artificial Sequence: Synthetic peptide
EVYSSGWYDYGMDV

SEQ ID NO: 23987 - DNA, 42 bp, Artificial Sequence; identical to SEQ ID NO: 21005
  Description of Artificial Sequence: Synthetic oligonucleotide

SEQ ID NO: 23988 - protein, 14 aa, Artificial Sequence
  Description of Artificial Sequence: Synthetic peptide
EVYSSGWYDYGMDV

SEQ ID NO: 23989 - DNA, 42 bp, Artificial Sequence; identical to SEQ ID NO: 21005
  Description of Artificial Sequence: Synthetic oligonucleotide

SEQ ID NO: 23990 - protein, 14 aa, Artificial Sequence
  Description of Artificial Sequence: Synthetic peptide
EVYSSGWYDYGMDV

SEQ ID NO: 23991 - DNA, 42 bp, Artificial Sequence
  Description of Artificial Sequence: Synthetic oligonucleotide
gaggtatatagcagtggctattacgactacggtatggacgtc

SEQ ID NO: 23992 - protein, 14 aa, Artificial Sequence
  Description of Artificial Sequence: Synthetic peptide
EVYSSGYYDYGMDV

SEQ ID NO: 23993 - DNA, 42 bp, Artificial Sequence
  Description of Artificial Sequence: Synthetic oligonucleotide
gaggtatatagcagtggcttctacgactacggtatggacgtc

SEQ ID NO: 23994 - protein, 14 aa, Artificial Sequence
  Description of Artificial Sequence: Synthetic peptide
EVYSSGFYDYGMDV

SEQ ID NO: 23995 - DNA, 42 bp, Artificial Sequence; identical to SEQ ID NO: 23991
  Description of Artificial Sequence: Synthetic oligonucleotide

SEQ ID NO: 23996 - protein, 14 aa, Artificial Sequence
  Description of Artificial Sequence: Synthetic peptide
EVYSSGYYDYGMDV

SEQ ID NO: 23997 - DNA, 42 bp, Artificial Sequence; identical to SEQ ID NO: 23991
  Description of Artificial Sequence: Synthetic oligonucleotide

SEQ ID NO: 23998 - protein, 14 aa, Artificial Sequence
  Description of Artificial Sequence: Synthetic peptide
EVYSSGYYDYGMDV

SEQ ID NO: 23999 - DNA, 42 bp, Artificial Sequence; identical to SEQ ID NO: 23993
  Description of Artificial Sequence: Synthetic oligonucleotide

SEQ ID NO: 24000 - protein, 14 aa, Artificial Sequence
  Description of Artificial Sequence: Synthetic peptide
EVYSSGFYDYGMDV

SEQ ID NO: 24001 - DNA, 42 bp, Artificial Sequence; identical to SEQ ID NO: 23991
  Description of Artificial Sequence: Synthetic oligonucleotide

SEQ ID NO: 24002 - protein, 14 aa, Artificial Sequence
  Description of Artificial Sequence: Synthetic peptide
EVYSSGYYDYGMDV

SEQ ID NO: 24003 - DNA, 42 bp, Artificial Sequence; identical to SEQ ID NO: 23991
  Description of Artificial Sequence: Synthetic oligonucleotide

SEQ ID NO: 24004 - protein, 14 aa, Artificial Sequence
  Description of Artificial Sequence: Synthetic peptide
EVYSSGYYDYGMDV

SEQ ID NO: 24005 - DNA, 42 bp, Artificial Sequence; identical to SEQ ID NO: 21005
  Description of Artificial Sequence: Synthetic oligonucleotide

SEQ ID NO: 24006 - protein, 14 aa, Artificial Sequence
  Description of Artificial Sequence: Synthetic peptide
EVYSSGWYDYGMDV

SEQ ID NO: 24007 - DNA, 27 bp, Artificial Sequence
  Description of Artificial Sequence: Synthetic oligonucleotide
gatctgagtatgggcggtatggacgtc

SEQ ID NO: 24008 - protein, 9 aa, Artificial Sequence
  Description of Artificial Sequence: Synthetic peptide
DLSMGGMDV

SEQ ID NO: 24009 - DNA, 27 bp, Artificial Sequence
  Description of Artificial Sequence: Synthetic oligonucleotide
gatctgagtatgggcggtatggacgtc

SEQ ID NO: 24010 - protein, 9 aa, Artificial Sequence
  Description of Artificial Sequence: Synthetic peptide
DLSMGGMDV

SEQ ID NO: 24011 - DNA, 27 bp, Artificial Sequence
  Description of Artificial Sequence: Synthetic oligonucleotide
gatctgagtatgggcggtatggacgtc

SEQ ID NO: 24012 - protein, 9 aa, Artificial Sequence
  Description of Artificial Sequence: Synthetic peptide
DLSMGGMDV

SEQ ID NO: 24013 - DNA, 27 bp, Artificial Sequence
  Description of Artificial Sequence: Synthetic oligonucleotide
gatctgagtatgggcggtatggacgtc

SEQ ID NO: 24014 - protein, 9 aa, Artificial Sequence
  Description of Artificial Sequence: Synthetic peptide
DLSMGGMDV

SEQ ID NO: 24015 - DNA, 27 bp, Artificial Sequence
  Description of Artificial Sequence: Synthetic oligonucleotide
gatctgagtatgggcggtatggacgtc

SEQ ID NO: 24016 - protein, 9 aa, Artificial Sequence
  Description of Artificial Sequence: Synthetic peptide
DLSMGGMDV

SEQ ID NO: 24017 - DNA, 27 bp, Artificial Sequence
  Description of Artificial Sequence: Synthetic oligonucleotide
gatctgagtatgggcggtatggacgtc

SEQ ID NO: 24018 - protein, 9 aa, Artificial Sequence
  Description of Artificial Sequence: Synthetic peptide
DLSMGGMDV

SEQ ID NO: 24019 - DNA, 27 bp, Artificial Sequence
  Description of Artificial Sequence: Synthetic oligonucleotide
gatctgagtatgggcggtatggacgtc

SEQ ID NO: 24020 - protein, 9 aa, Artificial Sequence
  Description of Artificial Sequence: Synthetic peptide
DLSMGGMDV

SEQ ID NO: 24021 - DNA, 27 bp, Artificial Sequence
  Description of Artificial Sequence: Synthetic oligonucleotide
gatctgagtatgggcggtatggacgtc

SEQ ID NO: 24022 - protein, 9 aa, Artificial Sequence
  Description of Artificial Sequence: Synthetic peptide
DLSMGGMDV

SEQ ID NO: 24023 - DNA, 27 bp, Artificial Sequence
  Description of Artificial Sequence: Synthetic oligonucleotide
gatctgagtatgggcggtatggacgtc

SEQ ID NO: 24024 - protein, 9 aa, Artificial Sequence
  Description of Artificial Sequence: Synthetic peptide
DLSMGGMDV

SEQ ID NO: 24025 - DNA, 27 bp, Artificial Sequence
  Description of Artificial Sequence: Synthetic oligonucleotide
gatctgagtatgggcggtatggacgtc

SEQ ID NO: 24026 - protein, 9 aa, Artificial Sequence
  Description of Artificial Sequence: Synthetic peptide
DLSMGGMDV

SEQ ID NO: 24027 - DNA, 27 bp, Artificial Sequence
  Description of Artificial Sequence: Synthetic oligonucleotide
gatctgagtatgggcggtatggacgtc

SEQ ID NO: 24028 - protein, 9 aa, Artificial Sequence
  Description of Artificial Sequence: Synthetic peptide
DLSMGGMDV

SEQ ID NO: 24029 - DNA, 27 bp, Artificial Sequence
  Description of Artificial Sequence: Synthetic oligonucleotide
gatctgagtatgggcggtatggacgtc

SEQ ID NO: 24030 - protein, 9 aa, Artificial Sequence
  Description of Artificial Sequence: Synthetic peptide
DLSMGGMDV

SEQ ID NO: 24031 - DNA, 27 bp, Artificial Sequence
  Description of Artificial Sequence: Synthetic oligonucleotide
gatctgagtatgggcggtatggacgtc

SEQ ID NO: 24032 - protein, 9 aa, Artificial Sequence
  Description of Artificial Sequence: Synthetic peptide
DLSMGGMDV

SEQ ID NO: 24033 - DNA, 27 bp, Artificial Sequence
  Description of Artificial Sequence: Synthetic oligonucleotide
gatctgagtatgggcggtatggacgtc

SEQ ID NO: 24034 - protein, 9 aa, Artificial Sequence
  Description of Artificial Sequence: Synthetic peptide
DLSMGGMDV

SEQ ID NO: 24035 - DNA, 27 bp, Artificial Sequence
  Description of Artificial Sequence: Synthetic oligonucleotide
gatctgagtatgggcggtatggacgtc

SEQ ID NO: 24036 - protein, 9 aa, Artificial Sequence
  Description of Artificial Sequence: Synthetic peptide
DLSMGGMDV

SEQ ID NO: 24037 - DNA, 27 bp, Artificial Sequence
  Description of Artificial Sequence: Synthetic oligonucleotide
gatctgagtatgggcggtatggacgtc

SEQ ID NO: 24038 - protein, 9 aa, Artificial Sequence
  Description of Artificial Sequence: Synthetic peptide
DLSMGGMDV

SEQ ID NO: 24039 - DNA, 27 bp, Artificial Sequence
  Description of Artificial Sequence: Synthetic oligonucleotide
gatctgagtatgggcggtatggacgtc

SEQ ID NO: 24040 - protein, 9 aa, Artificial Sequence
  Description of Artificial Sequence: Synthetic peptide
DLSMGGMDV

SEQ ID NO: 24041 - DNA, 27 bp, Artificial Sequence
  Description of Artificial Sequence: Synthetic oligonucleotide
gatctgagtatgggcggtatggacgtc

SEQ ID NO: 24042 - protein, 9 aa, Artificial Sequence
  Description of Artificial Sequence: Synthetic peptide
DLSMGGMDV

SEQ ID NO: 24043 - DNA, 27 bp, Artificial Sequence
  Description of Artificial Sequence: Synthetic oligonucleotide
gatctgagtatgggcggtatggacgtc

SEQ ID NO: 24044 - protein, 9 aa, Artificial Sequence
  Description of Artificial Sequence: Synthetic peptide
DLSMGGMDV

SEQ ID NO: 24045 - DNA, 27 bp, Artificial Sequence
  Description of Artificial Sequence: Synthetic oligonucleotide
gatctgagtatgggcggtatggacgtc

SEQ ID NO: 24046 - protein, 9 aa, Artificial Sequence
  Description of Artificial Sequence: Synthetic peptide
DLSMGGMDV

SEQ ID NO: 24047 - DNA, 27 bp, Artificial Sequence
  Description of Artificial Sequence: Synthetic oligonucleotide
gatctgagtatgggcggtatggacgtc

SEQ ID NO: 24048 - protein, 9 aa, Artificial Sequence
  Description of Artificial Sequence: Synthetic peptide
DLSMGGMDV

SEQ ID NO: 24049 - DNA, 33 bp, Artificial Sequence; identical to SEQ ID NO: 22209
  Description of Artificial Sequence: Synthetic oligonucleotide

SEQ ID NO: 24050 - protein, 11 aa, Artificial Sequence
  Description of Artificial Sequence: Synthetic peptide
GGYNWNHAFDI

SEQ ID NO: 24051 - DNA, 36 bp, Artificial Sequence
  Description of Artificial Sequence: Synthetic oligonucleotide
ggagggaattacttctacaaccacgttatggacgtc

SEQ ID NO: 24052 - protein, 12 aa, Artificial Sequence
  Description of Artificial Sequence: Synthetic peptide
GGNYFYNHVMDV

SEQ ID NO: 24053 - DNA, 36 bp, Artificial Sequence; identical to SEQ ID NO: 24051
  Description of Artificial Sequence: Synthetic oligonucleotide

SEQ ID NO: 24054 - protein, 12 aa, Artificial Sequence
  Description of Artificial Sequence: Synthetic peptide
GGNYFYNHVMDV

SEQ ID NO: 24055 - DNA, 27 bp, Artificial Sequence
  Description of Artificial Sequence: Synthetic oligonucleotide
agcagtggctggtactactttgactac

SEQ ID NO: 24056 - protein, 9 aa, Artificial Sequence
  Description of Artificial Sequence: Synthetic peptide
SSGWYYFDY

SEQ ID NO: 24057 - DNA, 24 bp, Artificial Sequence
  Description of Artificial Sequence: Synthetic oligonucleotide
gatgctaccagctcgtttgactac

SEQ ID NO: 24058 - protein, 8 aa, Artificial Sequence
  Description of Artificial Sequence: Synthetic peptide
DATSSFDY

SEQ ID NO: 24059 - DNA, 27 bp, Artificial Sequence
  Description of Artificial Sequence: Synthetic oligonucleotide
gatctgagtatgggcggtatggacgtc

SEQ ID NO: 24060 - protein, 9 aa, Artificial Sequence
  Description of Artificial Sequence: Synthetic peptide
DLSMGGMDV

SEQ ID NO: 24061 - DNA, 27 bp, Artificial Sequence
  Description of Artificial Sequence: Synthetic oligonucleotide
agcagtggctggtacatctttgactac

SEQ ID NO: 24062 - protein, 9 aa, Artificial Sequence
  Description of Artificial Sequence: Synthetic peptide
SSGWYIFDY

SEQ ID NO: 24063 - DNA, 27 bp, Artificial Sequence
  Description of Artificial Sequence: Synthetic oligonucleotide
tccagtggctggcactggttcgacccc

SEQ ID NO: 24064 - protein, 9 aa, Artificial Sequence
  Description of Artificial Sequence: Synthetic peptide
SSGWHWFDP

SEQ ID NO: 24065 - DNA, 18 bp, Artificial Sequence
  Description of Artificial Sequence: Synthetic oligonucleotide
gatgcgtatagccactac

SEQ ID NO: 24066 - protein, 6 aa, Artificial Sequence
  Description of Artificial Sequence: Synthetic peptide
DAYSHY

SEQ ID NO: 24067 - DNA, 24 bp, Artificial Sequence
  Description of Artificial Sequence: Synthetic oligonucleotide
gggggttcgagggggttcgacccc

SEQ ID NO: 24068 - protein, 8 aa, Artificial Sequence
  Description of Artificial Sequence: Synthetic peptide
GGSRGFDP

SEQ ID NO: 24069 - DNA, 42 bp, Artificial Sequence
  Description of Artificial Sequence: Synthetic oligonucleotide
gatgtgaagcagtggctggtacggacctacggtatggacgtc

SEQ ID NO: 24070 - protein, 14 aa, Artificial Sequence
  Description of Artificial Sequence: Synthetic peptide
DVKQWLVRTYGMDV

SEQ ID NO: 24071 - DNA, 60 bp, Artificial Sequence
  Description of Artificial Sequence: Synthetic oligonucleotide
gaggatcgatattgtagtggtaccagctgcccctactactactactacggtatggacgtc

SEQ ID NO: 24072 - protein, 20 aa, Artificial Sequence
  Description of Artificial Sequence: Synthetic peptide
EDRYCSGTSCPYYYYYGMDV

SEQ ID NO: 24073 - DNA, 39 bp, Artificial Sequence; identical to SEQ ID NO: 22947
  Description of Artificial Sequence: Synthetic oligonucleotide

SEQ ID NO: 24074 - protein, 13 aa, Artificial Sequence
  Description of Artificial Sequence: Synthetic peptide
HDFWSGYYKGMDV

SEQ ID NO: 24075 - DNA, 39 bp, Artificial Sequence; identical to SEQ ID NO: 22947
  Description of Artificial Sequence: Synthetic oligonucleotide

SEQ ID NO: 24076 - protein, 13 aa, Artificial Sequence
  Description of Artificial Sequence: Synthetic peptide
HDFWSGYYKGMDV

SEQ ID NO: 24077 - DNA, 39 bp, Artificial Sequence; identical to SEQ ID NO: 22947
  Description of Artificial Sequence: Synthetic oligonucleotide

SEQ ID NO: 24078 - protein, 13 aa, Artificial Sequence
  Description of Artificial Sequence: Synthetic peptide
HDFWSGYYKGMDV

SEQ ID NO: 24079 - DNA, 60 bp, Artificial Sequence; identical to SEQ ID NO: 23555
  Description of Artificial Sequence: Synthetic oligonucleotide

SEQ ID NO: 24080 - protein, 20 aa, Artificial Sequence
  Description of Artificial Sequence: Synthetic peptide
DRDYCSSTSCPYYYYYGMDV

SEQ ID NO: 24081 - DNA, 54 bp, Artificial Sequence
  Description of Artificial Sequence: Synthetic oligonucleotide
gaaaacgaaagtctagcaactcgtcctttctacgactactacggtatggacgtc

SEQ ID NO: 24082 - protein, 18 aa, Artificial Sequence
  Description of Artificial Sequence: Synthetic peptide
ENESLATRPFYDYYGMDV

SEQ ID NO: 24083 - DNA, 42 bp, Artificial Sequence; identical to SEQ ID NO: 22371
  Description of Artificial Sequence: Synthetic oligonucleotide

SEQ ID NO: 24084 - protein, 14 aa, Artificial Sequence
  Description of Artificial Sequence: Synthetic peptide
EPYNSGWYDYGMDV

SEQ ID NO: 24085 - DNA, 27 bp, Artificial Sequence
  Description of Artificial Sequence: Synthetic oligonucleotide
agcagtggctggtacttctttgactac

SEQ ID NO: 24086 - protein, 9 aa, Artificial Sequence
  Description of Artificial Sequence: Synthetic peptide
SSGWYFFDY

SEQ ID NO: 24087 - DNA, 42 bp, Artificial Sequence
  Description of Artificial Sequence: Synthetic oligonucleotide
gacacgttttgctttgatggttgtggttatttctttgactcc

SEQ ID NO: 24088 - protein, 14 aa, Artificial Sequence
  Description of Artificial Sequence: Synthetic peptide
DTFCFDGCGYFFDS

SEQ ID NO: 24089 - DNA, 33 bp, Artificial Sequence; identical to SEQ ID NO: 22735
  Description of Artificial Sequence: Synthetic oligonucleotide

SEQ ID NO: 24090 - protein, 11 aa, Artificial Sequence
  Description of Artificial Sequence: Synthetic peptide
DQGVGYYGMDV

SEQ ID NO: 24091 - DNA, 21 bp, Artificial Sequence
  Description of Artificial Sequence: Synthetic oligonucleotide
gactacggtgtctttgactac

SEQ ID NO: 24092 - protein, 7 aa, Artificial Sequence
  Description of Artificial Sequence: Synthetic peptide
DYGVFDY

SEQ ID NO: 24093 - DNA, 27 bp, Artificial Sequence
  Description of Artificial Sequence: Synthetic oligonucleotide
agcagtggctggtacttttttgactac

SEQ ID NO: 24094 - protein, 9 aa, Artificial Sequence
  Description of Artificial Sequence: Synthetic peptide
SSGWYFFDY

SEQ ID NO: 24095 - DNA, 27 bp, Artificial Sequence
  Description of Artificial Sequence: Synthetic oligonucleotide
agcagtggctggtacctctttgactac

SEQ ID NO: 24096 - protein, 9 aa, Artificial Sequence
  Description of Artificial Sequence: Synthetic peptide
SSGWYLFDY

SEQ ID NO: 24097 - DNA, 27 bp, Artificial Sequence
  Description of Artificial Sequence: Synthetic oligonucleotide
tccagtggctggtactggttcgacccc

SEQ ID NO: 24098 - protein, 9 aa, Artificial Sequence
  Description of Artificial Sequence: Synthetic peptide
SSGWYWFDP

SEQ ID NO: 24099 - DNA, 27 bp, Artificial Sequence
  Description of Artificial Sequence: Synthetic oligonucleotide
agcagtggctggtactactttgactac

SEQ ID NO: 24100 - protein, 9 aa, Artificial Sequence
  Description of Artificial Sequence: Synthetic peptide
SSGWYYFDY

SEQ ID NO: 24101 - DNA, 27 bp, Artificial Sequence
  Description of Artificial Sequence: Synthetic oligonucleotide
tccagtggctggaactggttcgacccc

SEQ ID NO: 24102 - protein, 9 aa, Artificial Sequence
  Description of Artificial Sequence: Synthetic peptide
SSGWNWFDP

SEQ ID NO: 24103 - DNA, 60 bp, Artificial Sequence
  Description of Artificial Sequence: Synthetic oligonucleotide
gggttttacgatattttgactggttattcccccacctactactactacgatatggacgtc

SEQ ID NO: 24104 - protein, 20 aa, Artificial Sequence
  Description of Artificial Sequence: Synthetic peptide
GFYDILTGYSPTYYYYDMDV

SEQ ID NO: 24105 - DNA, 60 bp, Artificial Sequence; identical to SEQ ID NO: 24103
  Description of Artificial Sequence: Synthetic oligonucleotide

SEQ ID NO: 24106 - protein, 20 aa, Artificial Sequence
  Description of Artificial Sequence: Synthetic peptide
GFYDILTGYSPTYYYYDMDV

SEQ ID NO: 24107 - DNA, 45 bp, Artificial Sequence
  Description of Artificial Sequence: Synthetic oligonucleotide
cacggtatagcagtggctggtactggggctcactactttgactac

SEQ ID NO: 24108 - protein, 15 aa, Artificial Sequence
  Description of Artificial Sequence: Synthetic peptide
HGIAVAGTGAHYFDY

SEQ ID NO: 24109 - DNA, 60 bp, Artificial Sequence; identical to SEQ ID NO: 24103
  Description of Artificial Sequence: Synthetic oligonucleotide

SEQ ID NO: 24110 - protein, 20 aa, Artificial Sequence
  Description of Artificial Sequence: Synthetic peptide
GFYDILTGYSPTYYYYDMDV

SEQ ID NO: 24111 - DNA, 60 bp, Artificial Sequence; identical to SEQ ID NO: 24103
  Description of Artificial Sequence: Synthetic oligonucleotide

SEQ ID NO: 24112 - protein, 20 aa, Artificial Sequence
  Description of Artificial Sequence: Synthetic peptide
GFYDILTGYSPTYYYYDMDV

SEQ ID NO: 24113 - DNA, 45 bp, Artificial Sequence; identical to SEQ ID NO: 24107
  Description of Artificial Sequence: Synthetic oligonucleotide

SEQ ID NO: 24114 - protein, 15 aa, Artificial Sequence
  Description of Artificial Sequence: Synthetic peptide
HGIAVAGTGAHYFDY

SEQ ID NO: 24115 - DNA, 321 bp, Artificial Sequence
  Description of Artificial Sequence: Synthetic polynucleotide
gacatccagatgacccagtctccattctccctgtctgcatctgtaggcgacagagtcaccatcacttgccgggcaagtcggagcgttagcagatatttaaattggtatcagcagacactggggaaagcccttaagctcttgatatctgttgcatcccgtttgcaaagtggggtcccatcgaggttcagtggcagtggatctgggacagatttcactctcaccatcagcagtgtgcaacgtgaagattttgcaacttacttctgtcaacagagtgacagtttccctctcactttcggcggagggaccaaggtggagatcaaa

SEQ ID NO: 24116 - protein, 107 aa, Artificial Sequence
  Description of Artificial Sequence: Synthetic polypeptide
DIQMTQSPFSLSASVGDRVTITCRASRSVSRYLNWYQQTLGKALKLLISVASRLQSGVPSRFSGSGSGTDFTLTISSVQREDFATYFCQQSDSFPLTFGGGTKVEIK

SEQ ID NO: 24117 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtcttttaaagagctccaacaataagagctacttagcttcgtaccagcagaagccaggacagcttcctaaactgctcatttactgggcatcttcccgggaatccggggtccctgaccgattcagtggcagcgggtctgggacagatttcactctcaccatcagcagcctgcaggctgaagatgtggcactttattactgtcagcaatattatagtattcctcccactttcggccatgggaccaatgtggatatcacg

SEQ ID NO: 24118 - protein, 113 aa, Artificial Sequence
  Description of Artificial Sequence: Synthetic polypeptide
DIVMTQSPDSLAVSLGERATINCKSSQSLLKSSNNKSYLASYQQKPGQLPKLLIYWASSRESGVPDRFSGSGSGTDFTLTISSLQAEDVALYYCQQYYSIPPTFGHGTNVDIT

SEQ ID NO: 24119 - DNA, 339 bp, Artificial Sequence
  Description of Artificial Sequence: Synthetic polynucleotide
gacatcgttatgacccagtctccagactccctggctgtgtctctgggcgagagggccaccatcaactgcaagtccagccagagtgttttattcagctccaacaattataactacttagcttggtaccagcagagaccaggacagcctcctaacctgctcatttactgggcatctacccgggaatccggggtccctgaccgattcagtggcagcgggtctgggacagatttcactctcaccatcagcagcctgcaggctgctgatgtggcagtttattactgtcagcaatatcatagttctcctccgacgttcggccaagggaccacggtgcaaatcaaa

SEQ ID NO: 24120 - protein, 113 aa, Artificial Sequence
  Description of Artificial Sequence: Synthetic polypeptide
DIVMTQSPDSLAVSLGERATINCKSSQSVLFSSNNYNYLAWYQQRPGQPPNLLIYWASTRESGVPDRFSGSGSGTDFTLTISSLQAADVAVYYCQQYHSSPPTFGQGTTVQIK

SEQ ID NO: 24121 - DNA, 336 bp, Artificial Sequence
  Description of Artificial Sequence: Synthetic polynucleotide
gatattgtgatgacccagactccactctctctctctgtcacacctggacagccggcctccatctcctgcaagtctagtcagagcctcctgcgtagtgatggaaagacccatttgtattggtacctgcagaagccaggccagcctccacagctcttaatctatgaagtttccaaccggttctctggagtgtcagataggttcagtggcagcgggtcagggacagatttcacactgaaaatcagccgggtggaggctgaggatgttggggtttattactgcatgcaaagtaaacagcttcctctcactttcggcggagggaccaaggtggagttcaaa

SEQ ID NO: 24122 - protein, 112 aa, Artificial Sequence
  Description of Artificial Sequence: Synthetic polypeptide
DIVMTQTPLSLSVTPGQPASISCKSSQSLLRSDGKTHLYWYLQKPGQPPQLLIYEVSNRFSGVSDRFSGSGSGTDFTLKISRVEAEDVGVYYCMQSKQLPLTFGGGTKVEFK

SEQ ID NO: 24123 - DNA, 321 bp, Artificial Sequence
  Description of Artificial Sequence: Synthetic polynucleotide
gacatccagatgacccagtttccatcctcactgtttgcatttgtaggagacagagtcaccatcacttgtccggcgagtcagggcattagcaattatttagcttggtttcagcagaaaccagggaaagcccctaagtcccttatttatggtgcattcaatttgcacagtggggtcccatcaaagttcagcggcagtggatttgggacagatttcactctcaccatcaacagcctgcagcctgaagattttgcaaattattactgccaacagtatagttgttacccattcactttcggccatgggaccaaagtggatatcaaa

SEQ ID NO: 24124 - protein, 107 aa, Artificial Sequence
  Description of Artificial Sequence: Synthetic polypeptide
DIQMTQFPSSLFAFVGDRVTITCPASQGISNYLAWFQQKPGKAPKSLIYGAFNLHSGVPSKFSGSGFGTDFTLTINSLQPEDFANYYCQQYSCYPFTFGHGTKVDIK

SEQ ID NO: 24125 - DNA, 321 bp, Artificial Sequence
  Description of Artificial Sequence: Synthetic polynucleotide
tcctatgagctgactcagccaccctcagtgtccgtgtccccaggacagacagccagcatcacctgctctggagataaattgggtaataaatatgtttgttggtatcagcagaggccaggccatgctgctgtgctgatcatctatcaagatagcaagcggccctcagggatccctgagcgattctctggctccaactctgggaacacagccactctgaccatcagcgggacccaggctatggatgaggctgactatttctgtcaggcgtgggacaggaacacttatgtggtgttcggcggagggaccaagctgaccgtccta

SEQ ID NO: 24126 - protein, 107 aa, Artificial Sequence
  Description of Artificial Sequence: Synthetic polypeptide
SYELTQPPSVSVSPGQTASITCSGDKLGNKYVCWYQQRPGHAAVLIIYQDSKRPSGIPERFSGSNSGNTATLTISGTQAMDEADYFCQAWDRNTYVVFGGGTKLTVL

SEQ ID NO: 24127 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggggggtcagggtattagcacatggttagcatggtatcagcagaaaccagggaaagcccctaagctcctgatctatgctgcatccattttgcaaagtggggtcccatcaaggttcagaggcaggggatctgggacagatttcactctcaccatcagcagcctgcagcctgaagattttgcaacttattattgtcaacagggtaacattttcccattcactttcggccgagggaccaaagtggatatcaaa

SEQ ID NO: 24128 - protein, 107 aa, Artificial Sequence
  Description of Artificial Sequence: Synthetic polypeptide
DIQMTQSPSSVSASVGDRVTITCRGGQGISTWLAWYQQKPGKAPKLLIYAASILQSGVPSRFRGRGSGTDFTLTISSLQPEDFATYYCQQGNIFPFTFGRGTKVDIK

SEQ ID NO: 24129 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcagggcattagaaatgatttaggctggtatcagcagcaaccagggaaaacccctaagcgcctgatctatgctgcatccagtttgcttagtggggtcccatcaaggttcagcggcagtagatctgggacagatttcactctcacaatcagcagcctgcagcctgaagattttgcaacttattactgtctacagtataatagttaccctcccaccttcggccaagggacacgactggagattaaa

SEQ ID NO: 24130 - protein, 107 aa, Artificial Sequence
  Description of Artificial Sequence: Synthetic polypeptide
DIQMTQSPSSLSASVGDRVTITCRTSQGIRNDLGWYQQQPGKTPKRLIYAASSLLSGVPSRFSGSRSGTDFTLTISSLQPEDFATYYCLQYNSYPPTFGQGTRLEIK

SEQ ID NO: 24131 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaaatggttagcctggtatcagcagaaaccagggaaagcccctaagctcctgctctatgctgcatccagtttgcaaagtggggtcccatcaagattcagcgccagtggatctgggacagatttcactctcaccatcagcagtttgcagcctgaagattttgcaacttactattgtcaacaggctaacagtttcccattcactttcggccctgggaccaaagtggatgtcaaa

SEQ ID NO: 24132 - protein, 107 aa, Artificial Sequence
  Description of Artificial Sequence: Synthetic polypeptide
DIQMTQSPSSVSASVGDRVTITCRASQGISKWLAWYQQKPGKAPKLLLYAASSLQSGVPSRFSASGSGTDFTLTISSLQPEDFATYYCQQANSFPFTFGPGTKVDVK

SEQ ID NO: 24133 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaagtggttagcctggtatcagcagaaaccagggaaagcccctaacctccttctctatgctgcatccagtttgcaaagtggggtcccatcaaaattcagcggcagtggatctgggacagatttcactctcaccatcagcagcctgcagcctgaagattttgcaacttactattgtcaacaggctaacagtttcccattcactttcggccctgggaccaaagtggatgtcaaa

SEQ ID NO: 24134 - protein, 107 aa, Artificial Sequence
  Description of Artificial Sequence: Synthetic polypeptide
DIQMTQSPSSVSASVGDRVTITCRASQGISKWLAWYQQKPGKAPNLLLYAASSLQSGVPSKFSGSGSGTDFTLTISSLQPEDFATYYCQQANSFPFTFGPGTKVDVK

SEQ ID NO: 24135 - DNA, 324 bp, Artificial Sequence
  Description of Artificial Sequence: Synthetic polynucleotide
gaaattgtgttgacgcagtctccaggcaccctgtctttgtctccaggggagagagccaccctctcctgcagggccagtcagagtgttaacagcaactacttagcctggtaccggcagaaacctggccaggctcccaggctcctcatctatggtgcatccagcagggccactggcatcccagacaggttcagtggcagtgggtctgggacagacttcattctcatcatcagcagactggagcctgaggattttgcagtgtattactgtcagcagtatgaaagctcgccgtggacgttcggccaagggaccaaggtggaaatcaaa

SEQ ID NO: 24136 - protein, 108 aa, Artificial Sequence
  Description of Artificial Sequence: Synthetic polypeptide
EIVLTQSPGTLSLSPGERATLSCRASQSVNSNYLAWYRQKPGQAPRLLIYGASSRATGIPDRFSGSGSGTDFILIISRLEPEDFAVYYCQQYESSPWTFGQGTKVEIK

SEQ ID NO: 24137 - DNA, 321 bp, Artificial Sequence
  Description of Artificial Sequence: Synthetic polynucleotide
gacatccagatgacccagtttccatcctccctgtctgcatctgtaggagacagagtcaccatcacttgccgggcaagtcgagacattagaaatgatttaggctggtatcagcagaaaccaggaaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacaacattatagttacccgctcactttcggcggagggaccaaggtggagatcaaa

SEQ ID NO: 24138 - protein, 107 aa, Artificial Sequence
  Description of Artificial Sequence: Synthetic polypeptide
DIQMTQFPSSLSASVGDRVTITCRASRDIRNDLGWYQQKPGKAPKRLIYAASSLQSGVPSRFSGSGSGTEFTLTISSLQPEDFATYYCLQHYSYPLTFGGGTKVEIK

SEQ ID NO: 24139 - DNA, 336 bp, Artificial Sequence
  Description of Artificial Sequence: Synthetic polynucleotide
gatattgtgatgacccagactccactctctctgtccgtcacccctggacagccggcctccatgtcctgcaagtctagtcagagcctcctgcatagtgaaggaaagacctatttgtattggtacctgcagaagacaggccagcctccacacctcctgatctatgaagtttccaagcggctctctggcgtgccagataggttcagtggcagcgggtcagggacagatttcacactgaaaatcagccggatggaggctgaggatgttggggtttattactgcatgcaaagtatgcagcttccgattatcttcggccaggggacacgactggagattaaa

SEQ ID NO: 24140 - protein, 112 aa, Artificial Sequence
  Description of Artificial Sequence: Synthetic polypeptide
DIVMTQTPLSLSVTPGQPASMSCKSSQSLLHSEGKTYLYWYLQKTGQPPHLLIYEVSKRLSGVPDRFSGSGSGTDFTLKISRMEAEDVGVYYCMQSMQLPIIFGQGTRLEIK

SEQ ID NO: 24141 - DNA, 321 bp, Artificial Sequence
  Description of Artificial Sequence: Synthetic polynucleotide
gacatccagatgacccagtctccctcctcactgtctgcatctgtaggagacagagtcaccatcacttgtcgggcgagtcagggcattagcaattatttagcctggtttcagcagaaaccagggaaagcccctaagtccctgatctatgctgcatccactttgcaaagtggggtcccatcaaagttcagcggcagtagatctgggacagattttaatctcaccatcagcaacctgcagcctgaagattttgcaacttattactgccaacagtatagtggttacccattcactttcggccctgggaccaaagtggataccaaa

SEQ ID NO: 24142 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASTLQSGVPSKFSGSRSGTDFNLTISNLQPEDFATYYCQQYSGYPFTFGPGTKVDTK

SEQ ID NO: 24143 - DNA, 336 bp, Artificial Sequence
  Description of Artificial Sequence: Synthetic polynucleotide
gctattgtgatgacccagactccactctctctgtccgtcacccctggacagccggcctccatctcctgcaagtctagtcagcgcctcctgcatggtgatggaaagacctatttgtattggtacctgcagaagccaggccagcctccacacctcctgatctctgaagtttccaaccggttctctggagtgccagataggttcagtggcagcgggtcagggacagatttcacactgaaaatcagccgggtggaggctgaggatgttggggtttattactgcatgcaaagtatacaggttccgtggacgttcggccaagggaccaaggtggaaatcaaa

SEQ ID NO: 24144 - protein, 112 aa, Artificial Sequence
  Description of Artificial Sequence: Synthetic polypeptide
AIVMTQTPLSLSVTPGQPASISCKSSQRLLHGDGKTYLYWYLQKPGQPPHLLISEVSNRFSGVPDRFSGSGSGTDFTLKISRVEAEDVGVYYCMQSIQVPWTFGQGTKVEIK

SEQ ID NO: 24145 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccgtcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 24146 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIK

SEQ ID NO: 24147 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgaaacttattactgtctacagcataatgattacccgttcactttcggcggagggaccaaggtggagatcaaa

SEQ ID NO: 24148 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFETYYCLQHNDYPFTFGGGTKVEIK

SEQ ID NO: 24149 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagacatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcattatagtttccctcggacgttcggccaagggaccaaggtggaaatcaaa

SEQ ID NO: 24150 - protein, 107 aa, Artificial Sequence
  Description of Artificial Sequence: Synthetic polypeptide
DIQMTQSPSSLSASVGDRVTITCRASQGIRHDLGWYQQKPGKAPKRLIYAASSLQSGVPSRFSGSGSGTEFTLTISSLQPEDFATYYCLQHYSFPRTFGQGTKVEIK

SEQ ID NO: 24151 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagactgttaacagcaacttagcctggtaccagcagaaatctggccaggctcccaggctcctcatctttggtgcatccaccagggccactgttatcccagccaggatcaatggcagtgggtctgggacagagttcactctcaccatcagcagcctgcggtctgaagattttgcagtttatttctgtcagcagtataatgactggccgtgcagttttggccaggggaccaagctggagatcaaa

SEQ ID NO: 24152 - protein, 107 aa, Artificial Sequence
  Description of Artificial Sequence: Synthetic polypeptide
EIVMTQSPATLSVSPGERATLSCRASQTVNSNLAWYQQKSGQAPRLLIFGASTRATVIPARINGSGSGTEFTLTISSLRSEDFAVYFCQQYNDWPCSFGQGTKLEIK

SEQ ID NO: 24153 - DNA, 321 bp, Artificial Sequence
  Description of Artificial Sequence: Synthetic polynucleotide
gaaatagtgatgacgcagtctccagccaccctgtctgtgtctccaggggaaagagccaacctctcctgcaggaccagtcagagtgtttggattagcgtagcctggtaccaccagaaacctggccaggctcccaggctcctcatctatggtgcagccaccagggccactggtatcccagccaggtttagtggcagtgggtctgggacagagttcactctcaccatcagcagcctgcagtctgaagattttgcagtttattactgtcagcagtataattactggccgctcactttcggcggagggaccaaggtggagatcaaa

SEQ ID NO: 24154 - protein, 107 aa, Artificial Sequence
  Description of Artificial Sequence: Synthetic polypeptide
EIVMTQSPATLSVSPGERANLSCRTSQSVWISVAWYHQKPGQAPRLLIYGAATRATGIPARFSGSGSGTEFTLTISSLQSEDFAVYYCQQYNYWPLTFGGGTKVEIK

SEQ ID NO: 24155 - DNA, 321 bp, Artificial Sequence
  Description of Artificial Sequence: Synthetic polynucleotide
gacatccagatgacccagtctccatcctccctgtctgcctctgcaggagacagagtcaccatcacttgccgggcaagtcaggacattagaaattatttaggctggtatcagcagaaaccagggaaagcccctaagcgactgatctatggtgcatccagtttgcaaagtggggtcccatcaaggttcagcggcagtggatctgggacagaattcactctcacaatcagcagcctgcagcctgaagattttgcaactttttactgtctacagtataatagttacccattcactttcggccctgggaccaaagtggatatcaaa

SEQ ID NO: 24156 - protein, 107 aa, Artificial Sequence
  Description of Artificial Sequence: Synthetic polypeptide
DIQMTQSPSSLSASAGDRVTITCRASQDIRNYLGWYQQKPGKAPKRLIYGASSLQSGVPSRFSGSGSGTEFTLTISSLQPEDFATFYCLQYNSYPFTFGPGTKVDIK

SEQ ID NO: 24157 - DNA, 324 bp, Artificial Sequence; identical to SEQ ID NO: 24135
  Description of Artificial Sequence: Synthetic polynucleotide

SEQ ID NO: 24158 - protein, 108 aa, Artificial Sequence; identical to SEQ ID NO: 24136
  Description of Artificial Sequence: Synthetic polypeptide

SEQ ID NO: 24159 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcataagaaaagatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttatgtctgtctacaacattatcgttaccctttcactttcggccctgggaccaaagtggatttcaaa

SEQ ID NO: 24160 - protein, 107 aa, Artificial Sequence
  Description of Artificial Sequence: Synthetic polypeptide
DIQMTQSPSSLSASVGDRVTITCRASQGIRKDLGWYQQKPGKAPKRLIYAASSLQSGVPSRFSGSGSGTEFTLTISSLQPEDFATYVCLQHYRYPFTFGPGTKVDFK

SEQ ID NO: 24161 - DNA, 324 bp, Artificial Sequence
  Description of Artificial Sequence: Synthetic polynucleotide
gaaattgtgttgacgcagtgtccaggcaccctgtctttgtctccaggggagagagccaccgtctcctgcagggccagtcagagcgttaacagcaactacttagcctggtaccggcagaaacctgaccaggctcccaggctcctcatctatggtgcatccagcagggccactggcatcccagacaggttcagtggcagtgggtctgggacagacttcattctcatcatcagcagactggagcctgaggattttgcagtgtattactgtcagcagtatgaaagctcgccgtggacgttcggccaagggaccaaggtggaaatcaaa

SEQ ID NO: 24162 - protein, 108 aa, Artificial Sequence
  Description of Artificial Sequence: Synthetic polypeptide
EIVLTQCPGTLSLSPGERATVSCRASQSVNSNYLAWYRQKPDQAPRLLIYGASSRATGIPDRFSGSGSGTDFILIISRLEPEDFAVYYCQQYESSPWTFGQGTKVEIK

SEQ ID NO: 24163 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtgggatcccatcaaggttcagcggcagtggatctgggacagaattcactctcacaatcagcagcctgcagcctgaagattttgcaacttattactgtctacagcataatagttaccctctcactttcggcggagggaccaaggtggagatcaaa

SEQ ID NO: 24164 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGIPSRFSGSGSGTEFTLTISSLQPEDFATYYCLQHNSYPLTFGGGTKVEIK

SEQ ID NO: 24165 - DNA, 324 bp, Artificial Sequence; identical to SEQ ID NO: 24135
  Description of Artificial Sequence: Synthetic polynucleotide

SEQ ID NO: 24166 - protein, 108 aa, Artificial Sequence; identical to SEQ ID NO: 24136
  Description of Artificial Sequence: Synthetic polypeptide

SEQ ID NO: 24167 - DNA, 321 bp, Artificial Sequence
  Description of Artificial Sequence: Synthetic polynucleotide
gacatccagatgacccagtctccatcctccctgtctgcatctgttggagacagagtcaccatcacttgccgggcaagtcagggcattagaaatgatttaggctggtatcagcagaaaccagggaaggcccctaagcgcctgatctatgctgcatccagtttgcaaagtggggtcccatcaaggttcagcggcagtggatctgggacagaattcactctcacaatcagcagcctacagcctgaagattttgcaacttattactgtctacaacattatagttaccctcggacgttcggccaagggaccaaggtggaaatcaaa

SEQ ID NO: 24168 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHYSYPRTFGQGTKVEIK

SEQ ID NO: 24169 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaagtgatttaggctggtatcagcagaaaccagggaaagcccctaagcgcctgatctatactgcatccagtttgcaaagtggggtcccatcaaggttcagcggcagtggatctgggacagaattcactctcacaatcagcagcctgcagcctgaagattttgcaacttattactgtctacagtataatagttacccattcactttcggccctgggaccaaagtggatatcaaa

SEQ ID NO: 24170 - protein, 107 aa, Artificial Sequence
  Description of Artificial Sequence: Synthetic polypeptide
DIQMTQSPSSLSASVGDRVTITCRASQGIRSDLGWYQQKPGKAPKRLIYTASSLQSGVPSRFSGSGSGTEFTLTISSLQPEDFATYYCLQYNSYPFTFGPGTKVDIK

SEQ ID NO: 24171 - DNA, 321 bp, Artificial Sequence; identical to SEQ ID NO: 24155
  Description of Artificial Sequence: Synthetic polynucleotide

SEQ ID NO: 24172 - protein, 107 aa, Artificial Sequence; identical to SEQ ID NO: 24156
  Description of Artificial Sequence: Synthetic polypeptide

SEQ ID NO: 24173 - DNA, 324 bp, Artificial Sequence
  Description of Artificial Sequence: Synthetic polynucleotide
gacatccagatgacccagtctccatcctccctgtctgcttctattggagacagagtcaccatcacttgccgggcaagtcagaacattagcagctatttaaattggtatcagcagaaaccagggaaggcccccaagttcctgatctatgctgcatccagtttgcatagtggggtcccaccaaggttcagtggcagtggatctgggacagatttcactctcaccatcagcagtctgcaacctgaagattttgcaatttactactgtcaacagagttacagaacccctctgtggacgttcggccaagggaccaaggtggaaatcaaa

SEQ ID NO: 24174 - protein, 108 aa, Artificial Sequence
  Description of Artificial Sequence: Synthetic polypeptide
DIQMTQSPSSLSASIGDRVTITCRASQNISSYLNWYQQKPGKAPKFLIYAASSLHSGVPPRFSGSGSGTDFTLTISSLQPEDFAIYYCQQSYRTPLWTFGQGTKVEIK

SEQ ID NO: 24175 - DNA, 339 bp, Artificial Sequence
  Description of Artificial Sequence: Synthetic polynucleotide
gacatcgtgatgacccaatctccagactccctggctgtgtctctgggcgagagggccaccatcaactgcaagtccagccagagtgttttatccagctccaacaataacaactacttagcttggtaccagcagaaaccaggacagcctcctaagctgctcatttactgggcatctacccgggaatccgggatccctgaccgattcagtggcagcgggtctgggacaggtttcactctcaccatcagcagcctgcaggctgaggatgtggcagtttattactgtcagcaatattatactactccgtgcagttttggccaggggaccaagctggagatcaat

SEQ ID NO: 24176 - protein, 113 aa, Artificial Sequence
  Description of Artificial Sequence: Synthetic polypeptide
DIVMTQSPDSLAVSLGERATINCKSSQSVLSSSNNNNYLAWYQQKPGQPPKLLIYWASTRESGIPDRFSGSGSGTGFTLTISSLQAEDVAVYYCQQYYTTPCSFGQGTKLEIN

SEQ ID NO: 24177 - DNA, 339 bp, Artificial Sequence
  Description of Artificial Sequence: Synthetic polynucleotide
gacatcgtgatgacccaatctccagactccctggctgtgtctctgggcgcgagggccaccatcaactgcaagtccagccagagtgttttatccaactccaacaataacaactacttagcttggtaccagcagaaaccaggacagcctcctaagctgctcatttactgggcatctacccgggaatccgggatccctgaccgattcagtggcagcgggtctgggacagatttcactctcaccatcaacagcctgcaggctgaagatgtggcagtttattactgtcagcaatattatactactccgtgcagttttggccaggggaccaagctggagatcaaa

SEQ ID NO: 24178 - protein, 113 aa, Artificial Sequence
  Description of Artificial Sequence: Synthetic polypeptide
DIVMTQSPDSLAVSLGARATINCKSSQSVLSNSNNNNYLAWYQQKPGQPPKLLIYWASTRESGIPDRFSGSGSGTDFTLTINSLQAEDVAVYYCQQYYTTPCSFGQGTKLEIK

SEQ ID NO: 24179 - DNA, 336 bp, Artificial Sequence
  Description of Artificial Sequence: Synthetic polynucleotide
gatgttgtaatgactcagtctccgctctccctgcccgtcacccttggacagccggcctccatctcctgcaggtctggtcaaagcctcgtatacagtgatggaaacacctacttgaattggtttcagcagaggccaggccaatctccaaggcgcctaatttatgaggtttctaagtgggactctggggtcccagacagattcagtggcagtgggtcaggcactaatttcacactgaaaatcagcagggtggaggctgaggatgttggggtcttttactgcatgcaaggtacacactggccgctcactttcggcggagggaccaaggtggagatcaaa

SEQ ID NO: 24180 - protein, 112 aa, Artificial Sequence
  Description of Artificial Sequence: Synthetic polypeptide
DVVMTQSPLSLPVTLGQPASISCRSGQSLVYSDGNTYLNWFQQRPGQSPRRLIYEVSKWDSGVPDRFSGSGSGTNFTLKISRVEAEDVGVFYCMQGTHWPLTFGGGTKVEIK

SEQ ID NO: 24181 - DNA, 336 bp, Artificial Sequence
  Description of Artificial Sequence: Synthetic polynucleotide
gatgttgtgatgactcagtctccactctccctgcccgtcacccttggacagccggcctccatctcctgcaggtctagtcaaagcctcgtttacagtgttggaaacacctccttgagttggtttcagcagaggccaggccaatctccaaggcgcctaatttataaggtttctaactgggactctggggtcccagacagattcagcggcagtgggtcaggcactgatttcacactgaaaatcagcagggtggaggctgaggatgttggggtttattaccgcatgcaaggtacacactggccattcactttcggccctgggaccaaagtggatatcaaa

SEQ ID NO: 24182 - protein, 112 aa, Artificial Sequence
  Description of Artificial Sequence: Synthetic polypeptide
DVVMTQSPLSLPVTLGQPASISCRSSQSLVYSVGNTSLSWFQQRPGQSPRRLIYKVSNWDSGVPDRFSGSGSGTDFTLKISRVEAEDVGVYYRMQGTHWPFTFGPGTKVDIK

SEQ ID NO: 24183 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcggggcattagagatgatttaggctggtatcagcagaaaccagggaaagcccctaagcgcctgatctatgctgcatccagtttgcagagtggggtcccatcaaggttcagcggcagtggatctgggacagaattcactctcacaatcagcagcctgcagcctgaagattttgcaacttattactgtctacagcattatagttatcctcggacgttcggccaagggaccaaggtggaaatcaaa

SEQ ID NO: 24184 - protein, 107 aa, Artificial Sequence
  Description of Artificial Sequence: Synthetic polypeptide
DIQMTQSPSSLSASVGDRVTITCRASRGIRDDLGWYQQKPGKAPKRLIYAASSLQSGVPSRFSGSGSGTEFTLTISSLQPEDFATYYCLQHYSYPRTFGQGTKVEIK

SEQ ID NO: 24185 - DNA, 321 bp, Artificial Sequence
  Description of Artificial Sequence: Synthetic polynucleotide
gacatccagatgacccagtctccttcctccctgtctgcatctgtaggagacagagtcaccatcacttgccgggcaagtcagggcattagaaatgatttaggctggtatcagcagaaaccagggaaagcccctacgcgcctgatctatgctgcatccagtttgcaaagtggggtcccatcgaggttcagcggcagtggatctgggacagaattcactctcacaatcagcagcctgcagcctgaagattttgcaacttattactgtctacaacattatagttaccctcggacgttcggccaagggaccaaggtggaaatcaaa

SEQ ID NO: 24186 - protein, 107 aa, Artificial Sequence
  Description of Artificial Sequence: Synthetic polypeptide
DIQMTQSPSSLSASVGDRVTITCRASQGIRNDLGWYQQKPGKAPTRLIYAASSLQSGVPSRFSGSGSGTEFTLTISSLQPEDFATYYCLQHYSYPRTFGQGTKVEIK

SEQ ID NO: 24187 - DNA, 330 bp, Artificial Sequence
  Description of Artificial Sequence: Synthetic polynucleotide
cagtctgccctgactcagtctgcctccgtgtcggggtctcctggacagtcgatcaccatctcctgcactggaaccagcagtgacgttggtggttataattttgtctcctggtaccaacagcacccaggcaaagtccccaaattcatgatttatgaggtcagtaatcggccctcaggggttcctaatcgtttttctggctccaagtctggcaacacggcctccctgaccatctctggcctccaggctgaggacgaggctgattattactgcagctcatatacaagcagctacacttgggtgttcggcggagggaccaaactgaccgtccta

SEQ ID NO: 24188 - protein, 110 aa, Artificial Sequence
  Description of Artificial Sequence: Synthetic polypeptide
QSALTQSASVSGSPGQSITISCTGTSSDVGGYNFVSWYQQHPGKVPKFMIYEVSNRPSGVPNRFSGSKSGNTASLTISGLQAEDEADYYCSSYTSSYTWVFGGGTKLTVL

SEQ ID NO: 24189 - DNA, 327 bp, Artificial Sequence
  Description of Artificial Sequence: Synthetic polynucleotide
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtccggtcggcggagggaccaagctgaccgtccta

SEQ ID NO: 24190 - protein, 109 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPVGGGTKLTVL

SEQ ID NO: 24191 - DNA, 321 bp, Artificial Sequence
  Description of Artificial Sequence: Synthetic polynucleotide
tcctatgagctgacacagccaccctcggtgtcagtgtccccaggacaaacggccaggatcacctgcactggagatgcaatgccgaaaaaatatgcttattgggaccagcagaagtcaggccaggcccctgtgctggtcatctctgaggacagcaagcgaccctccgggatccctgagagattctctggctccagctcagggacaatggcccccttgactatcagtggggcccaggtggaggatgaaactgactacgactgtaactcaacagacagcagtggtaatcgggtgttcggcggagggaccaagctgaccgtccta

SEQ ID NO: 24192 - protein, 107 aa, Artificial Sequence
  Description of Artificial Sequence: Synthetic polypeptide
SYELTQPPSVSVSPGQTARITCTGDAMPKKYAYWDQQKSGQAPVLVISEDSKRPSGIPERFSGSSSGTMAPLTISGAQVEDETDYDCNSTDSSGNRVFGGGTKLTVL

SEQ ID NO: 24193 - DNA, 321 bp, Artificial Sequence
  Description of Artificial Sequence: Synthetic polynucleotide
gacatccagatgacccagtctccatcctccctgtcggcatctgtaggagacagagtcaccatcacttgccgggcaagtcagggcattagaaatgatttaggctggtatcagcagaaaccagggaaagcccctaagcgcctgatctacgctgcatccagtttgcaaagtggggtcccatcaaggttcagcggcagtggatctgggacagaattcactctcacaatcagcagcctgcagcctgaagattttgcaacttattactgtctacagcatgatagttaccctctcactttcggcggaggggccaaggtggagatcaaa

SEQ ID NO: 24194 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHDSYPLTFGGGAKVEIK

SEQ ID NO: 24195 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttgtacagctccaacagtcacaactacttagcttggtaccagcagaaaccaggacagcctcctaaactgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtgcagttttggccaggggaccaagctggagatcaaa

SEQ ID NO: 24196 - protein, 113 aa, Artificial Sequence
  Description of Artificial Sequence: Synthetic polypeptide
DIVMTQSPDSLAVSLGERATINCKSSQSVLYSSNSHNYLAWYQQKPGQPPKLLIYWASTRESGVPDRFSGSGSGTDFTLTISSLQAEDVAVYYCQQYYSTPCSFGQGTKLEIK

SEQ ID NO: 24197 - DNA, 321 bp, Artificial Sequence
  Description of Artificial Sequence: Synthetic polynucleotide
gacatccagatgacccagtctccatcctacctgtctgcatctgtaggagacagagtcaccatcacttgccgggcaagtcaggacattagagataatttaggctggtatcagcagaaaccagggaaagcccctaaacgcctgatctatactgcatacagtttgcaaagtggggtcccatcaaggttcagcggcagtggatctgggacagaattcactctcacaatcagcagcctgcagcctgaggattttgcaacttattactgtctacaacattataattacccgctcactttcggcggagggaccaaggtggagatcaaa

SEQ ID NO: 24198 - protein, 107 aa, Artificial Sequence
  Description of Artificial Sequence: Synthetic polypeptide
DIQMTQSPSYLSASVGDRVTITCRASQDIRDNLGWYQQKPGKAPKRLIYTAYSLQSGVPSRFSGSGSGTEFTLTISSLQPEDFATYYCLQHYNYPLTFGGGTKVEIK

SEQ ID NO: 24199 - DNA, 318 bp, Artificial Sequence
  Description of Artificial Sequence: Synthetic polynucleotide
tcctttgagctgactcagccaccctcagtgtccgtgtccccaggacagacagccagcatcacctgctctggagataaattgggggataaatatgcttactggtatcagcagaagccaggccagtcccctgtgttggtcatctatcaagataggaagcgcccctcagggatccctgagcgattctctggctccaactctgggaacacagccactctgaccatcagcgggacccaggctatggatgaggctgactattactgtcaggcgtgggacaacagcactgtggtgttcggcggagggaccaagctgaccgtccta

SEQ ID NO: 24200 - protein, 106 aa, Artificial Sequence
  Description of Artificial Sequence: Synthetic polypeptide
SFELTQPPSVSVSPGQTASITCSGDKLGDKYAYWYQQKPGQSPVLVIYQDRKRPSGIPERFSGSNSGNTATLTISGTQAMDEADYYCQAWDNSTVVFGGGTKLTVL

SEQ ID NO: 24201 - DNA, 336 bp, Artificial Sequence
  Description of Artificial Sequence: Synthetic polynucleotide
gatgttgtgatgactcagtctccactctccctgcccgtcacccttggacagccggcctccatctcctgcaggtctagtcaaagcctcgtatacagtgatggaaacaccttcttgaattggtttcagcagaggccaggccaatctccaaggcgcctaatttataaggtttctaactgggactctggggtcccagacagattcagcggcagtgggtcaggcactggtttcacactgaaaatcagcagggtggaggctgaggatgttggggtttattactgcatacaaggtacgcactggcctttccccttcggccaagggacacgactggagattaaa

SEQ ID NO: 24202 - protein, 112 aa, Artificial Sequence
  Description of Artificial Sequence: Synthetic polypeptide
DVVMTQSPLSLPVTLGQPASISCRSSQSLVYSDGNTFLNWFQQRPGQSPRRLIYKVSNWDSGVPDRFSGSGSGTGFTLKISRVEAEDVGVYYCIQGTHWPFPFGQGTRLEIK

SEQ ID NO: 24203 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacgttggtggttataattttgtctcctggtaccaacagcacccagacaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcaccggcactgtggtaatcggcggagggaccaaactgaccgtccta

SEQ ID NO: 24204 - protein, 110 aa, Artificial Sequence
  Description of Artificial Sequence: Synthetic polypeptide
QSALTQPASVSGSPGQSITISCTGTSSDVGGYNFVSWYQQHPDKAPKLMIYEVSNRPSGVSNRFSGSKSGNTASLTISGLQAEDEADYYCSSYTSTGTVVIGGGTKLTVL

SEQ ID NO: 24205 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaagtgatttaggctggtatcagcagaatccagtcaaagcccctaagcgcctgatctatgctgcatccagtttgcaaagtggggtcccatcgaggttcagcggcagtggatctgggacagaattcactctcacagtcagcagcctgcagcctgaagattttgcattttattactgtctacagcataatagttacctccccatcaccttcggccaagggacacgactggaaattaaa

SEQ ID NO: 24206 - protein, 108 aa, Artificial Sequence
  Description of Artificial Sequence: Synthetic polypeptide
DIQMTQSPSSLSASVGDRVTITCRASQGIRSDLGWYQQNPVKAPKRLIYAASSLQSGVPSRFSGSGSGTEFTLTVSSLQPEDFAFYYCLQHNSYLPITFGQGTRLEIK

SEQ ID NO: 24207 - DNA, 321 bp, Artificial Sequence
  Description of Artificial Sequence: Synthetic polynucleotide
gacatccagatgacccagtctccatcttccgtgtctgcatctctaggagacagagtcaccatcacttgtcgggcgagtcagggtattagcagctggttagcctggtatcagcagaaacaagggaaagcccctaagctcctgatctttgctgcatccaggttgcaaagtggggccccatcaaggttcagcggcagtggatctgggacagatttcactctcaccatcagcagcctgcagcctgaagattttgcaacttactattgtcaacaggctaacagtttcccattcactttcggccctgggaccaaagtggatatcaaa

SEQ ID NO: 24208 - protein, 107 aa, Artificial Sequence
  Description of Artificial Sequence: Synthetic polypeptide
DIQMTQSPSSVSASLGDRVTITCRASQGISSWLAWYQQKQGKAPKLLIFAASRLQSGAPSRFSGSGSGTDFTLTISSLQPEDFATYYCQQANSFPFTFGPGTKVDIK

SEQ ID NO: 24209 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaggtggttagcctggtatcagcagaaaccagggaaagcccctaagctcctgatctatgctgcatccagattgcaaagtggggtcccatcaaggttcagcggcagtggatctgggacagatttcactctcaccatcagcggcctgctgcctgaagattttgcaatttattattgtcaacaggctaacagtttcccattcactttcggccctgggaccaaagtggatttcaaa

SEQ ID NO: 24210 - protein, 107 aa, Artificial Sequence
  Description of Artificial Sequence: Synthetic polypeptide
DIQMTQSPSSVSASVGDRVTITCRASQGISRWLAWYQQKPGKAPKLLIYAASRLQSGVPSRFSGSGSGTDFTLTISGLLPEDFAIYYCQQANSFPFTFGPGTKVDFK

SEQ ID NO: 24211 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagtcaaagcccctaagcgccttatctatgctgcatccagtttgcaaagtggggtcccatcaaggttcagcggcagtggatctgggacagaattcactctcacaatcagcagcctgcagcctgaagattttgcaacttattactgtctacagcataatagttacctccccatcaccttcggccaagggacacgactggagattaaa

SEQ ID NO: 24212 - protein, 108 aa, Artificial Sequence
  Description of Artificial Sequence: Synthetic polypeptide
DIQMTQSPSSLSASVGDRVTITCRASQGIRNDLGWYQQKPVKAPKRLIYAASSLQSGVPSRFSGSGSGTEFTLTISSLQPEDFATYYCLQHNSYLPITFGQGTRLEIK

SEQ ID NO: 24213 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgtttactggtttcagcagaagccaggccagtcccctgtgctagtcatctatcaagataggaagcggccctcagggatccctgagcgattctctggctccaactctgggaacacagccactctgaccatcagcgggacgcaggctctggatgaggctgactattactgtcaggcgtgggacaacagcactgcggtattcggcggagggaccaagctgaccgtccta

SEQ ID NO: 24214 - protein, 106 aa, Artificial Sequence
  Description of Artificial Sequence: Synthetic polypeptide
SYELTQPPSVSVSPGQTASITCSGDKLGDKYVYWFQQKPGQSPVLVIYQDRKRPSGIPERFSGSNSGNTATLTISGTQALDEADYYCQAWDNSTAVFGGGTKLTVL

SEQ ID NO: 24215 - DNA, 336 bp, Artificial Sequence
  Description of Artificial Sequence: Synthetic polynucleotide
gatgtcgtgatgactcagtctccactctccctgcccgtcacccttggacagccggcctccatctcctgcaggtctagtcaaagcctcgtatccagtgatggaaacaccttcttgaattggtttcagcagaggccaggccaatctccaaggcgcctaatttataaggtttctaactgggactctggggtcccagacagattcagcggcagtgggtcaggcactgatttcacactgaaaatcagcaggttggaggctgaggatgttggggtttattactgcttgcaaggtacacactggcctctcaccttcggccaagggacacgactggagattaaa

SEQ ID NO: 24216 - protein, 112 aa, Artificial Sequence
  Description of Artificial Sequence: Synthetic polypeptide
DVVMTQSPLSLPVTLGQPASISCRSSQSLVSSDGNTFLNWFQQRPGQSPRRLIYKVSNWDSGVPDRFSGSGSGTDFTLKISRLEAEDVGVYYCLQGTHWPLTFGQGTRLEIK

SEQ ID NO: 24217 - DNA, 318 bp, Artificial Sequence
  Description of Artificial Sequence: Synthetic polynucleotide
tcctatgaggtgactcagccaccctcagtgtccgtgtccccaggacagacagccagcatcacctgctctggagataaattgggggataaatatacttactggtatcagcagaaggcaggccagtcccctttcctggtcatctatcaagataggaagcggccctcagggatccctgaccgattctctggctccaactctgggaacacagccactctgaccatcagcgggacccaggctatggatgcggctgacttttactgtcaggcgtgggacaatagtactgcggtattcggcggagggaccaagctgaccgtccta

SEQ ID NO: 24218 - protein, 106 aa, Artificial Sequence
  Description of Artificial Sequence: Synthetic polypeptide
SYEVTQPPSVSVSPGQTASITCSGDKLGDKYTYWYQQKAGQSPFLVIYQDRKRPSGIPDRFSGSNSGNTATLTISGTQAMDAADFYCQAWDNSTAVFGGGTKLTVL

SEQ ID NO: 24219 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcacctcatatacaagcaccagcactgtggtcttcggcggagggaccaagctgaccgtccta

SEQ ID NO: 24220 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCTSYTSTSTVVFGGGTKLTVL

SEQ ID NO: 24221 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattggggaataaatatgcttggtggtatcagcagaagccaggccagtcccctgtgctggtcatctatcaagataggaagcggccctcagggatccctgagcgattctctggctccaactctgggaacacagccactctgaccatcagcgggacccaggctatggatgaggctgactattactgtcaggcgtgggacaacagcactgtggttttcggcggagggaccaaactgaccgtccta

SEQ ID NO: 24222 - protein, 106 aa, Artificial Sequence
  Description of Artificial Sequence: Synthetic polypeptide
SYELTQPPSVSVSPGQTASITCSGDKLGNKYAWWYQQKPGQSPVLVIYQDRKRPSGIPERFSGSNSGNTATLTISGTQAMDEADYYCQAWDNSTVVFGGGTKLTVL

SEQ ID NO: 24223 - DNA, 315 bp, Artificial Sequence
  Description of Artificial Sequence: Synthetic polynucleotide
acctatgagctgactcagccatcctcagtgtccgtgtccccaggacagacagccagcatcacctgctctggagataaattgggggaaaaatatgtttgctggtatcagcagaagccaggccagtcccctgtgctggtcatatatcaagataccaagcggccctcagggatccctgagcgattctctggctccaactctgggaacacagccactctgaccatcagcgggacccaggctatggatgaggctgactattactgtcaggcgtgggacagcagcactatattcggcggagggaccaagctgaccgtccta

SEQ ID NO: 24224 - protein, 105 aa, Artificial Sequence
  Description of Artificial Sequence: Synthetic polypeptide
TYELTQPSSVSVSPGQTASITCSGDKLGEKYVCWYQQKPGQSPVLVIYQDTKRPSGIPERFSGSNSGNTATLTISGTQAMDEADYYCQAWDSSTIFGGGTKLTVL

SEQ ID NO: 24225 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagagaaattgggggataaatatgtttgttggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtggaacagcagcaatgtggtattcggcggagggaccaagctgaccgtccta

SEQ ID NO: 24226 - protein, 106 aa, Artificial Sequence
  Description of Artificial Sequence: Synthetic polypeptide
SYELTQPPSVSVSPGQTASITCSGEKLGDKYVCWYQQKPGQSPVLVIYQDSKRPSGIPERFSGSNSGNTATLTISGTQAMDEADYYCQAWNSSNVVFGGGTKLTVL

SEQ ID NO: 24227 - DNA, 321 bp, Artificial Sequence
  Description of Artificial Sequence: Synthetic polynucleotide
tcctatgagctgactcagccaccctcagtgtccgtatccccaggacagacagccagcatcacctgctctggagataaattgggggataaatatgcttcctggtatcagcagaagccaggccagtcccctgttttggtcatctatcaagatggcaagcggccctcagggatccctgagcgattctctggctccaactctgggaacacagccactctgaccctcagcgggacccaggctatggatgaggctgactattactgtcaggcgtgggacagcagcacttatgtggtattcggcggagggaccaagctgaccgtccta

SEQ ID NO: 24228 - protein, 107 aa, Artificial Sequence
  Description of Artificial Sequence: Synthetic polypeptide
SYELTQPPSVSVSPGQTASITCSGDKLGDKYASWYQQKPGQSPVLVIYQDGKRPSGIPERFSGSNSGNTATLTLSGTQAMDEADYYCQAWDSSTYVVFGGGTKLTVL

SEQ ID NO: 24229 - DNA, 324 bp, Artificial Sequence
  Description of Artificial Sequence: Synthetic polynucleotide
tcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgatcatgtggtattcggcggagggaccaagctgaccgtccta

SEQ ID NO: 24230 - protein, 108 aa, Artificial Sequence
  Description of Artificial Sequence: Synthetic polypeptide
SYELTQPHSVSVATAQMARITCGGNNIGSKAVHWYQQKPGQDPVLVIYSDSNRPSGIPERFSGSNPGNTATLTISRIEAGDEADYYCQVWDSSSDHVVFGGGTKLTVL

SEQ ID NO: 24231 - DNA, 345 bp, Artificial Sequence
  Description of Artificial Sequence: Synthetic polynucleotide
ctgcctgtgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggatgagtatcactgtggagagagccacacgattgatggccaagtcggtgtggtattcggcggagggaccaagctgaccgtccta

SEQ ID NO: 24232 - protein, 115 aa, Artificial Sequence
  Description of Artificial Sequence: Synthetic polypeptide
LPVLTQPPSASALLGASIKLTCTLSSEHSTYTIEWYQQRPGRSPQYIMKVKSDGSHSKGDGIPDRFMGSSSGADRYLTFSNLQSDDEDEYHCGESHTIDGQVGVVFGGGTKLTVL

SEQ ID NO: 24233 - DNA, 318 bp, Artificial Sequence
  Description of Artificial Sequence: Synthetic polynucleotide
tcctatgaactgacgcagccaccctcagtgtccgtgtccccaggacagacagccagcatcacctgctctggagatagattgggggataaatatgcttggtggtatcagcagaagccaggccagtcccctgtgctggtcatatatcaagatcgcaagcggccctcagggatccctgagcgattctctggctccaattcagggaacacagccactctgaccatcagcgggacccaggctatggatgaggctgactattactgtcaggcgtgggacagcagcacagtggtattcggcggagggaccaagctgaccgtccta

SEQ ID NO: 24234 - protein, 106 aa, Artificial Sequence
  Description of Artificial Sequence: Synthetic polypeptide
SYELTQPPSVSVSPGQTASITCSGDRLGDKYAWWYQQKPGQSPVLVIYQDRKRPSGIPERFSGSNSGNTATLTISGTQAMDEADYYCQAWDSSTVVFGGGTKLTVL

SEQ ID NO: 24235 - DNA, 336 bp, Artificial Sequence
  Description of Artificial Sequence: Synthetic polynucleotide
gatattgtgatgacccagactccactctctctgtccgtcattcctggacagccggcctccatctcctgcaagtctagtcagagcctcctgcatagtgatggaaagacccatttgaattggtacctgcagaagccaggccagcctccacagctcctgatctatgaagtttcctaccggttctctggagtgccagataggttcagtggcagcgggtcagggacagttttcacactggagatcagccgggtggaggctgcggatgttggggtttattactgctttcaaagtatacagcttccgctcactttcggcggagggaccaaggtggagatcaaa

SEQ ID NO: 24236 - protein, 112 aa, Artificial Sequence
  Description of Artificial Sequence: Synthetic polypeptide
DIVMTQTPLSLSVIPGQPASISCKSSQSLLHSDGKTHLNWYLQKPGQPPQLLIYEVSYRFSGVPDRFSGSGSGTVFTLEISRVEAADVGVYYCFQSIQLPLTFGGGTKVEIK

SEQ ID NO: 24237 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatcaatgctgcatccagtttacaaagtggggtcccatcaaagttcagcggcagtggatctgggacagatttcactctcaccatcagcagcctgcagcctgaagattttgcaacttattactgccaacagtatcatagttacccattcactttcggccctgggaccaaagtggatatcaaa

SEQ ID NO: 24238 - protein, 107 aa, Artificial Sequence
  Description of Artificial Sequence: Synthetic polypeptide
DIQMTQSPSSLSASVGDRVTITCRASQGISNYLAWFQQKPGKAPKSLINAASSLQSGVPSKFSGSGSGTDFTLTISSLQPEDFATYYCQQYHSYPFTFGPGTKVDIK

SEQ ID NO: 24239 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatggtgcatccagtttgcaaagtggggtcccatcaaggttcagcggcagtggatctgggacagaattcactctcacaatcagcagcctgcagcctgaagattttacaacttattactgtctacagcataatagttacccactcactttcggcggagggaccaaggtggagatcaaa

SEQ ID NO: 24240 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYGASSLQSGVPSRFSGSGSGTEFTLTISSLQPEDFTTYYCLQHNSYPLTFGGGTKVEIK

SEQ ID NO: 24241 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatttaggctggtatcagcagaaagcagggaaagcccctaagcgcctgatcaatgctgcatccagtttgcaaagtggggtcccatcaaggttcagcggcattggctctgggacagaattcactctcacaatcaccggcctgcagcctgaagattttgcaacttattactgtctacagcattatagttatatgttcactttcggcggagggaccaaggtggagatcaaa

SEQ ID NO: 24242 - protein, 107 aa, Artificial Sequence
  Description of Artificial Sequence: Synthetic polypeptide
DIQMTQSPSSLSASVGDRVTITCRASQDIRNDLGWYQQKAGKAPKRLINAASSLQSGVPSRFSGIGSGTEFTLTITGLQPEDFATYYCLQHYSYMFTFGGGTKVEIK

SEQ ID NO: 24243 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcttgcagcctgaagattttgcaacttattactgtctacagcataatagttacccgtggacgttcggccaagggaccaaggtggaaatcaaa

SEQ ID NO: 24244 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKVEIK

SEQ ID NO: 24245 - DNA, 321 bp, Artificial Sequence
  Description of Artificial Sequence: Synthetic polynucleotide
gacatccagatgacccagtctccatcctccctgtctgcatctgtacaagacagagtcaccatcacttgccgggcaagtcagggcattagaaatgatttaggctggtatcagcagaaaccagggaaagcccctaagcgcctgatctttgctgcatccagtttgcaaagtggggtcccgtcaaggttcagcggcagtggatctgggacagaattcactctcacaatcagcagcctgcagcctgaagattttgcaacttattactgtcttcaacatgctagttacccgctcactttcggcggagggaccaaggtggagatcgaa

SEQ ID NO: 24246 - protein, 107 aa, Artificial Sequence
  Description of Artificial Sequence: Synthetic polypeptide
DIQMTQSPSSLSASVQDRVTITCRASQGIRNDLGWYQQKPGKAPKRLIFAASSLQSGVPSRFSGSGSGTEFTLTISSLQPEDFATYYCLQHASYPLTFGGGTKVEIE

SEQ ID NO: 24247 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 24248 - protein, 107 aa, Artificial Sequence; identical to SEQ ID NO: 24146
  Description of Artificial Sequence: Synthetic polypeptide

SEQ ID NO: 24249 - DNA, 321 bp, Artificial Sequence
  Description of Artificial Sequence: Synthetic polynucleotide
gacatccagatgacccagtctccatcctccctgtctgcatctgtcggagacagtgtcaccatctcttgccgggcaagtcaggacattagaaatcatttaggctggtatcagcgtaacccagggaaagcccctaagcgcctgatctatgctgcatccagtttgcaaagtggggtcccatcaaggttcagcggcagtggatctgggacagaattcactctcacaatcagcagcctgcagcctgaagactttgcaacttattactgtctacagtataatagttatccattcactttcggccctgggaccaaagtggacatcaaa

SEQ ID NO: 24250 - protein, 107 aa, Artificial Sequence
  Description of Artificial Sequence: Synthetic polypeptide
DIQMTQSPSSLSASVGDSVTISCRASQDIRNHLGWYQRNPGKAPKRLIYAASSLQSGVPSRFSGSGSGTEFTLTISSLQPEDFATYYCLQYNSYPFTFGPGTKVDIK

SEQ ID NO: 24251 - DNA, 321 bp, Artificial Sequence
  Description of Artificial Sequence: Synthetic polynucleotide
gacatccagatgacccagtctccatcctccctgtctgcatctgtaggagacagagtcaccttcacttgccgggcaagtcagggcattagaagtgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcaatatagttaccctcggacgttcggccaagggaccaaggtggaaatcaaa

SEQ ID NO: 24252 - protein, 107 aa, Artificial Sequence
  Description of Artificial Sequence: Synthetic polypeptide
DIQMTQSPSSLSASVGDRVTFTCRASQGIRSDLGWYQQKPGKAPKRLIYAASSLQSGVPSRFSGSGSGTEFTLTISSLQPEDFATYYCLQQYSYPRTFGQGTKVEIK

SEQ ID NO: 24253 - DNA, 321 bp, Artificial Sequence
  Description of Artificial Sequence: Synthetic polynucleotide
gacatccagatgacccagtctccatcctccctgtctgcatctgtcggagacagagtcaccatcacttgccgggcaagtcagaccattagcaactatttaaattggtatcatcagaaaccagggaaagcccctaagctcctgatctatgctgcttccagtttgcaaagtggggtcccatcaaggttcagtggcagtggatctgggacagatttcactctcaccatcagcagtctgcaacctgaagattttgcaacttactactgtcaacagagtcacacttccccgctcactttcggcggagggaccaaggtggagatcaaa

SEQ ID NO: 24254 - protein, 107 aa, Artificial Sequence
  Description of Artificial Sequence: Synthetic polypeptide
DIQMTQSPSSLSASVGDRVTITCRASQTISNYLNWYHQKPGKAPKLLIYAASSLQSGVPSRFSGSGSGTDFTLTISSLQPEDFATYYCQQSHTSPLTFGGGTKVEIK

SEQ ID NO: 24255 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggtcattagaaatgatttaggctggtatcagcagaaaccagggaaagcccctaagcgcctgatctatgctgtatccagtttgcaaagtggggtcccatcaaggttcagcggcagtggatctgggacagaattcactctcacaatcaacagcctgcagcctgaagattttgcaacttattactgtctacaacataatacttatccgctcactttcggcggcgggaccaaggtggagttcaaa

SEQ ID NO: 24256 - protein, 107 aa, Artificial Sequence
  Description of Artificial Sequence: Synthetic polypeptide
DIQMTQSPSSLSASVGDRVTITCRASQVIRNDLGWYQQKPGKAPKRLIYAVSSLQSGVPSRFSGSGSGTEFTLTINSLQPEDFATYYCLQHNTYPLTFGGGTKVEFK

SEQ ID NO: 24257 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttacaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 24258 - protein, 107 aa, Artificial Sequence; identical to SEQ ID NO: 24146
  Description of Artificial Sequence: Synthetic polypeptide

SEQ ID NO: 24259 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcagggcattagaaatgatttaggctggtatcagcagaaaccggggaaagcccctaagcgcctgatctatgctgcatccagtttgcaaagtggggtcccgtcaaggttcagcggcagtggatctgggacagaattcactctcacaatcagcagcctgcagcctgaagattttgcaacttattactgtctacagcatagttcttacccgctcactttcggcggagggaccaaggtggagatcaaa

SEQ ID NO: 24260 - protein, 107 aa, Artificial Sequence
  Description of Artificial Sequence: Synthetic polypeptide
DIQMTQSPSSLSASVGDRVTITCRTSQGIRNDLGWYQQKPGKAPKRLIYAASSLQSGVPSRFSGSGSGTEFTLTISSLQPEDFATYYCLQHSSYPLTFGGGTKVEIK

SEQ ID NO: 24261 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccaatttacaaagtggggtcccatcaaggttcagcggcagtggatctgggacagaattcactctcacaatcagcagcctgcagcctgaagattttgcaacttattactgtctacagcataatagtttcccgctcactttcggcggagggaccaaggtggagatcaaa

SEQ ID NO: 24262 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASNLQSGVPSRFSGSGSGTEFTLTISSLQPEDFATYYCLQHNSFPLTFGGGTKVEIK

SEQ ID NO: 24263 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttccaaagtggggtcccatcaaggttcagcggcagtggatctgggacagaattcactctcacaatcagcagcctgcagcctgaagattttgcaagttattactgtctacagcataatagttacccgctcactttcggcggagggaccaaggtggagatcaaa

SEQ ID NO: 24264 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSFQSGVPSRFSGSGSGTEFTLTISSLQPEDFASYYCLQHNSYPLTFGGGTKVEIK

SEQ ID NO: 24265 - DNA, 321 bp, Artificial Sequence
  Description of Artificial Sequence: Synthetic polynucleotide
gacatccagatgacccagtctccatcctccctgtctgcatctgtcggagacagagtcaccatcacttgccgggcaagtcagaccattagcaactatttaaattggtatcatcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagtcacagttccccgctcactttcggcggagggaccaaggtggagatcaaa

SEQ ID NO: 24266 - protein, 107 aa, Artificial Sequence
  Description of Artificial Sequence: Synthetic polypeptide
DIQMTQSPSSLSASVGDRVTITCRASQTISNYLNWYHQKPGKAPKLLIYAASSLQSGVPSRFSGSGSGTDFTLTISSLQPEDFATYYCQQSHSSPLTFGGGTKVEIK

SEQ ID NO: 24267 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattggcaactggttagcctggtatcagcagaaaccagggaaagcccctaaactcctgatctttgctgcatccagtttgcaaagtggggtcccatcacggttcagcggcagtggatctgggacagatttcactctcaccatcagcagcctgcagcctgaagattttgtaacttactattgtcaacaggctaacagtttccctcggacgttcggccaagggaccaaggtggaaatcaaa

SEQ ID NO: 24268 - protein, 107 aa, Artificial Sequence
  Description of Artificial Sequence: Synthetic polypeptide
DIQMTQSPSSVSASVGDRVTITCRASQGIGNWLAWYQQKPGKAPKLLIFAASSLQSGVPSRFSGSGSGTDFTLTISSLQPEDFVTYYCQQANSFPRTFGQGTKVEIK

SEQ ID NO: 24269 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattaatacttatttaaattggtatcagcaaaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttacttctgtcaacagagttacagaaccccctttttcactttcggccctgggaccaaagtggatatcaaa

SEQ ID NO: 24270 - protein, 108 aa, Artificial Sequence
  Description of Artificial Sequence: Synthetic polypeptide
DIQMTQSPSSLSASVGDRVTITCRASQSINTYLNWYQQKPGKAPKLLIYAASSLQSGVPSRFSGSGSGTDFTLTISSLQPEDFATYFCQQSYRTPFFTFGPGTKVDIK

SEQ ID NO: 24271 - DNA, 321 bp, Artificial Sequence; identical to SEQ ID NO: 24257
  Description of Artificial Sequence: Synthetic polynucleotide

SEQ ID NO: 24272 - protein, 107 aa, Artificial Sequence; identical to SEQ ID NO: 24146
  Description of Artificial Sequence: Synthetic polypeptide

SEQ ID NO: 24273 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtgtgcaaagtggggtcccatcaaggttcagcggcagtggatctgggacagaattcactctcacaatcagcagcctgcagcctgaagattttgcaatttattactgtctacagcataatagttacccgctcactttcggcggagggaccaaggtggagatcaaa

SEQ ID NO: 24274 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSVQSGVPSRFSGSGSGTEFTLTISSLQPEDFAIYYCLQHNSYPLTFGGGTKVEIK

SEQ ID NO: 24275 - DNA, 321 bp, Artificial Sequence
  Description of Artificial Sequence: Synthetic polynucleotide
gacatccagatgacccaggctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 24276 - protein, 107 aa, Artificial Sequence
  Description of Artificial Sequence: Synthetic polypeptide
DIQMTQAPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIK

SEQ ID NO: 24277 - DNA, 321 bp, Artificial Sequence
  Description of Artificial Sequence: Synthetic polynucleotide
gacatccagatgacccagtctccatcctccctgtctgcttctgtcggagacagaatcaccatcacttgccgggcaggtcagaacattatcaactatttaaattggtatcagcagaaaccagggaaagcccctaacctcctgatatatgttgcatccagtttgcaaagtggggtcccatcaaggttcaatggcagtggatctgggacagatttcactctcaccatcagcagtctgcaacctgaagattttgcaacttactactgtcaacagagttacagtacccctttcactttcggccctgggaccaaagtggatatcaaa

SEQ ID NO: 24278 - protein, 107 aa, Artificial Sequence
  Description of Artificial Sequence: Synthetic polypeptide
DIQMTQSPSSLSASVGDRITITCRAGQNIINYLNWYQQKPGKAPNLLIYVASSLQSGVPSRFNGSGSGTDFTLTISSLQPEDFATYYCQQSYSTPFTFGPGTKVDIK

SEQ ID NO: 24279 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattatcacctatttaaattggtatcagcagaaaccagggaaagcccctaaggtcctgatccatactgcatccagtttgcaaagtggggtcccatcaaggttcagtggcagtggatctgggacagatttcactctcaccatcagcagtctgcaacctgaagattttgcaacttactactgtcaacagacttacagtcccccgctcactttcggcggagggaccaaggtggagatcaaa

SEQ ID NO: 24280 - protein, 107 aa, Artificial Sequence
  Description of Artificial Sequence: Synthetic polypeptide
DIQMTQSPSSLSASVGDRVTITCRASQSIITYLNWYQQKPGKAPKVLIHTASSLQSGVPSRFSGSGSGTDFTLTISSLQPEDFATYYCQQTYSPPLTFGGGTKVEIK

SEQ ID NO: 24281 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtgtacaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 24282 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSVQSGVPSRFSGSGSGTEFTLTISSLQPEDFATYYCLQHNSYPLTFGGGTKVEIK

SEQ ID NO: 24283 - DNA, 324 bp, Artificial Sequence
  Description of Artificial Sequence: Synthetic polynucleotide
gacatccagatgacccagtctccatcctccctgtctgcatctgtaggcgacagagtcaccatcacttgccgggcaagtcagaacattagtagttatttaaattggtatcagcagaaaccagggaaagcccctaagctcctgatctttggtgcatccagtttgcaaactggggtcccatcaaggttcagtggcagtggatctgggacagatttcactctcaccatcaacagtctgcaacctgaagattttgcaacttacttctgtcaacagagttacagaaccccctttttcactttcggccctgggaccaaagtggatatcaaa

SEQ ID NO: 24284 - protein, 108 aa, Artificial Sequence
  Description of Artificial Sequence: Synthetic polypeptide
DIQMTQSPSSLSASVGDRVTITCRASQNISSYLNWYQQKPGKAPKLLIFGASSLQTGVPSRFSGSGSGTDFTLTINSLQPEDFATYFCQQSYRTPFFTFGPGTKVDIK

SEQ ID NO: 24285 - DNA, 321 bp, Artificial Sequence
  Description of Artificial Sequence: Synthetic polynucleotide
gacatccagatgacccagtctccatcctccctgtctgcgtctgtaggagacagagtcaccatcacttgccgggcaagtcagggcattagaaatgatttaggctggtatcagcagaaaccagggaaagcccctaagcgcctgatctatactgcatccagtttgcaaagtggggtcccatcaagattcagcggcagtggatttgggacagaattcactctcacaatcagcagcctgcagcctgaagattttgcaacttattactgtctacaacataatagttacccgtggacgttcggcctggggaccaaggtggtcatcaaa

SEQ ID NO: 24286 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASSLQSGVPSRFSGSGFGTEFTLTISSLQPEDFATYYCLQHNSYPWTFGLGTKVVIK

SEQ ID NO: 24287 - DNA, 321 bp, Artificial Sequence
  Description of Artificial Sequence: Synthetic polynucleotide
gacatccagatgacccagtctccatcctccctgtctgcatctgtacgagacagagtcaccatcacttgccgggcaagtcagggcataagaaatgatttaggctggtatcagcagaaaccagggaaagcccctaagcgcctgatctatgctgtttccagtttgcaaagtggggtcccatcaaggttcagcggcagtggatctgggacagagttcactctcacaatcagcagcctgcagcctgaagattttgcaacttattactgtctacagcatgccagttacccgctcactttcggcggagggaccaaggtggagatcaaa

SEQ ID NO: 24288 - protein, 107 aa, Artificial Sequence
  Description of Artificial Sequence: Synthetic polypeptide
DIQMTQSPSSLSASVRDRVTITCRASQGIRNDLGWYQQKPGKAPKRLIYAVSSLQSGVPSRFSGSGSGTEFTLTISSLQPEDFATYYCLQHASYPLTFGGGTKVEIK

SEQ ID NO: 24289 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagtagttatttatattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtgcccctccattcactttcggccctgggaccaaagtggatatcaaa

SEQ ID NO: 24290 - protein, 108 aa, Artificial Sequence
  Description of Artificial Sequence: Synthetic polypeptide
DIQMTQSPSSLSASVGDRVTITCRASQSISSYLYWYQQKPGKAPKLLIYAASSLQSGVPSRFSGSGSGTDFTLTISSLQPEDFATYYCQQSYSAPPFTFGPGTKVDIK

SEQ ID NO: 24291 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcaaaaaccagggaaagcccctaagcgcctgatctatgctgcatccagtttgcaaagtggggtcccatcaaggttcagcggcagtggatctgggacagaattctctctcacaatcagcagcctgcagcctgaagattttgcaacttattactgtctacagcataatagttacccgctcactttcggcggagggaccaaggtggagatcaaa

SEQ ID NO: 24292 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFSLTISSLQPEDFATYYCLQHNSYPLTFGGGTKVEIK

SEQ ID NO: 24293 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggccattaacacttatttagcctggtttcagcagaaaccagggaaagcccctaagtccctgatttctgctgcatccagtttgcaaagtggggtcccatcaaagttcagcggcagtggatctgggacagaattcactctcaccatcagcagcctgcagcctgaagattttgcaacttattactgccaacagtattatagttatccgctcactttcggcggagggaccaaggtggagatcaaa

SEQ ID NO: 24294 - protein, 107 aa, Artificial Sequence
  Description of Artificial Sequence: Synthetic polypeptide
DIQMTQSPSSLSASVGDRVTITCRASQAINTYLAWFQQKPGKAPKSLISAASSLQSGVPSKFSGSGSGTEFTLTISSLQPEDFATYYCQQYYSYPLTFGGGTKVEIK

SEQ ID NO: 24295 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccattcactttcggccctgggaccaaagtggatatcaaa

SEQ ID NO: 24296 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPFTFGPGTKVDIK

SEQ ID NO: 24297 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaagattcagcggcagtggatctgggacagaattcactctcacaatcagcagcctgcagcctgaagattttgcaacttattactgtctacagcataatagttacccgtggacgttcggccaagggaccaaggtggaaatcaaa

SEQ ID NO: 24298 - protein, 107 aa, Artificial Sequence; identical to SEQ ID NO: 24244
  Description of Artificial Sequence: Synthetic polypeptide

SEQ ID NO: 24299 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgtggacgttcggccaagggaccaaggtggaaatcaaa

SEQ ID NO: 24300 - protein, 107 aa, Artificial Sequence; identical to SEQ ID NO: 24244
  Description of Artificial Sequence: Synthetic polypeptide

SEQ ID NO: 24301 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattagctattatttagcctggtttcagcagaaaccagggaaagcccctaagtccctgatttatgttgcatccagtttgcaaagtggggtcccatcaaagttcggcggcagtggatttgggacagatttcactctcaccatcagcagcctgcagcctgaagattttgcaacttattactgcttacagtataatagttacccattcactttcggccctgggaccaaagtggatatcaaa

SEQ ID NO: 24302 - protein, 107 aa, Artificial Sequence
  Description of Artificial Sequence: Synthetic polypeptide
DIQMTQSPSSLSASVGDRVTITCRASQDISYYLAWFQQKPGKAPKSLIYVASSLQSGVPSKFGGSGFGTDFTLTISSLQPEDFATYYCLQYNSYPFTFGPGTKVDIK

SEQ ID NO: 24303 - DNA, 321 bp, Artificial Sequence
  Description of Artificial Sequence: Synthetic polynucleotide
gacatccagatgacccagtctccatcctccctgtctgcacctgtaggagacagagtctccatcacttgccgggcaagtcagaacattatcaactatttaaattggtatcagcagaaaccagggaaagcccctaagctcctgatagatgttgcatccaatttacaaggtggggtcccatcaaggttcagtggcagtggatctgggacagatttcactctcaccatcagcagtctgcaacctgaagattttgcaacttactactgtcaacagagttacagtacccctttcactttcggccctgggaccaaagtggatatcaaa

SEQ ID NO: 24304 - protein, 107 aa, Artificial Sequence
  Description of Artificial Sequence: Synthetic polypeptide
DIQMTQSPSSLSAPVGDRVSITCRASQNIINYLNWYQQKPGKAPKLLIDVASNLQGGVPSRFSGSGSGTDFTLTISSLQPEDFATYYCQQSYSTPFTFGPGTKVDIK

SEQ ID NO: 24305 - DNA, 324 bp, Artificial Sequence
  Description of Artificial Sequence: Synthetic polynucleotide
gacatccagatgacccagtctccagcctccctgtctgcatctgtaggagacagagtcaccatcacttgccgggcaagtcagagcattatcaactatttaaattggtatcagcagagaccagggaaatcccctaagctcctgatctatgctgcatccagtttgcacagtggggtcccatcaaggttcagtggcagaggatctgggacagatttcactctcaccatcagtagtctgcaacctgaagattttgcaacttacttctgtcaacagagttacagaacccccttattcactttcggccctgggaccaaagtagatttcaaa

SEQ ID NO: 24306 - protein, 108 aa, Artificial Sequence
  Description of Artificial Sequence: Synthetic polypeptide
DIQMTQSPASLSASVGDRVTITCRASQSIINYLNWYQQRPGKSPKLLIYAASSLHSGVPSRFSGRGSGTDFTLTISSLQPEDFATYFCQQSYRTPLFTFGPGTKVDFK

SEQ ID NO: 24307 - DNA, 321 bp, Artificial Sequence; identical to SEQ ID NO: 24257
  Description of Artificial Sequence: Synthetic polynucleotide

SEQ ID NO: 24308 - protein, 107 aa, Artificial Sequence; identical to SEQ ID NO: 24146
  Description of Artificial Sequence: Synthetic polypeptide

SEQ ID NO: 24309 - DNA, 324 bp, Artificial Sequence
  Description of Artificial Sequence: Synthetic polynucleotide
gacatccagatgacccagtctccatcctccctgtctgcatctgttggagacagagtcaccatcacttgccgggcaagtcagaccattagtagttttttaaattggtatcagcagaaaccagggaaagcccctaaactcctgatctatgctgcttccagtttgcaaagtggggtcccgtcaaggttcagtggcagtggatctgggacagatttcactctcaccatcagcggtctgcaacctgaagattttgcaacttacttctgtcaacagagttacagaaccccctttttcactttcggccctgggaccaaagtggatatcaaa

SEQ ID NO: 24310 - protein, 108 aa, Artificial Sequence
  Description of Artificial Sequence: Synthetic polypeptide
DIQMTQSPSSLSASVGDRVTITCRASQTISSFLNWYQQKPGKAPKLLIYAASSLQSGVPSRFSGSGSGTDFTLTISGLQPEDFATYFCQQSYRTPFFTFGPGTKVDIK

SEQ ID NO: 24311 - DNA, 324 bp, Artificial Sequence
  Description of Artificial Sequence: Synthetic polynucleotide
gacatccagatgacccagtctccatcctccctgtctgcatctataggagacagagtctccatcacttgccgggcaagtcggaccattaacaactatttaaattggtatcagcagaaaccagggaaagcccctaaactcctgatctttgctacatccagtttacaaagtggggtcccatcaaggttcagtggcagtggatctgggacagatttcactctcaccatcagcagtctgcaacctgaagattttgcaacttactactgtcaacagacttacagtacccccttattcgctttcggccctgggaccaaagtggatatcaaa

SEQ ID NO: 24312 - protein, 108 aa, Artificial Sequence
  Description of Artificial Sequence: Synthetic polypeptide
DIQMTQSPSSLSASIGDRVSITCRASRTINNYLNWYQQKPGKAPKLLIFATSSLQSGVPSRFSGSGSGTDFTLTISSLQPEDFATYYCQQTYSTPLFAFGPGTKVDIK

SEQ ID NO: 24313 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgttgcatccagtttgcaaagtggggtcccatcaaggttcaacggcagtggatctgggacagaattcactctcacaatcagcagcctgcagcctgaagattttgcaacttattactgtctacagcatagtagttacccgctcactttcggcggagggaccaaggtggagatcaaa

SEQ ID NO: 24314 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYVASSLQSGVPSRFNGSGSGTEFTLTISSLQPEDFATYYCLQHSSYPLTFGGGTKVEIK

SEQ ID NO: 24315 - DNA, 321 bp, Artificial Sequence
  Description of Artificial Sequence: Synthetic polynucleotide
gacatccagatgacccagtctccttcctcactgtttgcatttgtaggagacagagtcaccatcacttgtcgggcgagtcagggcattagctattatttagcctggtttcagcagaaaccagggaaagcccctaagtccctgatttatgttgcatccagtttgcaaagtggggtcccatcaaagttcagcggcagtggatttgggacagatttcactctcaccatcagcagcctgcagcctgaagattttgcaacttattactgccaacagtataatacttacccattcactttcggccctgggaccacagtggatatcaag

SEQ ID NO: 24316 - protein, 107 aa, Artificial Sequence
  Description of Artificial Sequence: Synthetic polypeptide
DIQMTQSPSSLFAFVGDRVTITCRASQGISYYLAWFQQKPGKAPKSLIYVASSLQSGVPSKFSGSGFGTDFTLTISSLQPEDFATYYCQQYNTYPFTFGPGTTVDIK

SEQ ID NO: 24317 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaactgatttaggctggtatcagcagagaccagggaaagcccctaagcgcctgatctatactgcatccagtttgcaaagtggggtcccatcaaggttcagcggcagtggatctgggacagaattcactctcacaatcagcaggctgcagcctgaagattttgcaacttattactgtctacagcataatggttacccgtggacgttcggccaagggaccaaggtggaaatcaaa

SEQ ID NO: 24318 - protein, 107 aa, Artificial Sequence
  Description of Artificial Sequence: Synthetic polypeptide
DIQMTQSPSSLSASVGDRVTITCRASQGIRTDLGWYQQRPGKAPKRLIYTASSLQSGVPSRFSGSGSGTEFTLTISRLQPEDFATYYCLQHNGYPWTFGQGTKVEIK

SEQ ID NO: 24319 - DNA, 321 bp, Artificial Sequence
  Description of Artificial Sequence: Synthetic polynucleotide
gacatccagatgacccagtctccatcctcactgtctgcatctgttggagacagagtcaccatcacttgtcgggcgagtcaggacattagcaattatttagcctggtttcagcagaaaccagggaaagcccctaagtccctgatctatgctgcatccagtttgcaaagtggggtcccatcaaagttcagaggcagtggatctgggacagatttcactctcaccatcagcaacctgcagcctgaagattttgcatcttattactgccaacagtatcatagtttcccattcactttcggccctgggaccaaagtggatatcaaa

SEQ ID NO: 24320 - protein, 107 aa, Artificial Sequence
  Description of Artificial Sequence: Synthetic polypeptide
DIQMTQSPSSLSASVGDRVTITCRASQDISNYLAWFQQKPGKAPKSLIYAASSLQSGVPSKFRGSGSGTDFTLTISNLQPEDFASYYCQQYHSFPFTFGPGTKVDIK

SEQ ID NO: 24321 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccaatttgcaaagtggggtcccatcaaggttcagcggcagtggatctgggacagaattcagtttcacaatcagcagcctgcagcctgaagattttgcaacttattactgtctacagcataatagttacccgctcactttcggcggagggaccaaggtggagatcaaa

SEQ ID NO: 24322 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASNLQSGVPSRFSGSGSGTEFSFTISSLQPEDFATYYCLQHNSYPLTFGGGTKVEIK

SEQ ID NO: 24323 - DNA, 339 bp, Artificial Sequence
  Description of Artificial Sequence: Synthetic polynucleotide
gatattgtgatgactcagtctccactctccctgcccgtcacccctggagagccggcctccatctcctgtaggtctagtcagagcctcctgcatagtaatgggaacaactctttggattggtacctgcagaagccagggcagtctccacagctcctgatctatttgggttctcatcgggcctccggggtccctgacaggttcagtgacagtggatcaggcacagattttacactgaaaatcagcagagtggaggctgaggatgttggggtttattactgcatgcaagttctacaaactcctcccctcactttcggcggagggaccaaggtggagatcaaa

SEQ ID NO: 24324 - protein, 113 aa, Artificial Sequence
  Description of Artificial Sequence: Synthetic polypeptide
DIVMTQSPLSLPVTPGEPASISCRSSQSLLHSNGNNSLDWYLQKPGQSPQLLIYLGSHRASGVPDRFSDSGSGTDFTLKISRVEAEDVGVYYCMQVLQTPPLTFGGGTKVEIK

SEQ ID NO: 24325 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagtagttatttaaattggtatcaccagaaaccagggaaagcccctaagctcctgatctatgctgcatccagtttgcaaagtggggtcccatcaaggttcagtggcagtggatctgggacagatttcactctcaccatcagcaatctgcaacctgaagattttgcaacttactactgtcaacagagttacaatacccccttattcactttcggccctgggaccaaagtggatatcaaa

SEQ ID NO: 24326 - protein, 108 aa, Artificial Sequence
  Description of Artificial Sequence: Synthetic polypeptide
DIQMTQSPSSLSASVGDRVTITCRASQSISSYLNWYHQKPGKAPKLLIYAASSLQSGVPSRFSGSGSGTDFTLTISNLQPEDFATYYCQQSYNTPLFTFGPGTKVDIK

SEQ ID NO: 24327 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagtagttatttaaattggtatcagcagaaaccagggaaagcccctacgctcctgatctatgctgcatccagtttacaaagtggggtcccatcaaggttcagtggcagtggatctgggacagatttcactctcaccatcaacagtctgcaacctgaagattttgcaacttacttctgtcaacagagttacagaaccccctttttcactttcggccctgggaccaaagtggatatcaaa

SEQ ID NO: 24328 - protein, 108 aa, Artificial Sequence
  Description of Artificial Sequence: Synthetic polypeptide
DIQMTQSPSSLSASVGDRVTITCRASQSISSYLNWYQQKPGKAPTLLIYAASSLQSGVPSRFSGSGSGTDFTLTINSLQPEDFATYFCQQSYRTPFFTFGPGTKVDIK

SEQ ID NO: 24329 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcgagtcagggcattaacaattatttagcctggtatcagcagaaaccagggaaaattcctaagctcctgatctatgctgcatccactttgcaatcaggggtcccctctcggttcagtggcagtggatctgggacagatttcactctcaccatcagcagcctgcagcctgaagatgttgcaacttattgctgtcaaaagtataacagtgcccctccgatcaccttcggccaagggacacgactggagattaaa

SEQ ID NO: 24330 - protein, 108 aa, Artificial Sequence
  Description of Artificial Sequence: Synthetic polypeptide
DIQMTQSPSSLSASVGDRVTITCRASQGINNYLAWYQQKPGKIPKLLIYAASTLQSGVPSRFSGSGSGTDFTLTISSLQPEDVATYCCQKYNSAPPITFGQGTRLEIK

SEQ ID NO: 24331 - DNA, 321 bp, Artificial Sequence
  Description of Artificial Sequence: Synthetic polynucleotide
gacatccagatgacccagtctccatcttccgtgtctgcatctgtaggagacggagtcaccatcacttgtcgggcgagtcagggtattagcagctggttagcctggtatcagcagaaaccagggaaagcccctaaactcttgatttatgctgcatccagtttgcaaagtggggtcccatcaaggttcagcggcagtggatctgggacagatttcactctcaccatcagcagcctgcagcctgaagattttgcaacttactattgtcaacaggctaacagtttccctcggacgttcggccaagggaccaaggtggaaatcaaa

SEQ ID NO: 24332 - protein, 107 aa, Artificial Sequence
  Description of Artificial Sequence: Synthetic polypeptide
DIQMTQSPSSVSASVGDGVTITCRASQGISSWLAWYQQKPGKAPKLLIYAASSLQSGVPSRFSGSGSGTDFTLTISSLQPEDFATYYCQQANSFPRTFGQGTKVEIK

SEQ ID NO: 24333 - DNA, 324 bp, Artificial Sequence
  Description of Artificial Sequence: Synthetic polynucleotide
gacatccagatgacccagtctccatcctccctgtctgcatctgtaggagacagagtcaccatcacctgccgggcaagtcagaacattaacaattatttaaattggtatcagcagaaaccagggaaaggccctaaggtcctgatctttactacatctagtttacaaagtggggtcccatcaaggttcagtggcagtggatctgggacagatttcactctcaccatcagcagtctgcaacctgaagattttgcaacttactactgtcaacagagttacactacccccacgtggacgttcggccaagggaccaaggtggaaatcaaa

SEQ ID NO: 24334 - protein, 108 aa, Artificial Sequence
  Description of Artificial Sequence: Synthetic polypeptide
DIQMTQSPSSLSASVGDRVTITCRASQNINNYLNWYQQKPGKGPKVLIFTTSSLQSGVPSRFSGSGSGTDFTLTISSLQPEDFATYYCQQSYTTPTWTFGQGTKVEIK

SEQ ID NO: 24335 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatactgcatccagtttgcaaagtggggtcccatcaaggttcagcggcagtggatctgggacagaattcactctcacaatcagcagcctgcagcctgaagattttgcaacttattactgtctacaacataatagttacccgttgacgttcggcccagggaccaaggtggtcatcaaa

SEQ ID NO: 24336 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASSLQSGVPSRFSGSGSGTEFTLTISSLQPEDFATYYCLQHNSYPLTFGPGTKVVIK

SEQ ID NO: 24337 - DNA, 321 bp, Artificial Sequence
  Description of Artificial Sequence: Synthetic polynucleotide
gaaatagtgatgacgcagtctccatccaccctgtctgtgtctccaggggaaagagccaccctctcctgcagggccagtcagagtgttagcagcaacttagcctggttccagcagaaacctggccaggctcccaggctcctcatcaatggtgcatccaccagggccagtggtatcccagccaggttcagtggcagtgggtctgggacagagttcactctcaccatcagcagcctgcagtctgaagattttgcagtttattactgtcagcagtataataactggcctctgacgttcggccaagggaccaaggtggaaatcaaa

SEQ ID NO: 24338 - protein, 107 aa, Artificial Sequence
  Description of Artificial Sequence: Synthetic polypeptide
EIVMTQSPSTLSVSPGERATLSCRASQSVSSNLAWFQQKPGQAPRLLINGASTRASGIPARFSGSGSGTEFTLTISSLQSEDFAVYYCQQYNNWPLTFGQGTKVEIK

SEQ ID NO: 24339 - DNA, 324 bp, Artificial Sequence
  Description of Artificial Sequence: Synthetic polynucleotide
gacatccagatgacccagtctccatcctccctgtctgcatctgtaggagacagagtctccatcacttgccgggcaagtcagaatattaacaactatttaaattggtatcagcagaaaccagggaaaggccctaaggtcctgatccttactgcatccagtttgcaaagtggggtcccatcaaggttcagtggcagtggatctgggacagatttcactctcaccatcagcagtctacaacctgaagattttgcaacttactactgtcaacagacttacactacccccacgtggacgttcggccaagggaccaaggtggaaatcaaa

SEQ ID NO: 24340 - protein, 108 aa, Artificial Sequence
  Description of Artificial Sequence: Synthetic polypeptide
DIQMTQSPSSLSASVGDRVSITCRASQNINNYLNWYQQKPGKGPKVLILTASSLQSGVPSRFSGSGSGTDFTLTISSLQPEDFATYYCQQTYTTPTWTFGQGTKVEIK

SEQ ID NO: 24341 - DNA, 321 bp, Artificial Sequence
  Description of Artificial Sequence: Synthetic polynucleotide
gacatccacatgacccagtctccatcctccctgtctgcatctgtaggagacagagtcaccatcacttgccgggcaagtcagagcattatcagctatttaaattggtatcagcagaaaccagggaaagcccctaaggtcctgatctatactgcatccagtttgcaaactggggtcccatcagggttcagtggcagtggatctgggacagatttcactctcaccatcagcagtctgcaacctgaagattttgcaacttactactgtcaacagacttacagtcccccgctcactttcggcggtgggaccaaggtggagatcaaa

SEQ ID NO: 24342 - protein, 107 aa, Artificial Sequence
  Description of Artificial Sequence: Synthetic polypeptide
DIHMTQSPSSLSASVGDRVTITCRASQSIISYLNWYQQKPGKAPKVLIYTASSLQTGVPSGFSGSGSGTDFTLTISSLQPEDFATYYCQQTYSPPLTFGGGTKVEIK

SEQ ID NO: 24343 - DNA, 321 bp, Artificial Sequence
  Description of Artificial Sequence: Synthetic polynucleotide
gacatccagatgacccagtctccatcctccctgtctgcgtctgtaggagacagagtcaccatcacttgccgggcaagtcagggcattagaaatgatttaggctggtatcagcagaaaccagggaaagcccctaagcgcctgatctatactgcatccaatttgcaaagtggggtcccatcaaggttcagcggcagtggatctgggacagaattcactctcacaatcagcagcctgcagcctgaagattttgcaacttattactgtctacaacataataattacccgtggacgttcggcctagggaccaaggtggtcatcaaa

SEQ ID NO: 24344 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASNLQSGVPSRFSGSGSGTEFTLTISSLQPEDFATYYCLQHNNYPWTFGLGTKVVIK

SEQ ID NO: 24345 - DNA, 321 bp, Artificial Sequence
  Description of Artificial Sequence: Synthetic polynucleotide
gacatccagatgacccagtctccatcctccctgtctgcctctgtaggagacagagtcaatatcacttgccgggcaagtcaggacattagaaatgatttaggctggtatcagcagaaaccagggaaagcccctaagcgcctgatctatgctgcatccagtttgcaaagtggggtcccatcaaggttcagcggcagtggatctgggacagaattcactctcacgatcagcagcctgcagcctgaagattttgcaacttattactgtctacagcattataattaccctcgggcgttcggccaggggaccaaggtggatatcaaa

SEQ ID NO: 24346 - protein, 107 aa, Artificial Sequence
  Description of Artificial Sequence: Synthetic polypeptide
DIQMTQSPSSLSASVGDRVNITCRASQDIRNDLGWYQQKPGKAPKRLIYAASSLQSGVPSRFSGSGSGTEFTLTISSLQPEDFATYYCLQHYNYPRAFGQGTKVDIK

SEQ ID NO: 24347 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgttcactttcggcggagggaccaaggtggagatcaaa

SEQ ID NO: 24348 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPFTFGGGTKVEIK

SEQ ID NO: 24349 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcggacgagtcagggcattaacaattatttagtctggtttcagcagaaaccagggaaagcccctaagcgcctgatctatgctgcatccagtttgcaaagtggggtcccatcaaagttcagcggcagtggatctgggacagatttcactctcaccatcagcagcctgcagcctgaagattttgcaacttattactgccaacagtattatagttacccattcactttcggccctgggaccaaaatggatttcaaa

SEQ ID NO: 24350 - protein, 107 aa, Artificial Sequence
  Description of Artificial Sequence: Synthetic polypeptide
DIQMTQSPSSLSASVGDRVTITCRTSQGINNYLVWFQQKPGKAPKRLIYAASSLQSGVPSKFSGSGSGTDFTLTISSLQPEDFATYYCQQYYSYPFTFGPGTKMDFK

SEQ ID NO: 24351 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattaataattatttagtctggtttcagcagaaaccagggaaagcccctaagtccctgatctatgctgcatccagtttgctgagtggggtcccatcaaagttcagcggcagtggatctgggacagatttcactctcaccatcagcagcctgcagcctgaagattttgcaacttattactgccaacagtataatagttacccgatcaccttcggccaagggacacgactggagattaaa

SEQ ID NO: 24352 - protein, 107 aa, Artificial Sequence
  Description of Artificial Sequence: Synthetic polypeptide
DIQMTQSPSSLSASVGDRVTITCRASQGINNYLVWFQQKPGKAPKSLIYAASSLLSGVPSKFSGSGSGTDFTLTISSLQPEDFATYYCQQYNSYPITFGQGTRLEIK

SEQ ID NO: 24353 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaacaagggaaagcccctaagcgcctgatctatgctgcatccagtttgcaaagtggggtcccatcaaggttcagcggcagtggatctgggacagaattcactctcaccatcagcagcctgcagcctgaagattttgcaacttattactgtctacagcataatagatacccgctcactttcggcggagggaccaaggtggagatcaaa

SEQ ID NO: 24354 - protein, 107 aa, Artificial Sequence
  Description of Artificial Sequence: Synthetic polypeptide
DIQMTQSPSSLSASVGDRVTITCRASQGIRNDLGWYQQKQGKAPKRLIYAASSLQSGVPSRFSGSGSGTEFTLTISSLQPEDFATYYCLQHNRYPLTFGGGTKVEIK

SEQ ID NO: 24355 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattactggttattcaaattggtatcagcagaagccagggaaaacccctaaactcctgatctttgctacatacagtttggaaagtggggtcccatcaaggttcagtggcagtggatttgggacaaatttcactctcaccatcaccagtctgcaacctgaagattttgcaacttactactgtcaacagagttacagtacctcgatcaccttcggccaagggacacgactggagattaaa

SEQ ID NO: 24356 - protein, 107 aa, Artificial Sequence
  Description of Artificial Sequence: Synthetic polypeptide
DIQMTQSPSSLSASVGDRVTITCRASQSITGYSNWYQQKPGKTPKLLIFATYSLESGVPSRFSGSGFGTNFTLTITSLQPEDFATYYCQQSYSTSITFGQGTRLEIK

SEQ ID NO: 24357 - DNA, 321 bp, Artificial Sequence
  Description of Artificial Sequence: Synthetic polynucleotide
gacatccagatgacccagtctccatcctccctgtctgcgtctgtaggagacagagtcaccatcacttgccgggcaagtcagggcattagaaatgatttaggctggtatcagcagaaaccagggaaagcccctaagcgcctgatctatactgcatccagtttgcaaagtggggtcccatcaaggttcagcggcagtggatctgggacagaattcactctcacaatcagcagcctgcagcctgaagattttgcaacttattactgtctacaacataataattacccgtggacgttcggcctagggaccaaggtggtcatcaaa

SEQ ID NO: 24358 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASSLQSGVPSRFSGSGSGTEFTLTISSLQPEDFATYYCLQHNNYPWTFGLGTKVVIK

SEQ ID NO: 24359 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagtaattatttaaattggtatcagcagaaaccagggaaagcccctaagctcctgatctttgctgcttccagtttgcaaagtggggtcccatcaaggttcagtggcagtggatctgggacagatttcactctcaccatcagcggtctacaacctgaagattttgcaacttacttctgtcaacagagtttcagaaccccctttttcactttcggccctgggaccaaagtggatatcaaa

SEQ ID NO: 24360 - protein, 108 aa, Artificial Sequence
  Description of Artificial Sequence: Synthetic polypeptide
DIQMTQSPSSLSASVGDRVTITCRASQSISNYLNWYQQKPGKAPKLLIFAASSLQSGVPSRFSGSGSGTDFTLTISGLQPEDFATYFCQQSFRTPFFTFGPGTKVDIK

SEQ ID NO: 24361 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacattagcagctatttaaattggtatcagcagaaacaagggaaagcccctaagctcctgatctatgctgcatccagtttgcaaaatggggtcccatcaaggttcagtggcagaggatctgggacagatttcactctcaccatcagtagtctgcaacctgaagattttgcaacttactactgtcaacagagttacagaacccccttattcactttcggccctgggaccaaggttgatttcaaa

SEQ ID NO: 24362 - protein, 108 aa, Artificial Sequence
  Description of Artificial Sequence: Synthetic polypeptide
DIQMTQSPSSLSASVGDRVTITCRASQNISSYLNWYQQKQGKAPKLLIYAASSLQNGVPSRFSGRGSGTDFTLTISSLQPEDFATYYCQQSYRTPLFTFGPGTKVDFK

SEQ ID NO: 24363 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattttcagctatttaaattggtatcagcagaaaccagggaaagcccctaaactcctgatctatgctgcatccagtttacaaagtggggtcccatcaaggttcagtggcagtggatctgggacagatttcactctcaccatcagcagtctccaacctgaagattttgcaacttacttctgtcaacagagtttcagaacccccttattcactttcggccctgggaccaaggtggatttcaaa

SEQ ID NO: 24364 - protein, 108 aa, Artificial Sequence
  Description of Artificial Sequence: Synthetic polypeptide
DIQMTQSPSSLSASVGDRVTITCRASQSIFSYLNWYQQKPGKAPKLLIYAASSLQSGVPSRFSGSGSGTDFTLTISSLQPEDFATYFCQQSFRTPLFTFGPGTKVDFK

SEQ ID NO: 24365 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcaggtatttaaattggtatcagcagaaaccagggagagcccctaaactcctgatctgttctacatccagtttgcaaagtggggtcccatcaaggttcagtggcagtggatctgggacagatttcactctcaccatcagcagtctgcaacctgaagattttgcaacttattactgtcaacagagttacagtacccccacgtggacgttcggccaagggaccaaggtggaaatcaga

SEQ ID NO: 24366 - protein, 108 aa, Artificial Sequence
  Description of Artificial Sequence: Synthetic polypeptide
DIQMTQSPSSLSASVGDRVTITCRASQSISRYLNWYQQKPGRAPKLLICSTSSLQSGVPSRFSGSGSGTDFTLTISSLQPEDFATYYCQQSYSTPTWTFGQGTKVEIR

SEQ ID NO: 24367 - DNA, 321 bp, Artificial Sequence
  Description of Artificial Sequence: Synthetic polynucleotide
gaaatagtgatgacgcagtctccatccaccctgtctgtgtctccaggggaaagagtcaccctctcttgcagggccagtcagagtgttagcagcaacttagcctggtttcagcagaaacctggccaggctcccaggctcctcatcaatggtgcatccaccagggccagtggtatcccagccaggttcagtggcagtgggtctgggacagagttcactctcaccatcagcagcctgcagtctgaagattttgcagtttattactgtcagcagtataataactgtcctctgacgttcggccaagggaccaaggtggaaatcaaa

SEQ ID NO: 24368 - protein, 107 aa, Artificial Sequence
  Description of Artificial Sequence: Synthetic polypeptide
EIVMTQSPSTLSVSPGERVTLSCRASQSVSSNLAWFQQKPGQAPRLLINGASTRASGIPARFSGSGSGTEFTLTISSLQSEDFAVYYCQQYNNCPLTFGQGTKVEIK

SEQ ID NO: 24369 - DNA, 324 bp, Artificial Sequence
  Description of Artificial Sequence: Synthetic polynucleotide
gacatccacatgacccagtctccatcctccctgtctgcatctgtgggagacaaagtctccatcacttgccgggcaagtcaccatattagcaactatttaaattggtatcagcagaaaccagggaaaggccctaaggtcctgatccttactgcatccagtttgcaaagtggggtcccatcaaggttcagtggcagtggatctgggacagatttcactctcaccatcagcagtctgcaacctgaagattttgcaacttactactgtcaacagagttacactacccccacgtggacgttcggccaagggaccaaggtggaaatcaaa

SEQ ID NO: 24370 - protein, 108 aa, Artificial Sequence
  Description of Artificial Sequence: Synthetic polypeptide
DIHMTQSPSSLSASVGDKVSITCRASHHISNYLNWYQQKPGKGPKVLILTASSLQSGVPSRFSGSGSGTDFTLTISSLQPEDFATYYCQQSYTTPTWTFGQGTKVEIK

SEQ ID NO: 24371 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctttgctgcatccagtttacaaagtggggtcccatcaaggttcagcggcagtggatctgggacagaattcactctcacaatcagcagcctgcagcctgaagattttgcaacttattactgtctacagcataatagttacccgttcactttcggcggagggaccaaggtggagatcaaa

SEQ ID NO: 24372 - protein, 107 aa, Artificial Sequence
  Description of Artificial Sequence: Synthetic polypeptide
DIQMTQSPSSLSASVGDRVTITCRASQGIRNDLGWYQQKPGKAPKRLIFAASSLQSGVPSRFSGSGSGTEFTLTISSLQPEDFATYYCLQHNSYPFTFGGGTKVEIK

SEQ ID NO: 24373 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagatttcattctcacaatcagcagcctgcagcctgaagattttgcaacttattactgtctacagcatagtagttaccccctcactttcggcggagggaccaaggtggagatcaaa

SEQ ID NO: 24374 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTDFILTISSLQPEDFATYYCLQHSSYPLTFGGGTKVEIK

SEQ ID NO: 24375 - DNA, 321 bp, Artificial Sequence
  Description of Artificial Sequence: Synthetic polynucleotide
gacatccagatgacccagtctccatcctcactgtctgcatctgtgggagacagagtcaccatcacttgtcgggcgagtcaaggcattagcaaatatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttacccgttcaggtttggccaggggaccaagctggagatcaaa

SEQ ID NO: 24376 - protein, 107 aa, Artificial Sequence
  Description of Artificial Sequence: Synthetic polypeptide
DIQMTQSPSSLSASVGDRVTITCRASQGISKYLAWFQQKPGKAPKSLIYAASSLQSGVPSKFSGSGSGTDFTLTISSLQPEDFATYYCQQYNSYPFRFGQGTKLEIK

SEQ ID NO: 24377 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaataatttaggctggtatcagcagaaaccagggaaagcccctaagcgcctgatctatcctgcatccagtttgcaaactggggtcccatcaaggttcagcggcagtggatctgggacagaattcactctcacaatcagcagcctgcagcctgaagattttgcaacttatttctgtctacaggataatagttacccattcactttcggccctgggaccaaagtggatatcaaa

SEQ ID NO: 24378 - protein, 107 aa, Artificial Sequence
  Description of Artificial Sequence: Synthetic polypeptide
DIQMTQSPSSLSASVGDRVTITCRASQDIRNNLGWYQQKPGKAPKRLIYPASSLQTGVPSRFSGSGSGTEFTLTISSLQPEDFATYFCLQDNSYPFTFGPGTKVDIK

SEQ ID NO: 24379 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaaacgcctgatctatactgcatccagtttgcaaagtggggtcccatcaaggttcagcggcagtggttctgggacagaattcactctcacaatcagcagcctgcagcctgaagattttgcaacttattactgtctacagcataatacttacccgctcactttcggcggagggaccaaggtggagatcaaa

SEQ ID NO: 24380 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASSLQSGVPSRFSGSGSGTEFTLTISSLQPEDFATYYCLQHNTYPLTFGGGTKVEIK

SEQ ID NO: 24381 - DNA, 321 bp, Artificial Sequence
  Description of Artificial Sequence: Synthetic polynucleotide
gacatccagatgacccagtctccatcctcactgtctgcgtctgtaggagacagagtcaccatcatttgtcgggcgagtcaggacattagcaattatttagcctggtttcaggagaaaccagggaaagcccataagtccctgatctatggtgcatccagtttgcggagtggggtcccatcaaagttcagcggcagtggatctgggacagatttcaatctcaccatcagcagcctgcagcctgaagatcttgcaacttattactgccaacagtatcatagttacccattcactttcggccctgggaccaaagtggatttcaaa

SEQ ID NO: 24382 - protein, 107 aa, Artificial Sequence
  Description of Artificial Sequence: Synthetic polypeptide
DIQMTQSPSSLSASVGDRVTIICRASQDISNYLAWFQEKPGKAHKSLIYGASSLRSGVPSKFSGSGSGTDFNLTISSLQPEDLATYYCQQYHSYPFTFGPGTKVDFK

SEQ ID NO: 24383 - DNA, 321 bp, Artificial Sequence
  Description of Artificial Sequence: Synthetic polynucleotide
gacatccagatgacccagtctccatcctcactgtctgcatctgtaggagacagagtcaccatcacttgccgggcgagtcagggcattggcatttatttagcctggtttcagcagaaaccagggaaagcccctaagtccctgatctctgctgcatccagtttgcaaagtggggtcccatcaaagttcagcggcagtggatctgggacagagttcactctcaccatcagcagcctgcagcctgaagattttgcaacttattactgccaacagtataatagttacccattcactttcggccctgggaccaaagtggatatcaaa

SEQ ID NO: 24384 - protein, 107 aa, Artificial Sequence
  Description of Artificial Sequence: Synthetic polypeptide
DIQMTQSPSSLSASVGDRVTITCRASQGIGIYLAWFQQKPGKAPKSLISAASSLQSGVPSKFSGSGSGTEFTLTISSLQPEDFATYYCQQYNSYPFTFGPGTKVDIK

SEQ ID NO: 24385 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacacctccaacaataacaactacttaacttggtaccagcagaaacctggacagcgtcctaacctgctcatttactgggcatctacccgggaatccggggtccctgaccgattcagtggcagcgggtctgggacagatttcactctcaccatcagcagcctgcaggctgaagatgtggcagtttattactgtcagcaattttatagtactcctccgacgttcggccaagggaccaaggtggaaatcaaa

SEQ ID NO: 24386 - protein, 113 aa, Artificial Sequence
  Description of Artificial Sequence: Synthetic polypeptide
DIVMTQSPDSLAVSLGERATINCKSSQSVLYTSNNNNYLTWYQQKPGQRPNLLIYWASTRESGVPDRFSGSGSGTDFTLTISSLQAEDVAVYYCQQFYSTPPTFGQGTKVEIK

SEQ ID NO: 24387 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagaagaaaccagggaaagcccctaagcgcctgatcaatgctgcatccagtttgcaaagtggggtcccatcaaggttcagcggcagtggatctgggacagaattcactctcacaatcagcagcctgcagcctgaagattttgcaacttattactgtctacaagataatagttacccgttcactttcggcggagggaccaaggtggagatcaca

SEQ ID NO: 24388 - protein, 107 aa, Artificial Sequence
  Description of Artificial Sequence: Synthetic polypeptide
DIQMTQSPSSLSASVGDRVTITCRASQGIRNDLGWYQKKPGKAPKRLINAASSLQSGVPSRFSGSGSGTEFTLTISSLQPEDFATYYCLQDNSYPFTFGGGTKVEIT

SEQ ID NO: 24389 - DNA, 321 bp, Artificial Sequence
  Description of Artificial Sequence: Synthetic polynucleotide
gacatccagatgacccagtctccatcctccctgtctgcatttgtaggagacagagtcaccatcacttgccgggcaagtcagggcattagaaatgatttaggctggtatcagcagaaaccagggaaagcccgtaagcgcctgatctatgttgcatacagtttgcaaagtggggtcccatcaaggttcagcggcagtggatatgggacagaattcactctcacaatcagcagcttgcagcctgaagattttgcaacttattactgtatacagcaaaatagttacccgtggacgttcggccaagggaccaaggtggaaatcaaa

SEQ ID NO: 24390 - protein, 107 aa, Artificial Sequence
  Description of Artificial Sequence: Synthetic polypeptide
DIQMTQSPSSLSAFVGDRVTITCRASQGIRNDLGWYQQKPGKARKRLIYVAYSLQSGVPSRFSGSGYGTEFTLTISSLQPEDFATYYCIQQNSYPWTFGQGTKVEIK

SEQ ID NO: 24391 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcgagtcagggcattagcaattatttagcctggtatcagcagaaaccagggaaagttcctaaggtcttgatctatactgcatccactttgcaatcaggggtcccatctcggttcagtggcagtggatctgggacagatttcactctcaccgtcagcagcctgcagcctgaagatgttgcaacttattactgtcaaaagtataacagtgcccctccgatcaccttcggccaagggacacgactggagattaaa

SEQ ID NO: 24392 - protein, 108 aa, Artificial Sequence
  Description of Artificial Sequence: Synthetic polypeptide
DIQMTQSPSSLSASVGDRVTITCRASQGISNYLAWYQQKPGKVPKVLIYTASTLQSGVPSRFSGSGSGTDFTLTVSSLQPEDVATYYCQKYNSAPPITFGQGTRLEIK

SEQ ID NO: 24393 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcgtccagtgtgcaaactggggtcccatcaaggttcagcggcagtggatctgggacagaattcactctcacaatcagcagcctgcaggctgaagatttggcaatttattactgtctacagcataatagttatccgctcactttcggcggagggaccaaggtggagatcaaa

SEQ ID NO: 24394 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSVQTGVPSRFSGSGSGTEFTLTISSLQAEDLAIYYCLQHNSYPLTFGGGTKVEIK

SEQ ID NO: 24395 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtcttcagcataatagttacccgtggacgttcggccaagggaccaaggtggaaatcaaa

SEQ ID NO: 24396 - protein, 107 aa, Artificial Sequence; identical to SEQ ID NO: 24244
  Description of Artificial Sequence: Synthetic polypeptide

SEQ ID NO: 24397 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacattatcagctatttaaattggtatcagcagaaaccagagaaagcccctaaactcctgatccatattgcatccagtttgcaaagtggggtcccatcaaggttcagtggcagtggatctgggacagatttcactctcaccatcagcagtctgcaacctgaagattttgcaacttactactgtcaacagacttacagtaccccgctcactttcggcggagggaccaaggtggagatcaaa

SEQ ID NO: 24398 - protein, 107 aa, Artificial Sequence
  Description of Artificial Sequence: Synthetic polypeptide
DIQMTQSPSSLSASVGDRVTITCRASQNIISYLNWYQQKPEKAPKLLIHIASSLQSGVPSRFSGSGSGTDFTLTISSLQPEDFATYYCQQTYSTPLTFGGGTKVEIK

SEQ ID NO: 24399 - DNA, 321 bp, Artificial Sequence
  Description of Artificial Sequence: Synthetic polynucleotide
gacatccagatgacccagtctccatcctccctgtctgcatctgtaggagacagagtcaccatcacttgtcgggcaagtcagggcattagaaatgatttaggctggtatcagcagaaaccagggaaagcccctaagcgcctgatctatgctgcatccagtttgcagagtggggtcccatctaggttcagcggcagtggatctgggacagatttcactctcacaatcagcagcctgcagcctgaagattttgcaacttattactgtctacagcatagtacttaccctctcactttcggcggagggaccaaggtggagatcaaa

SEQ ID NO: 24400 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTDFTLTISSLQPEDFATYYCLQHSTYPLTFGGGTKVEIK

SEQ ID NO: 24401 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagataccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagttttatagttacccattcactttcggccctgggaccaaagtggatatcaat

SEQ ID NO: 24402 - protein, 107 aa, Artificial Sequence
  Description of Artificial Sequence: Synthetic polypeptide
DIQMTQSPSSLSASVGDRVTITCRASQGISNYLAWFQQIPGKAPKSLIYAASSLQSGVPSKFSGSGSGTDFTLTISSLQPEDFATYYCQQFYSYPFTFGPGTKVDIN

SEQ ID NO: 24403 - DNA, 324 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctattttgcatccatcagggccactggtatcccagccaggttcagtggcagtgggtctgggacagagttcactctcaccatcagcagcctgcagtctgaagattttgcagtttattactgtcagcagtataataactggcccatgtgcagttttggccaggggaccaagctggagatcaaa

SEQ ID NO: 24404 - protein, 108 aa, Artificial Sequence
  Description of Artificial Sequence: Synthetic polypeptide
EIVMTQSPATLSVSPGERATLSCRASQSVSSNLAWYQQKPGQAPRLLIYFASIRATGIPARFSGSGSGTEFTLTISSLQSEDFAVYYCQQYNNWPMCSFGQGTKLEIK

SEQ ID NO: 24405 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcaggtatttaaattggtatcagcagaaaccagggaaagcccctgagctcctgatctatgctgcttccagtttgcaaagtggggtcccatcaaggttcagtggcagtggatctgggacagatttcattctcaccatcagcagtctacaacctgaagattttgcaacttactactgtcaacagagttacaatacccccacgtggacgttcggccaagggaccaaggtggaaatcaaa

SEQ ID NO: 24406 - protein, 108 aa, Artificial Sequence
  Description of Artificial Sequence: Synthetic polypeptide
DIQMTQSPSSLSASVGDRVTITCRASQSISRYLNWYQQKPGKAPELLIYAASSLQSGVPSRFSGSGSGTDFILTISSLQPEDFATYYCQQSYNTPTWTFGQGTKVEIK

SEQ ID NO: 24407 - DNA, 321 bp, Artificial Sequence
  Description of Artificial Sequence: Synthetic polynucleotide
gacatccagatgacccagtctccatcctccctgtctgcttctgtaggagacagagtcaccatcacttgccgggcaagtcagggcattagaaatgatttagactggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 24408 - protein, 107 aa, Artificial Sequence
  Description of Artificial Sequence: Synthetic polypeptide
DIQMTQSPSSLSASVGDRVTITCRASQGIRNDLDWYQQKPGKAPKRLIYAASSLQSGVPSRFSGSGSGTEFTLTISSLQPEDFATYYCLQHNSYPLTFGGGTKVEIK

SEQ ID NO: 24409 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacattggtagttatttaaattggtatcagcagaaaccagggaaagcccctaagctcctgatctttgctgcatccagtttgcaaagtggggtcccatcaaggttcagtggcagtggatctgggacagatttcactctcaccatcagcagtctgcaacctgaagattttgcaactttcttctgtcaacagagttacagaaccccctttttcactttcggccctgggaccaaagtggatttcaaa

SEQ ID NO: 24410 - protein, 108 aa, Artificial Sequence
  Description of Artificial Sequence: Synthetic polypeptide
DIQMTQSPSSLSASVGDRVTITCRASQNIGSYLNWYQQKPGKAPKLLIFAASSLQSGVPSRFSGSGSGTDFTLTISSLQPEDFATFFCQQSYRTPFFTFGPGTKVDFK

SEQ ID NO: 24411 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatagtggtggaaagacctatttatattggtacctgcagaagccaggccagcctccacagctcctgatctatgaagtttccaaccggttctctggactgccagataggttcagtggcagcgggtcagggacagatttcacactgaaaatcagccgggtggaggctgcggatgttggggtttattactgcatgcaaactttacaccttccgtggacgttcggccaagggaccaaggtggaaatcaaa

SEQ ID NO: 24412 - protein, 112 aa, Artificial Sequence
  Description of Artificial Sequence: Synthetic polypeptide
DIVMTQTPLSLSVTPGQPASISCKSSQSLLHSGGKTYLYWYLQKPGQPPQLLIYEVSNRFSGLPDRFSGSGSGTDFTLKISRVEAADVGVYYCMQTLHLPWTFGQGTKVEIK

SEQ ID NO: 24413 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacattagtagttatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacaatacccccttattcactttcggccctgggaccaaagtggatatcaaa

SEQ ID NO: 24414 - protein, 108 aa, Artificial Sequence
  Description of Artificial Sequence: Synthetic polypeptide
DIQMTQSPSSLSASVGDRVTITCRASQNISSYLNWYQQKPGKAPKLLIYAASSLQSGVPSRFSGSGSGTDFTLTISSLQPEDFATYYCQQSYNTPLFTFGPGTKVDIK

SEQ ID NO: 24415 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcagaacagtaacagttatttaaattggtatcagcagaaaccagggaaagcccctaagctccagatctttgctgcatacagtttggaaagtggggtcccatcaaggttcagtggcaatagatctgggacagagttcactctcaccatcagcagtctgcaacctgaagattttgcaacttactactgtcaacagacttacggtacctcgatcaccttcggccaagggacacgactggagattaaa

SEQ ID NO: 24416 - protein, 107 aa, Artificial Sequence
  Description of Artificial Sequence: Synthetic polypeptide
DIQMTQSPSSLSASVGDRVTITCRTSQNSNSYLNWYQQKPGKAPKLQIFAAYSLESGVPSRFSGNRSGTEFTLTISSLQPEDFATYYCQQTYGTSITFGQGTRLEIK

SEQ ID NO: 24417 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcatcagaaatgatttaggctggtatcagcagaaaccagggaaagcccctaagcgcctgatctatgctgcatccagtttacaaagtggggtcccatcaaggttcagcggcagtggttctgggacagaattcactctcacagtcagcagcctgcagcctgaagattttgcaacttattactgtctacagcatagtagttaccctctcactttcggcggagggaccaaggtggagatcaaa

SEQ ID NO: 24418 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTVSSLQPEDFATYYCLQHSSYPLTFGGGTKVEIK

SEQ ID NO: 24419 - DNA, 321 bp, Artificial Sequence
  Description of Artificial Sequence: Synthetic polynucleotide
gacatccagatgacccagtctccatcctcccggtctgcatctgtaggggacagagtcaccatcacttgccgggcaagtcaggacattagaaatgatttaggctggtatcagcagaaaccagggagagcccctaagcgcctgatcaatggtgcatccagtgtgcaaagtggggtcccatcaaggttcagcggcagtggatctgggacagaattcactctcacaatcagcagcctgcagcctgaagattttgtaatttattactgtctacagcataatagttacccgctcactttcggcggagggaccaaggtggagatcaaa

SEQ ID NO: 24420 - protein, 107 aa, Artificial Sequence
  Description of Artificial Sequence: Synthetic polypeptide
DIQMTQSPSSRSASVGDRVTITCRASQDIRNDLGWYQQKPGRAPKRLINGASSVQSGVPSRFSGSGSGTEFTLTISSLQPEDFVIYYCLQHNSYPLTFGGGTKVEIK

SEQ ID NO: 24421 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcatagtaattacccgctcactttcggcggagggaccaaggtggagatcaaa

SEQ ID NO: 24422 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHSNYPLTFGGGTKVEIK

SEQ ID NO: 24423 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgttgcatccagtttgcaaagtggggtcccatcaaagttcagcggcagtggatctgggacagatttcactctcaccatcagcagcctgcagcctgaagattttgcaacttattactgccaacagtataatacttatccattcactttcggccctgggaccaaagtggatatcaaa

SEQ ID NO: 24424 - protein, 107 aa, Artificial Sequence
  Description of Artificial Sequence: Synthetic polypeptide
DIQMTQSPSSLSASVGDRVTITCRASQGISNYLAWFQQKPGKAPKSLIYVASSLQSGVPSKFSGSGSGTDFTLTISSLQPEDFATYYCQQYNTYPFTFGPGTKVDIK

SEQ ID NO: 24425 - DNA, 321 bp, Artificial Sequence
  Description of Artificial Sequence: Synthetic polynucleotide
gacatccagatgacccagtctccatcctccctgtgtgcatctgtaggagacagagtcaccatcacttgccgggcaagtcagaccattagcagccatttaaattggtatcagcggaaaccagggaaagcccctaaactcctgatctatgctgcatccagtttgcaaagtggggtcccatcacggttcagtggcagtggatctgggacagatttcactctcaccatcagcagtgtgcaacctgaagattttgcaacttattactgtcaacagagttacaatatctcattcactttcggccctgggaccaaagtggatatcaaa

SEQ ID NO: 24426 - protein, 107 aa, Artificial Sequence
  Description of Artificial Sequence: Synthetic polypeptide
DIQMTQSPSSLCASVGDRVTITCRASQTISSHLNWYQRKPGKAPKLLIYAASSLQSGVPSRFSGSGSGTDFTLTISSVQPEDFATYYCQQSYNISFTFGPGTKVDIK

SEQ ID NO: 24427 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttacaaagtggggtcccatcaaggttcagaggcagtggatctgggacagaattcactctcacaatcagcagcctgcagcctgaagattttgcaacttattactgtctacagcataatagttacccgtggacgttcggccaagggaccaaggtggaaatcaaa

SEQ ID NO: 24428 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFRGSGSGTEFTLTISSLQPEDFATYYCLQHNSYPWTFGQGTKVEIK

SEQ ID NO: 24429 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcatagtacttacccgctcactttcggcggagggaccaaggtggagatcaaa

SEQ ID NO: 24430 - protein, 107 aa, Artificial Sequence
  Description of Artificial Sequence: Synthetic polypeptide
DIQMTQSPSSLSASVGDRVTITCRTSQGIRNDLGWYQQKPGKAPKRLIYAASSLQSGVPSRFSGSGSGTEFTLTISSLQPEDFATYYCLQHSTYPLTFGGGTKVEIK

SEQ ID NO: 24431 - DNA, 321 bp, Artificial Sequence
  Description of Artificial Sequence: Synthetic polynucleotide
gacatccagatgacccagtctccatcctccctgtctgcttctgttggagacagagtcaccatcacttgccgggcaagtcaggtcattagagatgatttaggctggtatcagcagaaaccagggaaagcccctaagcgcctgatctatgctgcatccagtttgcaaagtggggtcccatcgaggttcagcggcagtagatctgggacagacttcactctcacaatcagcagcctgcagcctgaagattttgcaacttattactgtctacaccactatagttatcctcggacgttcggccaagggaccaaggtggaaatcaaa

SEQ ID NO: 24432 - protein, 107 aa, Artificial Sequence
  Description of Artificial Sequence: Synthetic polypeptide
DIQMTQSPSSLSASVGDRVTITCRASQVIRDDLGWYQQKPGKAPKRLIYAASSLQSGVPSRFSGSRSGTDFTLTISSLQPEDFATYYCLHHYSYPRTFGQGTKVEIK

SEQ ID NO: 24433 - DNA, 321 bp, Artificial Sequence
  Description of Artificial Sequence: Synthetic polynucleotide
gacatccagatgatccagtctccatcctccctgttcgcatctgtaggagacagagtcaccatcacttgccggacaagtcagggcattagaaatgatttaggctggtatcagcagaaaccagggaaagcccctaagcgcctgatctatgctgcatccagtttgcaaagtggggtcccatcaaaattcagcggcagtggatctgggacagaattcactctctcaatcagcagcctgcagcctgaagattttgcaacttattactgtctacagcataatagttacccgctcactttcggcggagggaccaaggtggagatcaaa

SEQ ID NO: 24434 - protein, 107 aa, Artificial Sequence
  Description of Artificial Sequence: Synthetic polypeptide
DIQMIQSPSSLFASVGDRVTITCRTSQGIRNDLGWYQQKPGKAPKRLIYAASSLQSGVPSKFSGSGSGTEFTLSISSLQPEDFATYYCLQHNSYPLTFGGGTKVEIK

SEQ ID NO: 24435 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctctgctgcatccagtttacagagtggggtcccatcacagttcagcggcagtggatttgggacagatttcactctcaccatcagcagcctgcagcctgaggattttgcaacttattactgccaacagtataatagttacccattcactttcggccctgggaccaaagtggatatcaaa

SEQ ID NO: 24436 - protein, 107 aa, Artificial Sequence
  Description of Artificial Sequence: Synthetic polypeptide
DIQMTQSPSSLSASVGDRVTITCRASQGISNYLAWFQQKPGKAPKSLISAASSLQSGVPSQFSGSGFGTDFTLTISSLQPEDFATYYCQQYNSYPFTFGPGTKVDIK

SEQ ID NO: 24437 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagaaattatttagcctggtttcagcagaaaccagggaaagcccctaagtccctgatctatgctgcatccagtttgcaaagtggggtcccatcaaacttcagcggcagtggatctgggacagatttcactctcaccatcagtagcctgcagcctgaagattttgcaacttattactgccaacagtataatagttaccctttcactatcggccctgggaccaaggtggatatcaaa

SEQ ID NO: 24438 - protein, 107 aa, Artificial Sequence
  Description of Artificial Sequence: Synthetic polypeptide
DIQMTQSPSSLSASVGDRVTITCRASQGIRNYLAWFQQKPGKAPKSLIYAASSLQSGVPSNFSGSGSGTDFTLTISSLQPEDFATYYCQQYNSYPFTIGPGTKVDIK

SEQ ID NO: 24439 - DNA, 321 bp, Artificial Sequence
  Description of Artificial Sequence: Synthetic polynucleotide
gacatccagatgacccagtctccatcctccctgtctgcatctgtaggagacagaatcaccatcacttgccgggcaagtcagggcattagaaatgatttaggctggtatcagcagaaaccagggaaagcccctaagcgcctgatctatcctgcatccagtttgcaaagtggggtcccatcaaggttcagcggcagtggatctgggacagaattcactctcacaatcagcagcctgcagcctgaagattttgcaacttattactgtctacagcataatagttacccgtggacgttcggccaagggaccaaggtggaaatcaaa

SEQ ID NO: 24440 - protein, 107 aa, Artificial Sequence
  Description of Artificial Sequence: Synthetic polypeptide
DIQMTQSPSSLSASVGDRITITCRASQGIRNDLGWYQQKPGKAPKRLIYPASSLQSGVPSRFSGSGSGTEFTLTISSLQPEDFATYYCLQHNSYPWTFGQGTKVEIK

SEQ ID NO: 24441 - DNA, 321 bp, Artificial Sequence
  Description of Artificial Sequence: Synthetic polynucleotide
gacatccagatgacccagtctccatcctccctgtctgcatctgtcggagacagagtcaccatcacttgccgggcaagtcaggacattagaaatgatttaggctggtatcagcagaagccagggaaagcccctaagcgcctgatctatgctgcatccagtttgcacagtggggtcccatcaaggttcagcggcagtggatctgggacagaattcactctcacaatcagcagcctgcagactgaagattttgcaacttattactgtctacagcattatagttaccctcggacgttcggccaagggaccaaggtggaagtcaag

SEQ ID NO: 24442 - protein, 107 aa, Artificial Sequence
  Description of Artificial Sequence: Synthetic polypeptide
DIQMTQSPSSLSASVGDRVTITCRASQDIRNDLGWYQQKPGKAPKRLIYAASSLHSGVPSRFSGSGSGTEFTLTISSLQTEDFATYYCLQHYSYPRTFGQGTKVEVK

SEQ ID NO: 24443 - DNA, 321 bp, Artificial Sequence
  Description of Artificial Sequence: Synthetic polynucleotide
gacatccagatgacccagtctccatcctcactgtctgcatctgtaggagacagaatcaccatcacttgtcgggcgagtcagggcattagcaattatttagcctggtttcagcagaaaccagggaaagcccctaagtccctgatctctgctgcatccagtttgcaaagtggggtcccttcaaagttcagcggcagtggatccgggacagatttcactctcaccatcagcagcctgcagcctgaagattttgcaacttattgctgccaacagtatcatagttacccgtggacgttcggccaagggaccaaggtggaaatcaaa

SEQ ID NO: 24444 - protein, 107 aa, Artificial Sequence
  Description of Artificial Sequence: Synthetic polypeptide
DIQMTQSPSSLSASVGDRITITCRASQGISNYLAWFQQKPGKAPKSLISAASSLQSGVPSKFSGSGSGTDFTLTISSLQPEDFATYCCQQYHSYPWTFGQGTKVEIK

SEQ ID NO: 24445 - DNA, 321 bp, Artificial Sequence
  Description of Artificial Sequence: Synthetic polynucleotide
ggcatccagatgacccagtctccatcctccctgtctgcatctgtaggagacagagtcaccatcacttgccgggcaagtcagggcattaaaaataatttaggctggtatcagcagaaaccagggaaaggccctaagtgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 24446 - protein, 107 aa, Artificial Sequence
  Description of Artificial Sequence: Synthetic polypeptide
GIQMTQSPSSLSASVGDRVTITCRASQGIKNNLGWYQQKPGKGPKCLIYAASSLQSGVPSRFSGSGSGTEFTLTISSLQPEDFATYYCLQHNSYPLTFGGGTKVEIK

SEQ ID NO: 24447 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagtattagtagttatttaaattggtatcagcagaaaccagggaaagcccctaagctcctgatctatgctgcatccagtttgcaaagtggggtcccatcaaggttcagtggcagtggatctgggacagacttcactctcaccatcagtagtctgcaacctgaagattttgcaacttacttctgtcaacagagttacagaaccccctttttcactttcggccctgggaccaaagtggatatcaaa

SEQ ID NO: 24448 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYFCQQSYRTPFFTFGPGTKVDIK

SEQ ID NO: 24449 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctacatccagtttgcaaagtggggtcccatcaaggttcagcggcagtggatctgggacagaattcactctcacaatcagcagcctgcagcctgaagattttgcaacttattactgtctacagcataatagttaccccctcactttcggcggagggaccaaggtggagatcaaa

SEQ ID NO: 24450 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYATSSLQSGVPSRFSGSGSGTEFTLTISSLQPEDFATYYCLQHNSYPLTFGGGTKVEIK

SEQ ID NO: 24451 - DNA, 321 bp, Artificial Sequence
  Description of Artificial Sequence: Synthetic polynucleotide
gacatccagatgacccagtctccatcctcactgtctgcatctgtcggagacagagtcaccatcacttgtcgggcgagtcaggacattagcaattatttagcctgggttcagcagaaaccagggaaagcccctaagtccctgatctacgctgcatccagtttgcaaagtggggtcccatcaaagttcagcggcagtggatctgggacagatttcactctcaccatcagcagcctgcagcctgaagattttgcaagttattactgccaacagtataatagtttcccgctcactttcggcggagggaccaaggtggagatcaaa

SEQ ID NO: 24452 - protein, 107 aa, Artificial Sequence
  Description of Artificial Sequence: Synthetic polypeptide
DIQMTQSPSSLSASVGDRVTITCRASQDISNYLAWVQQKPGKAPKSLIYAASSLQSGVPSKFSGSGSGTDFTLTISSLQPEDFASYYCQQYNSFPLTFGGGTKVEIK

SEQ ID NO: 24453 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtgtgcaaagtggggtcccatcaaggttcagcggcagtggatctgggacagaattcactctcacaatcagcagcctgcagcctgaagattttgcactttattactgtctacagcataatagttacccgctcactttcggcggagggaccaaggtggagatcaaa

SEQ ID NO: 24454 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSVQSGVPSRFSGSGSGTEFTLTISSLQPEDFALYYCLQHNSYPLTFGGGTKVEIK

SEQ ID NO: 24455 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatagtgatggaaagacctttttgtattggtacctgcagaagccaggccatcctccacagctcctgatctatgaagtttccaaccggttctctggagtgccagataggttcagtggcagcgggtcagggacagatttcacactgaaaatcagccgggtggaggctgaggatgttggaatttattactgcatgcaaagtatacagcttccgctctcattcggcggagggaccaaggtggagatcaac

SEQ ID NO: 24456 - protein, 112 aa, Artificial Sequence
  Description of Artificial Sequence: Synthetic polypeptide
DIVMTQTPLSLSVTPGQPASISCKSSQSLLHSDGKTFLYWYLQKPGHPPQLLIYEVSNRFSGVPDRFSGSGSGTDFTLKISRVEAEDVGIYYCMQSIQLPLSFGGGTKVEIN

SEQ ID NO: 24457 - DNA, 324 bp, Artificial Sequence
  Description of Artificial Sequence: Synthetic polynucleotide
gaaattgtgttgacgcagtctccaggcaccctgtctttgtctccaggagaaagagccaccctctcctgcagggccagtcagaatgtttacagcagctacttagcctggtaccagcagaaacctggccagactcccaggctcctcatctatggtgcatccagcagggccagtggcatcccagacaggttcagtggcagtgggtctgggacagacttcactctcaccatcagcagactggagcctgaagattttgcagtgtattactgtcagcagtatggtagctcacctcggacgttcggccaagggaccaaggtggaaatcaaa

SEQ ID NO: 24458 - protein, 108 aa, Artificial Sequence
  Description of Artificial Sequence: Synthetic polypeptide
EIVLTQSPGTLSLSPGERATLSCRASQNVYSSYLAWYQQKPGQTPRLLIYGASSRASGIPDRFSGSGSGTDFTLTISRLEPEDFAVYYCQQYGSSPRTFGQGTKVEIK

SEQ ID NO: 24459 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttagactggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatcgttacccgctcactttcggcggagggaccaaggtggagatcaaa

SEQ ID NO: 24460 - protein, 107 aa, Artificial Sequence
  Description of Artificial Sequence: Synthetic polypeptide
DIQMTQSPSSLSASVGDRVTITCRASQGIRNDLDWYQQKPGKAPKRLIYAASSLQSGVPSRFSGSGSGTEFTLTISSLQPEDFATYYCLQHNRYPLTFGGGTKVEIK

SEQ ID NO: 24461 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattaacaactatttaaattggtatcagcagaaaccagggaaagcccttaagctcttgatatacgatgcatccgatttggaaacaggggtcccatcaaggttcagtggaagtggatctgggacagattttactttcaccatcagcagtctgcagcctgaagatattgcaatatattactgtcaacagtatgaaaatctcccgatcaccttcggccaagggacacgactggagattaaa

SEQ ID NO: 24462 - protein, 107 aa, Artificial Sequence
  Description of Artificial Sequence: Synthetic polypeptide
DIQMTQSPSSLSASVGDRVTITCQASQDINNYLNWYQQKPGKALKLLIYDASDLETGVPSRFSGSGSGTDFTFTISSLQPEDIAIYYCQQYENLPITFGQGTRLEIK

SEQ ID NO: 24463 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcatagtacttaccctctcactttcggcggagggaccaaggtggagatcaaa

SEQ ID NO: 24464 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHSTYPLTFGGGTKVEIK

SEQ ID NO: 24465 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattggaaatgatttaggctggtatcagcagaaaccagagaaagcccctaagcgcctgatctatgctgcatccagtttgcatagtggggtcccatccaggttcagcggcagtggctctgggacagaattcactctcacaatcagcagcctgcagcctgaagattttgcaacttattactgtctacagcattatagttaccctcggacgtttggccaagggaccaaggtggaaatcaaa

SEQ ID NO: 24466 - protein, 107 aa, Artificial Sequence
  Description of Artificial Sequence: Synthetic polypeptide
DIQMTQSPSSLSASVGDRVTITCRASQGIGNDLGWYQQKPEKAPKRLIYAASSLHSGVPSRFSGSGSGTEFTLTISSLQPEDFATYYCLQHYSYPRTFGQGTKVEIK

SEQ ID NO: 24467 - DNA, 327 bp, Artificial Sequence
  Description of Artificial Sequence: Synthetic polynucleotide
gacatccagatgacccagtctccatcctccctgtttgcatctgtaggagacagagtcaccatcacttgccgggcaagtcagagcattagcgactatttaaattggtatcagcagaaaccagggagagcccctaaactcctgatctatgatacatccagtttgcaaagtggggtcccatcaaggttcagtggcagtggatctgggacagatttcactctcaccatcaacagtctgcaacctgaagattttgcaacttactactgtcaacagacttacaatattcttccggagcgcagttttggccgggggaccaagctggagatcaaa

SEQ ID NO: 24468 - protein, 109 aa, Artificial Sequence
  Description of Artificial Sequence: Synthetic polypeptide
DIQMTQSPSSLFASVGDRVTITCRASQSISDYLNWYQQKPGRAPKLLIYDTSSLQSGVPSRFSGSGSGTDFTLTINSLQPEDFATYYCQQTYNILPERSFGRGTKLEIK

SEQ ID NO: 24469 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatttaggctggtatcagcagaaaccagggaaagcccctaagcgcctgatctatgctgcatccaattttcaaagtggggtcccatcaaggttcagcggcagtggatctgggacagaattcactctcacaatcagcagcctgcagcctgaagattttgcaacttattactgtctacagcataataattacccgtggacgttcggccaagggaccaaggtggaaatcaaa

SEQ ID NO: 24470 - protein, 107 aa, Artificial Sequence
  Description of Artificial Sequence: Synthetic polypeptide
DIQMTQSPSSLSASVGDRVTITCRASQDIRNDLGWYQQKPGKAPKRLIYAASNFQSGVPSRFSGSGSGTEFTLTISSLQPEDFATYYCLQHNNYPWTFGQGTKVEIK

SEQ ID NO: 24471 - DNA, 324 bp, Artificial Sequence
  Description of Artificial Sequence: Synthetic polynucleotide
gacatccagatgacccagtctccagcctccctgtctgcgtctgttggagacagagtcaccatcacttgccgggcaagtcagaacattagcagctatttaaattggtatcagcagaaaccagggaaggcccctaaactcctgatctatgctgcatccgttttgcaacatgggatcccatcaaggttcagtggcaggggatctgggacagatttcactctcatcatcagtagtctgcaacctgaagattttgcaacttactactgtcaacagagttacagaacccccttattcactttcggccctgggaccaaagtagatttcaaa

SEQ ID NO: 24472 - protein, 108 aa, Artificial Sequence
  Description of Artificial Sequence: Synthetic polypeptide
DIQMTQSPASLSASVGDRVTITCRASQNISSYLNWYQQKPGKAPKLLIYAASVLQHGIPSRFSGRGSGTDFTLIISSLQPEDFATYYCQQSYRTPLFTFGPGTKVDFK

SEQ ID NO: 24473 - DNA, 321 bp, Artificial Sequence; identical to SEQ ID NO: 24257
  Description of Artificial Sequence: Synthetic polynucleotide

SEQ ID NO: 24474 - protein, 107 aa, Artificial Sequence; identical to SEQ ID NO: 24146
  Description of Artificial Sequence: Synthetic polypeptide

SEQ ID NO: 24475 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtgtgcaaagtggggtcccatcaaggttcagcggcagtggatctgggacagaattcactctcacaatcagcagcctgcagcctgaagattttgcaatttatttctgtctacagcataatagttacccgctcactttcggcggagggaccaaggtggagatcaaa

SEQ ID NO: 24476 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSVQSGVPSRFSGSGSGTEFTLTISSLQPEDFAIYFCLQHNSYPLTFGGGTKVEIK

SEQ ID NO: 24477 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcggcagcctgcagcctgaagattttgcaacttattactgtctgcaacattatagttaccctcggacgttcggcctagggaccaaggtggaaatcaaa

SEQ ID NO: 24478 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTIGSLQPEDFATYYCLQHYSYPRTFGLGTKVEIK

SEQ ID NO: 24479 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaataacaattatttagcttggtaccagcagaaaccaggacagcctcctaagctgctcatttactggacatctacccgggaatccggggtccctgaccgattcagtggcagcgggtctgggacagatttcactctcaccatcagcagcctgcaggctgaagatgtggccgtttattactgtcagcagtattatgatactcctccgacgttcggccaagggaccaaggtggaaatcaaa

SEQ ID NO: 24480 - protein, 113 aa, Artificial Sequence
  Description of Artificial Sequence: Synthetic polypeptide
DIVMTQSPDSLAVSLGERATINCKSSQSVLYSSNNNNYLAWYQQKPGQPPKLLIYWTSTRESGVPDRFSGSGSGTDFTLTISSLQAEDVAVYYCQQYYDTPPTFGQGTKVEIK

SEQ ID NO: 24481 - DNA, 336 bp, Artificial Sequence
  Description of Artificial Sequence: Synthetic polynucleotide
gatattgtgatgaaccagactccactctctctgtccgtcacccctggacagccggcctccatctcctgcaagtctagtcagagcctcctacatagtgaaggaaagacctatttgtattggtatctgcagaagccaggccagcctccacaactcctgatctatgaaatttccaaccggttctctggagtgccagctaggttaagtggcagcgggtcagggacagatttcacactgaaaatcagccgggtggaggctgaggatgttggggtttattactgcatgcaaagtacacagtttccgctcactttcggcggagggaccaaggtggagatcaaa

SEQ ID NO: 24482 - protein, 112 aa, Artificial Sequence
  Description of Artificial Sequence: Synthetic polypeptide
DIVMNQTPLSLSVTPGQPASISCKSSQSLLHSEGKTYLYWYLQKPGQPPQLLIYEISNRFSGVPARLSGSGSGTDFTLKISRVEAEDVGVYYCMQSTQFPLTFGGGTKVEIK

SEQ ID NO: 24483 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctctgctgcatccagtttgcaaagtggggtcccatcaaagttcagcggcagtggatctgggacagatttcactctcaccatcagcagcctgcagcctgaagattttgcaacttattactgccaacagtataatagttacccattcactttcggccctgggaccaaagtggatatcaaa

SEQ ID NO: 24484 - protein, 107 aa, Artificial Sequence
  Description of Artificial Sequence: Synthetic polypeptide
DIQMTQSPSSLSASVGDRVTITCRASQGISNYLAWFQQKPGKAPKSLISAASSLQSGVPSKFSGSGSGTDFTLTISSLQPEDFATYYCQQYNSYPFTFGPGTKVDIK

SEQ ID NO: 24485 - DNA, 321 bp, Artificial Sequence
  Description of Artificial Sequence: Synthetic polynucleotide
gacatccagatgacccagtctccatcctcactgtctgcatctgttggagacagagtcaccatcacttgtcgggcgagtcaggacattagcaattatttagcctggtttcagcagaaaccagggaaagcccctaagtccctgatctatgctgcatccagtttgcaaagtggggtcccatcaaagttcagaggcagtggatctgggacagatttcactctcaccatcagcagcctgcagcctgaagattttgcaacttattactgccaacagtatcatagtttcccattcactttcggccctgggaccaaagtggatgtcaaa

SEQ ID NO: 24486 - protein, 107 aa, Artificial Sequence
  Description of Artificial Sequence: Synthetic polypeptide
DIQMTQSPSSLSASVGDRVTITCRASQDISNYLAWFQQKPGKAPKSLIYAASSLQSGVPSKFRGSGSGTDFTLTISSLQPEDFATYYCQQYHSFPFTFGPGTKVDVK

SEQ ID NO: 24487 - DNA, 321 bp, Artificial Sequence
  Description of Artificial Sequence: Synthetic polynucleotide
gacatccagatgacccagtctccatcctccctgtctgcgtctgtaggagacagagtcaccatcacttgccgggcaagtcagggcattagaaatgatttaggctggtatcagcagaaaccagggaaagcccctaagcgcctgatctatacttcatccagtttgcaaagtggggtcccatcaaggttcagcggcagtggatctgggacagaattcactctcacaatcagcagcctgcagcctgaagattttgcaacttattactgtctacaacataatagttacccgtggacgttcggcctagggaccaaggtggtcatcaaa

SEQ ID NO: 24488 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTSSSLQSGVPSRFSGSGSGTEFTLTISSLQPEDFATYYCLQHNSYPWTFGLGTKVVIK

SEQ ID NO: 24489 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcgttagaaatgatttaggctggtatcagcagaaaccagggaaagcccctcagcgcctgatctatgctgcatccagtttgcaaagtggggtcccatcaaggttcaacggcagtggatctgggacagaattcactctcacaatcagcagcctgcagcctgaagattttgcaacttattactgtctacagcatagtagttacccgctcactttcggcggagggaccaaggtggagatcaaa

SEQ ID NO: 24490 - protein, 107 aa, Artificial Sequence
  Description of Artificial Sequence: Synthetic polypeptide
DIQMTQSPSSLSASVGDRVTITCRASQGVRNDLGWYQQKPGKAPQRLIYAASSLQSGVPSRFNGSGSGTEFTLTISSLQPEDFATYYCLQHSSYPLTFGGGTKVEIK

SEQ ID NO: 24491 - DNA, 321 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagttttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacgcagttttggccaggggaccaagctggagatcaaa

SEQ ID NO: 24492 - protein, 107 aa, Artificial Sequence
  Description of Artificial Sequence: Synthetic polypeptide
EIVLTQSPGTLSLSPGERATLSCRASQSFSSSYLAWYQQKPGQAPRLLIYGASSRATGIPDRFSGSGSGTDFTLTISRLEPEDFAVYYCQQYGSSRSFGQGTKLEIK

SEQ ID NO: 24493 - DNA, 321 bp, Artificial Sequence; identical to SEQ ID NO: 24257
  Description of Artificial Sequence: Synthetic polynucleotide

SEQ ID NO: 24494 - protein, 107 aa, Artificial Sequence; identical to SEQ ID NO: 24146
  Description of Artificial Sequence: Synthetic polypeptide

SEQ ID NO: 24495 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacatttttagttatttaaattggtatcatcagaaaccagggaaagcccctaagctcctgatctatgctgcatccagtttgcaaagtggggtcccatcaaggttcagtggcagtggatctgggacagatttcactctcaccatcagcagtctacaacctgaagattttgcaacttactactgtcaacagagttacagtacccccttattcactttcggccctgggaccaaagtggatatcaaa

SEQ ID NO: 24496 - protein, 108 aa, Artificial Sequence
  Description of Artificial Sequence: Synthetic polypeptide
DIQMTQSPSSLSASVGDRVTITCRASQNIFSYLNWYHQKPGKAPKLLIYAASSLQSGVPSRFSGSGSGTDFTLTISSLQPEDFATYYCQQSYSTPLFTFGPGTKVDIK

SEQ ID NO: 24497 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccaggaaaagcccctaagcgcctgatctatgctgcttccagtttgcaaagtggggtcccatcaaggttcagcggcagtggatctgggacagagttcactctcacaatcagcagcctgcagcctgaagattttgcaacttattactgtctacagcatgccagttacccgctcactttcggcggagggaccaaggtggagatcaaa

SEQ ID NO: 24498 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHASYPLTFGGGTKVEIK

SEQ ID NO: 24499 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgttgcatccagtttgcaaagtggggtcccatcaaggttcagcggcagtggatctgggacagaattcactctcacaatcagcagcctgcagcctgaagattttgcaagttattactgtctacagcataatagttacccgtggacgttcggccaagggaccaaggtggaaatcaaa

SEQ ID NO: 24500 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYVASSLQSGVPSRFSGSGSGTEFTLTISSLQPEDFASYYCLQHNSYPWTFGQGTKVEIK

SEQ ID NO: 24501 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagtggcagtggatctgggacagaattcactctcacaatcagcagcctgcagcctgaagattttgcaacttattactgtctacagcataatagttacccattcactttcggccctgggaccaaagtggatatcaaa

SEQ ID NO: 24502 - protein, 107 aa, Artificial Sequence; identical to SEQ ID NO: 24296
  Description of Artificial Sequence: Synthetic polypeptide

SEQ ID NO: 24503 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcagggcattagaaatgatttaggctggtatcagcagaaaccagggaaagcccctaagcgcctgatctatgctgcatccagtttacaaagtggggtcccatcaaggttcagcggcagtggatctgggacagaattcactctcacaatcagcagcctgcagcctgaagattttgcaacttattactgtctacagcattatagtttccctcggacgttcggccaagggaccaaagtggaaatcaaa

SEQ ID NO: 24504 - protein, 107 aa, Artificial Sequence
  Description of Artificial Sequence: Synthetic polypeptide
DIQMTQSPSSLSASVGDRVTITCRTSQGIRNDLGWYQQKPGKAPKRLIYAASSLQSGVPSRFSGSGSGTEFTLTISSLQPEDFATYYCLQHYSFPRTFGQGTKVEIK

SEQ ID NO: 24505 - DNA, 321 bp, Artificial Sequence
  Description of Artificial Sequence: Synthetic polynucleotide
gacatccagatgacccagtctccctcttccgtgtctgcatctgtaggagacagagtcaccatcacttgtcgggcgagtcagggtattagcagctggttagcctggtatcagcagaaaccagggaaagcccctaagttcctgatctatggtgcatccagtttgcaaagtggggtcccatcaaggttcagcgccagtggatctgggacagagttcactctcaccatcagcagcctgcagcctgaagattttgcaacttactgttgtcaacagtatgacagtttccctcggacgttcggccaagggaccaaggtggaaatcaaa

SEQ ID NO: 24506 - protein, 107 aa, Artificial Sequence
  Description of Artificial Sequence: Synthetic polypeptide
DIQMTQSPSSVSASVGDRVTITCRASQGISSWLAWYQQKPGKAPKFLIYGASSLQSGVPSRFSASGSGTEFTLTISSLQPEDFATYCCQQYDSFPRTFGQGTKVEIK

SEQ ID NO: 24507 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatactgcatccagtttgcaaagtggggtcccatcaaggttcagcggcagtggatctgggacagaattcactctcacaatcagcagcctgcagcctgaagattttgcaacttattactgtctacagcataatacttacccgtggacgttcggccaagggaccaaggtggaagtcaaa

SEQ ID NO: 24508 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASSLQSGVPSRFSGSGSGTEFTLTISSLQPEDFATYYCLQHNTYPWTFGQGTKVEVK

SEQ ID NO: 24509 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaca

SEQ ID NO: 24510 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIT

SEQ ID NO: 24511 - DNA, 321 bp, Artificial Sequence
  Description of Artificial Sequence: Synthetic polynucleotide
gacatccagatgacccagtctccaccctccctgtctacatctgtaggagacagagtcaccatcacttgccgggcaactcagaacattttcagctatttaaattggcatcagcagaaaccagggaaagcccctaagctcctgatccatactgcatccagtttgcaaggtggggtcccatcaaggttcagtggcagtggatctgggacagatttcactctcaccatcatcagtatgcaacctgaagatttttccacttactactgtcaactcagctacagtcccccgtacacttttggcggagggaccaaggtggagatcaaa

SEQ ID NO: 24512 - protein, 107 aa, Artificial Sequence
  Description of Artificial Sequence: Synthetic polypeptide
DIQMTQSPPSLSTSVGDRVTITCRATQNIFSYLNWHQQKPGKAPKLLIHTASSLQGGVPSRFSGSGSGTDFTLTIISMQPEDFSTYYCQLSYSPPYTFGGGTKVEIK

SEQ ID NO: 24513 - DNA, 336 bp, Artificial Sequence
  Description of Artificial Sequence: Synthetic polynucleotide
gatattgtgatgacccagactccactctctctgtccgtcacccctggacagccggcctccatctcctgcaggtctagtcagagcctcctccatagtgatggaaggacctatttgtattggtacctgcagaagccaggccagcctccacagctcctgatctatgaactttccaaccggttctctggagtgccagataggttcagtggcagcgggtcagggacagatttcacactgaaaatcagccgggtggaggctgaggatgttgggatttattcctgcttgcaaagtatacaatatcccatcaccttcggccaagggacacgactggagattaaa

SEQ ID NO: 24514 - protein, 112 aa, Artificial Sequence
  Description of Artificial Sequence: Synthetic polypeptide
DIVMTQTPLSLSVTPGQPASISCRSSQSLLHSDGRTYLYWYLQKPGQPPQLLIYELSNRFSGVPDRFSGSGSGTDFTLKISRVEAEDVGIYSCLQSIQYPITFGQGTRLEIK

SEQ ID NO: 24515 - DNA, 339 bp, Artificial Sequence
  Description of Artificial Sequence: Synthetic polynucleotide
gacatcgtgatgacccagtttccagactccctggctgtgtctctgggcgagagggccaccatcaagtgtaagtccagccagagtgttttatacagctcccacaataacaactacttagcttggtaccagcagaaaccaggacagcctcctaagttgctcctttactgggcatctacccgggaatccggggtccctgaccgattcagtggcagcgggtctgggacagaattcactctcaccatcagcagcctggaggctgaagatgtggcagtttattactgtcagcagtattatagtactcctccgacgttcggccaagggaccaaggtggaaatcaaa

SEQ ID NO: 24516 - protein, 113 aa, Artificial Sequence
  Description of Artificial Sequence: Synthetic polypeptide
DIVMTQFPDSLAVSLGERATIKCKSSQSVLYSSHNNNYLAWYQQKPGQPPKLLLYWASTRESGVPDRFSGSGSGTEFTLTISSLEAEDVAVYYCQQYYSTPPTFGQGTKVEIK

SEQ ID NO: 24517 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatggtgatggaaagacctatttgttttggtacctgcagaagccaggccagcctccacagctcctgatctatgaagtttccaatcggttctctggagtgccagataggttcagtggcagcgggtcagggacagatttcacactgaaaatcagccgggtggaggctgaggatgttggggtttattactgcatgcaaagtatacagcttccgtggacgttcggccaagggaccaaggtggaaatcaaa

SEQ ID NO: 24518 - protein, 112 aa, Artificial Sequence
  Description of Artificial Sequence: Synthetic polypeptide
DIVMTQTPLSLSVTPGQPASISCKSSQSLLHGDGKTYLFWYLQKPGQPPQLLIYEVSNRFSGVPDRFSGSGSGTDFTLKISRVEAEDVGVYYCMQSIQLPWTFGQGTKVEIK

SEQ ID NO: 24519 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcaacagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccattcactttcggccctgggaccaaagtggatatcaaa

SEQ ID NO: 24520 - protein, 107 aa, Artificial Sequence; identical to SEQ ID NO: 24296
  Description of Artificial Sequence: Synthetic polypeptide

SEQ ID NO: 24521 - DNA, 333 bp, Artificial Sequence
  Description of Artificial Sequence: Synthetic polynucleotide
gatgttgtgatgactcagtctccactctccctgcccgtcacccttggacagccggcctccatctcctgccggtctagtcaaagcctcgtatatagtgatggagacacctacttgaattggtttcagcagaggccaggccaatctccaaggcgccaaatttataaggtttctaactgggactctggggtcccagacagattcagcggcagtgggtcaggcactgatttcacactgaacatcagcagggtggaggctgaggatgttgggatttatttctgcatgcattgtacacactggctccttttcggccctgggaccaaagtggatatcaaa

SEQ ID NO: 24522 - protein, 111 aa, Artificial Sequence
  Description of Artificial Sequence: Synthetic polypeptide
DVVMTQSPLSLPVTLGQPASISCRSSQSLVYSDGDTYLNWFQQRPGQSPRRQIYKVSNWDSGVPDRFSGSGSGTDFTLNISRVEAEDVGIYFCMHCTHWLLFGPGTKVDIK

SEQ ID NO: 24523 - DNA, 336 bp, Artificial Sequence
  Description of Artificial Sequence: Synthetic polynucleotide
gatattgtgatgacccagactccactctctctgtccgtcacccctggacagccggcctccttctcctgcaagtctagtcagagcctcctgcatagtgatggaaagacctatttgtattggtacctgcagaagccaggccagcctccacagctcctgatctttgaggtttcccaccggttctctggactgccagataggttcagtggcagcgggtcagggacagatttcacactgaaaatcagccgggtggaggctgaggatgttggggtttattactgcatgcaaagtatacagcatccgttcactttcggcggagggaccagggtggagatcaaa

SEQ ID NO: 24524 - protein, 112 aa, Artificial Sequence
  Description of Artificial Sequence: Synthetic polypeptide
DIVMTQTPLSLSVTPGQPASFSCKSSQSLLHSDGKTYLYWYLQKPGQPPQLLIFEVSHRFSGLPDRFSGSGSGTDFTLKISRVEAEDVGVYYCMQSIQHPFTFGGGTRVEIK

SEQ ID NO: 24525 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtttcagcagaaaccggggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatacttacccattcactttcggccctgggaccaaagtggatttcaaa

SEQ ID NO: 24526 - protein, 107 aa, Artificial Sequence
  Description of Artificial Sequence: Synthetic polypeptide
DIQMTQSPSSLSASVGDRVTITCRASQGIRNDLGWFQQKPGKAPKRLIYAASSLQSGVPSRFSGSGSGTEFTLTISSLQPEDFATYYCLQHNTYPFTFGPGTKVDFK

SEQ ID NO: 24527 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagagatgatttaggctggtatcagcagaaaccagggaaagcccctaggcgcctgatctatggtgcattcagcttgcaaagtggggtcccatcaaggttcagcggcagtggatctgggacagaattcactctcacaatcagcagcctgcagcctgaagattttgcaacttattactgtctacagcatactagttaccctcctactttcggcggagggaccaaggtggagatcaaa

SEQ ID NO: 24528 - protein, 107 aa, Artificial Sequence
  Description of Artificial Sequence: Synthetic polypeptide
DIQMTQSPSSLSASVGDRVTITCRASQDIRDDLGWYQQKPGKAPRRLIYGAFSLQSGVPSRFSGSGSGTEFTLTISSLQPEDFATYYCLQHTSYPPTFGGGTKVEIK

SEQ ID NO: 24529 - DNA, 321 bp, Artificial Sequence
  Description of Artificial Sequence: Synthetic polynucleotide
gacatccagatgacccagtctccatcctccctgtctgcatctgtaggagacagattcaccatctctttccgggcaagtcaggacattagaagtgatttaggctggtatcagcagaaaccagggaaagcccataagcgcatcatctatgctgcatccagtttgcaaagtggggtcccatcaaggttcagcgtcagtggatctgggacagaattcactttcacaatcagcagcatgcagcctgacgatttttcaaattattactgtatacaacatattatttaccctcctactttcggcggagggaccaaggtggagatcaaa

SEQ ID NO: 24530 - protein, 107 aa, Artificial Sequence
  Description of Artificial Sequence: Synthetic polypeptide
DIQMTQSPSSLSASVGDRFTISFRASQDIRSDLGWYQQKPGKAHKRIIYAASSLQSGVPSRFSVSGSGTEFTFTISSMQPDDFSNYYCIQHIIYPPTFGGGTKVEIK

SEQ ID NO: 24531 - DNA, 321 bp, Artificial Sequence
  Description of Artificial Sequence: Synthetic polynucleotide
gacatccagatgacccagtctccatcctcactgtctgcatctgttggagacagagtcaccatcacttgccgggcaagtcaggacattagaaatgatttaggctggtatcagcagaaaccagggaaagcccctaagcgcctgatctatgctgcatccagtttgcaaagtggggtcccatcaaggttcagcggcagtggatctgggacagaattcactctcacagtcagcagcctgcagcctgaagattttgcaacttattactgtctacagcataatagttaccccttcactttcggccctgggaccaaagtggatatcaaa

SEQ ID NO: 24532 - protein, 107 aa, Artificial Sequence
  Description of Artificial Sequence: Synthetic polypeptide
DIQMTQSPSSLSASVGDRVTITCRASQDIRNDLGWYQQKPGKAPKRLIYAASSLQSGVPSRFSGSGSGTEFTLTVSSLQPEDFATYYCLQHNSYPFTFGPGTKVDIK

SEQ ID NO: 24533 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtgggttcccatcaaagttcagcggcagtggatctgggacagatttcactctcaccatcagcagcctgcagcctgaagattttgcaacttattactgccaacagtatcatagttacccattcactttcggccctgggaccaaagtggatatcaaa

SEQ ID NO: 24534 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQSGFPSKFSGSGSGTDFTLTISSLQPEDFATYYCQQYHSYPFTFGPGTKVDIK

SEQ ID NO: 24535 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattagcaattatttagcctggtttcagcagaaaccagggaaagcccctaagtccctgatctatgctgcatccagtttgcgaagtggggtcccatcaaacttcagcggcagtggatctgggacagatttcactctcaccatcagcagcctgcagcctgaaaattttgcaacttattactgccaacagtatcatagttacccattcactttcggccctgggaccaaagtggatatcaaa

SEQ ID NO: 24536 - protein, 107 aa, Artificial Sequence
  Description of Artificial Sequence: Synthetic polypeptide
DIQMTQSPSSLSASVGDRVTITCRASQDISNYLAWFQQKPGKAPKSLIYAASSLRSGVPSNFSGSGSGTDFTLTISSLQPENFATYYCQQYHSYPFTFGPGTKVDIK

SEQ ID NO: 24537 - DNA, 324 bp, Artificial Sequence
  Description of Artificial Sequence: Synthetic polynucleotide
gacatccagatgacccagtctccatcctccctgtctgcatctgtaggagacagaatcaccatcacttgccgggcaagtcagagcattagcagctatttaaattggtatcagcagaaaccagggaaagcccctaaggtcctgatctatgctgcatccagcttgcaaagtggggtcccatcaagattcagtggcagtggatctgggacagatttcactctcaccatcagcagtctgcaacctgaagattttgcaacttactactgtcaacagagttacagtacccctacgtggacgttcggccaagggaccaaggtggaaatcaaa

SEQ ID NO: 24538 - protein, 108 aa, Artificial Sequence
  Description of Artificial Sequence: Synthetic polypeptide
DIQMTQSPSSLSASVGDRITITCRASQSISSYLNWYQQKPGKAPKVLIYAASSLQSGVPSRFSGSGSGTDFTLTISSLQPEDFATYYCQQSYSTPTWTFGQGTKVEIK

SEQ ID NO: 24539 - DNA, 321 bp, Artificial Sequence
  Description of Artificial Sequence: Synthetic polynucleotide
gacatccagatgacccagtctccctcttccgtgtctgcatctgtaggagacagagtcaccatcacttgtcgggcgagtcagggtattagtagttggttagcctggtatcagcagaaaccagggaaagcccctaagctcctgatctatggtgcatccagtttgcaaagtggggtcccatcaaggttcagcgccagtggatctgggacagatttcactctcaccatcagcagcctgcagcctgaagattttgcaacttactgttgtcaacagtctgacagtttccctcggacgttcggccaagggaccaaggtggaaatcaaa

SEQ ID NO: 24540 - protein, 107 aa, Artificial Sequence
  Description of Artificial Sequence: Synthetic polypeptide
DIQMTQSPSSVSASVGDRVTITCRASQGISSWLAWYQQKPGKAPKLLIYGASSLQSGVPSRFSASGSGTDFTLTISSLQPEDFATYCCQQSDSFPRTFGQGTKVEIK

SEQ ID NO: 24541 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatattgcatccagtttgcaaagtggggtcccatcaaggttcagcggcagtggatctgggacagaattcactctcacaatcagcagcctgcagcctgaagattttgcaacttattactgtctacagcataatacttacccgtggacgttcggccaagggaccaaggtggaaatcaaa

SEQ ID NO: 24542 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYIASSLQSGVPSRFSGSGSGTEFTLTISSLQPEDFATYYCLQHNTYPWTFGQGTKVEIK

SEQ ID NO: 24543 - DNA, 339 bp, Artificial Sequence
  Description of Artificial Sequence: Synthetic polynucleotide
gacatcgtgatgacccagtttccagactccctggctgtgtctctgggcgagagggccaccatcaactgtaagtccagccagagtgttttatacagctcccacaataactactacttaacttggtaccagcagaaaccaggacagcctcataagttgctcctttactgggcatcttcccgggaatccggggtccctgaccgattcagtggcagcgggtctgggacagaattcactctcaccatcagcagcctgcaggctgaagatgtggcagtttattactgtcagcagtattatagtactcctccgacgttcggccaagggaccaaggtggaaatcaaa

SEQ ID NO: 24544 - protein, 113 aa, Artificial Sequence
  Description of Artificial Sequence: Synthetic polypeptide
DIVMTQFPDSLAVSLGERATINCKSSQSVLYSSHNNYYLTWYQQKPGQPHKLLLYWASSRESGVPDRFSGSGSGTEFTLTISSLQAEDVAVYYCQQYYSTPPTFGQGTKVEIK

SEQ ID NO: 24545 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctctgctgcatccagtttgcaaactggggtcccatcaaagttcagcggcagtggatctgggacagatttcactctcaccatcagcagcctgcagcctgaagattttgcaacttattactgccaacagtataatagttacccattcactttcggccctgggaccaaagtggatatcaaa

SEQ ID NO: 24546 - protein, 107 aa, Artificial Sequence
  Description of Artificial Sequence: Synthetic polypeptide
DIQMTQSPSSLSASVGDRVTITCRASQGISNYLAWFQQKPGKAPKSLISAASSLQTGVPSKFSGSGSGTDFTLTISSLQPEDFATYYCQQYNSYPFTFGPGTKVDIK

SEQ ID NO: 24547 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaagtgatttaggctggtatcagcagaaaccagggaaagcccctaagcgcctgatctatgctgtatccagtttgcaaagtggggtcccatcaaggttcagcggcagtggctctgggacagaattcactctcacaatcagcagcctgcagcctgaagattttgccacttattactgtctacagcatactatttaccctcctactttcggcggagggaccaaggtggagatcaaa

SEQ ID NO: 24548 - protein, 107 aa, Artificial Sequence
  Description of Artificial Sequence: Synthetic polypeptide
DIQMTQSPSSLSASVGDRVTITCRASQDIRSDLGWYQQKPGKAPKRLIYAVSSLQSGVPSRFSGSGSGTEFTLTISSLQPEDFATYYCLQHTIYPPTFGGGTKVEIK

SEQ ID NO: 24549 - DNA, 321 bp, Artificial Sequence
  Description of Artificial Sequence: Synthetic polynucleotide
gacatccagatgacccagtctccaacctcactgtctgcatctgtcggagacagagtcaccatcacttgtcgggcgagtcaggccattagcaattatttagcctggtttcagcagaaaccagggaaagcccctaagtccctgatctatgatacatccagtttgcaaagtggggtcccatcaaaattcagcggcagtgggtctgggacagatttcactctcaccatcagcaccctacagcctgaagattttgcaacttattactgccaacagtatcatagttacccgctcactttcggcggagggaccaaggtggagatcaag

SEQ ID NO: 24550 - protein, 107 aa, Artificial Sequence
  Description of Artificial Sequence: Synthetic polypeptide
DIQMTQSPTSLSASVGDRVTITCRASQAISNYLAWFQQKPGKAPKSLIYDTSSLQSGVPSKFSGSGSGTDFTLTISTLQPEDFATYYCQQYHSYPLTFGGGTKVEIK

SEQ ID NO: 24551 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccaggaaaagcccctaagcgcctgatctatcgtgcatccagtttgcaaagtggggtcccatcaaggttcagcggcagtggatctgggacagaattcactctcacaatcagcagcctgcagcctgaagattttgcaacttattactgtctacagcataatagttacccattcactttcggccctgggaccaaagtggatatcaaa

SEQ ID NO: 24552 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYRASSLQSGVPSRFSGSGSGTEFTLTISSLQPEDFATYYCLQHNSYPFTFGPGTKVDIK

SEQ ID NO: 24553 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaagtgatttaggctggtatcagcagaaaccagggaaagcccctaagcgcctgatctatactgcatccagtttgcagagtggggtcccatcaagattcagcggcagtggatctgggacagaattcactctcacattcagcagcctgcagcctgaagattttgcaacgtattactgtctacagcataatcgttacccgtggacgttcggccaagggaccaaggtggaaatcaaa

SEQ ID NO: 24554 - protein, 107 aa, Artificial Sequence
  Description of Artificial Sequence: Synthetic polypeptide
DIQMTQSPSSLSASVGDRVTITCRASQGIRSDLGWYQQKPGKAPKRLIYTASSLQSGVPSRFSGSGSGTEFTLTFSSLQPEDFATYYCLQHNRYPWTFGQGTKVEIK

SEQ ID NO: 24555 - DNA, 321 bp, Artificial Sequence
  Description of Artificial Sequence: Synthetic polynucleotide
gacatccagatgacccagtctccaatttccctgtctgcatctgtaggagacagagtcaccatcacttgccgggcaagtcaggccattagaaatgatttaggctggtatcagcagagaccagggaaagcccctaagcgcctgatctatgctgcatccagtttgcaaagtggggtcccatcaaggttcagcggcagtggatctgggacagaatttattctcacaatcagcagcctgcagcctgaagattttgcaacttattactgtctacagcattataattaccctcgcagttttggccaggggaccaagctggagatcaga

SEQ ID NO: 24556 - protein, 107 aa, Artificial Sequence
  Description of Artificial Sequence: Synthetic polypeptide
DIQMTQSPISLSASVGDRVTITCRASQAIRNDLGWYQQRPGKAPKRLIYAASSLQSGVPSRFSGSGSGTEFILTISSLQPEDFATYYCLQHYNYPRSFGQGTKLEIR

SEQ ID NO: 24557 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatcaatggtgcatccagtttgcaaagtggggtcccatcaaagttcagcggcagtggatctgggacagatttcactctcaccatcagcagcctgcagcctgaagattttgcaacttattactgccaacagtattatagttacccattcactttcggccctgggaccaaagtgaatatcaat

SEQ ID NO: 24558 - protein, 107 aa, Artificial Sequence
  Description of Artificial Sequence: Synthetic polypeptide
DIQMTQSPSSLSASVGDRVTITCRASQGISNYLAWFQQKPGKAPKSLINGASSLQSGVPSKFSGSGSGTDFTLTISSLQPEDFATYYCQQYYSYPFTFGPGTKVNIN

SEQ ID NO: 24559 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcacaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccattcactttcggccctgggaccaaagtggatatcaat

SEQ ID NO: 24560 - protein, 107 aa, Artificial Sequence
  Description of Artificial Sequence: Synthetic polypeptide
DIQMTQSPSSLSASVGDRVTITCRASQGIRNDLGWYQHKPGKAPKRLIYAASSLQSGVPSRFSGSGSGTEFTLTISSLQPEDFATYYCLQHNSYPFTFGPGTKVDIN

SEQ ID NO: 24561 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaatcagggaaaacccctaagcgcctgatctatgctgcatccagtttgcaaagtggggtcccatcaaggttcagcggcagtggatctgggacagaattcactctcacaatcagcagtctgcagcctgaagattttgcaacctattactgtctacagcataatagttacccgctcactttcggcggagggaccaaggtggagatcaaa

SEQ ID NO: 24562 - protein, 107 aa, Artificial Sequence
  Description of Artificial Sequence: Synthetic polypeptide
DIQMTQSPSSLSASVGDRVTITCRASQGIRNDLGWYQQKSGKTPKRLIYAASSLQSGVPSRFSGSGSGTEFTLTISSLQPEDFATYYCLQHNSYPLTFGGGTKVEIK

SEQ ID NO: 24563 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaagtgatttaggctggtatcaacagaaaccagggaaagcccctgagcgcctgatctatgctgcatccagtttgcaaagtggggtcccatcaaggttcagcggcagtggatctgggacagaattcactctcacaatcagcagcctgcagcctgaagattttacaacttattactgtctacagcatactatttaccctcctactttcggcggagggaccaaggtggagatcaaa

SEQ ID NO: 24564 - protein, 107 aa, Artificial Sequence
  Description of Artificial Sequence: Synthetic polypeptide
DIQMTQSPSSLSASVGDRVTITCRASQDIRSDLGWYQQKPGKAPERLIYAASSLQSGVPSRFSGSGSGTEFTLTISSLQPEDFTTYYCLQHTIYPPTFGGGTKVEIK

SEQ ID NO: 24565 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcaactatttaaattggtatcaacagcaaacagggaaagcccctaagttcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccattcactttcggccctgggaccaaagtggatatcaaa

SEQ ID NO: 24566 - protein, 107 aa, Artificial Sequence
  Description of Artificial Sequence: Synthetic polypeptide
DIQMTQSPSSLSASVGDRVTITCRASQSISNYLNWYQQQTGKAPKFLIYAASSLQSGVPSRFSGSGSGTDFTLTISSLQPEDFATYYCQQSYSTPFTFGPGTKVDIK

SEQ ID NO: 24567 - DNA, 321 bp, Artificial Sequence
  Description of Artificial Sequence: Synthetic polynucleotide
gacatccagatgatccagtctccatcctccctgtctgcatctgtaggagacagagtcaccatcacttgccgggcaagtcaggacattagaagtgatttaggctggtatcagcagaaaccagggaaagcccctaagcgcctgatctatggtgcatccagtttgcaaagtggggtcccatcaaggttcagcggcagtggatctgggacagaattcactctcacaatcagcagcctgcagcctgaagattttgcaacttattactgtctacagcatattatttaccctcctactttcggcggagggaccaaggtggagatcaaa

SEQ ID NO: 24568 - protein, 107 aa, Artificial Sequence
  Description of Artificial Sequence: Synthetic polypeptide
DIQMIQSPSSLSASVGDRVTITCRASQDIRSDLGWYQQKPGKAPKRLIYGASSLQSGVPSRFSGSGSGTEFTLTISSLQPEDFATYYCLQHIIYPPTFGGGTKVEIK

SEQ ID NO: 24569 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcggaaaccagggaaagcccctaagcgcctgatctatgctgcatccagtttgcaaagtggggtcccatcaaggttccgcggcagtggatctgggacagaattcactctcacaatcaacagtctgcagcctgaagattttgcaacctattactgtctacagcataatagttacccgctcactttcggcggagggaccaaggtggagatcaaa

SEQ ID NO: 24570 - protein, 107 aa, Artificial Sequence
  Description of Artificial Sequence: Synthetic polypeptide
DIQMTQSPSSLSASVGDRVTITCRASQGIRNDLGWYQRKPGKAPKRLIYAASSLQSGVPSRFRGSGSGTEFTLTINSLQPEDFATYYCLQHNSYPLTFGGGTKVEIK

SEQ ID NO: 24571 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcggggcattagaaatgatttaggctggtatcagcagaaaccagggaaagcccctaagcgcctgatctatgctgcattcagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 24572 - protein, 107 aa, Artificial Sequence
  Description of Artificial Sequence: Synthetic polypeptide
DIQMTQSPSSLSASVGDRVTITCRASRGIRNDLGWYQQKPGKAPKRLIYAAFSLQSGVPSRFSGSGSGTEFTLTISSLQPEDFATYYCLQHNSYPLTFGGGTKVEIK

SEQ ID NO: 24573 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttataccgctccaacaattacaactacttagcttggtaccagcacaaaccaggacagcctcctaagctgctcatttactgggcatctacccgggaatccggggtccctgaccgcttcagtggcagcgggtctgggacagatttcactctcaccatcagcagcctgcaggctgaagatgtggcagtttattactgtcagcaatattatagtactcctccgacgttcggccaagggaccaaggtggaattcaaa

SEQ ID NO: 24574 - protein, 113 aa, Artificial Sequence
  Description of Artificial Sequence: Synthetic polypeptide
DIVMTQSPDSLAVSLGERATINCKSSQSVLYRSNNYNYLAWYQHKPGQPPKLLIYWASTRESGVPDRFSGSGSGTDFTLTISSLQAEDVAVYYCQQYYSTPPTFGQGTKVEFK

SEQ ID NO: 24575 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagaccctcctgcatggtgaaggaaagacctatttgtattggtacctgcagaagccaggccagcctccacacctcctgatctatgaagtttccaaccggttctctggagtgccagataggttcagtggcagcgggtcagggacagatttcacactgaaaatcagccgggtggaggctgaggatgttgggatttattactgcatgcaaagtataaagcttccgctcactttcggcggagggaccaaggtggagatcaaa

SEQ ID NO: 24576 - protein, 112 aa, Artificial Sequence
  Description of Artificial Sequence: Synthetic polypeptide
DIVMTQTPLSLSVTPGQPASISCKSSQTLLHGEGKTYLYWYLQKPGQPPHLLIYEVSNRFSGVPDRFSGSGSGTDFTLKISRVEAEDVGIYYCMQSIKLPLTFGGGTKVEIK

SEQ ID NO: 24577 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcaggctatcaatgactggttagcctggtatcagcagaaaccagggaaagcccctaagctcctgatctatgctgcatccagtttccaaagtggggtcccatcaaggttcagcggcagtggatctgggacagatttcactctcaccatcaccagcctgcagcctgaagattttgcaacttactattgtcaacaggctagcagtttcccattcactttcggccctgggaccaaagtggatatcaaa

SEQ ID NO: 24578 - protein, 107 aa, Artificial Sequence
  Description of Artificial Sequence: Synthetic polypeptide
DIQMTQSPSSVSASVGDRVTITCRASQAINDWLAWYQQKPGKAPKLLIYAASSFQSGVPSRFSGSGSGTDFTLTITSLQPEDFATYYCQQASSFPFTFGPGTKVDIK

SEQ ID NO: 24579 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcttctagtttgcaaaatggagtcccatcaaggttcagcggcagtggatctgggacagaattcactctcacaatcagcagcctgcagcctgaagattttgcaacttattactgtctacagcataatcgttacccattcactttcggccctgggaccaaagtggatatcaaa

SEQ ID NO: 24580 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQNGVPSRFSGSGSGTEFTLTISSLQPEDFATYYCLQHNRYPFTFGPGTKVDIK

SEQ ID NO: 24581 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcaacagaaaccagggaaagcccctaagcgcctgatctatgctgcatccagtttacaaagtggggtcccatcaaggttcagcggcagtggatctgggacagaattcactctcacaatcagcagcctgcagcctgaagattttgcaacttattactgtctacagcataatagttacccattcactttcggccctgggaccaaagtggatatcaaa

SEQ ID NO: 24582 - protein, 107 aa, Artificial Sequence; identical to SEQ ID NO: 24296
  Description of Artificial Sequence: Synthetic polypeptide

SEQ ID NO: 24583 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacatttacagctatttaaattggtatcagcagaaaccagggaaagaccctaagctcctgatctatgctgcatccagtttgcatagtggggtcccgtcacggttcagtggcagtggttctgggacagatttcactctcaccatcagcagtctgcaacctgaagattttgcaacttactactgtcaacagagttacagtactccgctcactttcggcggagggaccaaggtggagatcaaa

SEQ ID NO: 24584 - protein, 107 aa, Artificial Sequence
  Description of Artificial Sequence: Synthetic polypeptide
DIQMTQSPSSLSASVGDRVTITCRASQNIYSYLNWYQQKPGKDPKLLIYAASSLHSGVPSRFSGSGSGTDFTLTISSLQPEDFATYYCQQSYSTPLTFGGGTKVEIK

SEQ ID NO: 24585 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaagtgatttaggctggtatcagcagaaaccagggaaagcccctaagcgcctgatctatgctgcatccagtttgcaaagtggggtcccatcaaggttcagcggcagtggatctgggacagaattcactctcacaatcggcagcctgcagcctgaagattttgcaacttatttctgtctacagcatactatttaccctcctactttcggcggagggaccaaggtggagatcaaa

SEQ ID NO: 24586 - protein, 107 aa, Artificial Sequence
  Description of Artificial Sequence: Synthetic polypeptide
DIQMTQSPSSLSASVGDRVTITCRASQDIRSDLGWYQQKPGKAPKRLIYAASSLQSGVPSRFSGSGSGTEFTLTIGSLQPEDFATYFCLQHTIYPPTFGGGTKVEIK

SEQ ID NO: 24587 - DNA, 321 bp, Artificial Sequence
  Description of Artificial Sequence: Synthetic polynucleotide
gacatccagatgacccagtctccatcctccctgtctgcatctataggagacagagtcaccatcacttgccgggcaagtcagggcattagaaatgatttaggctggtatcagcagaaaccagggaaagcccctaagcgcctgatctatcctgcatccagtttgcaaagtggggtcccatcaaggttcagcggcagtggatctgggacagagttcactctcacaatcagcagcctgcagcctgaagattttgcaacttattactgtctacaggataatagttaccctttcactttcggccctgggaccaaagtggatatcaaa

SEQ ID NO: 24588 - protein, 107 aa, Artificial Sequence
  Description of Artificial Sequence: Synthetic polypeptide
DIQMTQSPSSLSASIGDRVTITCRASQGIRNDLGWYQQKPGKAPKRLIYPASSLQSGVPSRFSGSGSGTEFTLTISSLQPEDFATYYCLQDNSYPFTFGPGTKVDIK

SEQ ID NO: 24589 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaactggttagcctggtatcagcagaaaccagggaaagcccctaagctcctgatctatactgcatccagtttgcaaggtggggtcccatcaaggttcagcggcagtggatctgggacagatttcactatcagcatcagcagcctgcagcctgaagattttgcaacttactattgtcaacaggctaacagtttcccaatcactttcggccctgggaccaaagtggatatcaaa

SEQ ID NO: 24590 - protein, 107 aa, Artificial Sequence
  Description of Artificial Sequence: Synthetic polypeptide
DIQMTQSPSSVSASVGDRVTITCRASQGISNWLAWYQQKPGKAPKLLIYTASSLQGGVPSRFSGSGSGTDFTISISSLQPEDFATYYCQQANSFPITFGPGTKVDIK

SEQ ID NO: 24591 - DNA, 336 bp, Artificial Sequence
  Description of Artificial Sequence: Synthetic polynucleotide
gatatcttgatgacccagactccactctctctgtccgtcacccctggacagccggcctccatctcctgcaagtctagtcagagcctcctgcatagtgagggaaagacctatttgtattggtacctgcagaagccaggccagcctccacagttcctgatctatgaagtttcccaccggctctctggagtgccagataggttcagtggcagcgggtcagggacagatttcacactgaaaatcagccgggttgaggctgaggatgttggggtttattactgcatgcaaagtatacagcttccgctcactttcggcggagggaccaaggtggagatcaaa

SEQ ID NO: 24592 - protein, 112 aa, Artificial Sequence
  Description of Artificial Sequence: Synthetic polypeptide
DILMTQTPLSLSVTPGQPASISCKSSQSLLHSEGKTYLYWYLQKPGQPPQFLIYEVSHRLSGVPDRFSGSGSGTDFTLKISRVEAEDVGVYYCMQSIQLPLTFGGGTKVEIK

SEQ ID NO: 24593 - DNA, 321 bp, Artificial Sequence; identical to SEQ ID NO: 24539
  Description of Artificial Sequence: Synthetic polynucleotide

SEQ ID NO: 24594 - protein, 107 aa, Artificial Sequence; identical to SEQ ID NO: 24540
  Description of Artificial Sequence: Synthetic polypeptide

SEQ ID NO: 24595 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaactggttagcctggtatcagcagaaaccagggaaagcccctaagctcctgatctctgctgcatccaatttgcaaagtggggtcccatcaaggttcagaggcagtggatctgggacagatttcactctcaccatcaccagcctgcagcctgaagattttgcaacttactgttgtcaacaggctaacagtctcccattcactttcggccctgggaccaaagtggatatcaaa

SEQ ID NO: 24596 - protein, 107 aa, Artificial Sequence
  Description of Artificial Sequence: Synthetic polypeptide
DIQMTQSPSSVSASVGDRVTITCRASQGISNWLAWYQQKPGKAPKLLISAASNLQSGVPSRFRGSGSGTDFTLTITSLQPEDFATYCCQQANSLPFTFGPGTKVDIK

SEQ ID NO: 24597 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtagatctgggacagaattcactctcacaatcagcagtctgcagcctgaagattttgcaacctattactgtctacagcataatagttacccgctcactttcggcggagggaccaaggtggagatcaaa

SEQ ID NO: 24598 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSRSGTEFTLTISSLQPEDFATYYCLQHNSYPLTFGGGTKVEIK

SEQ ID NO: 24599 - DNA, 321 bp, Artificial Sequence
  Description of Artificial Sequence: Synthetic polynucleotide
gacatccagatgacccagtctccacattccctgtctgcatctgtaggagacagagtcaccatcacttgccaggcgagtcagtacattagcaactatttaaattggtatcagcagaaatcaggaaaagcccctaagctcctgatctacgatggatccagtttggaaacaggggtcccatcaaggttcagtggaagtggatctgggacagattttactttcaccatcagcagcctgcagcctgaagatcttgcaacatattactgtcaacagtatgataatctcccgatcaccttcggccaagggacacgactggagattaaa

SEQ ID NO: 24600 - protein, 107 aa, Artificial Sequence
  Description of Artificial Sequence: Synthetic polypeptide
DIQMTQSPHSLSASVGDRVTITCQASQYISNYLNWYQQKSGKAPKLLIYDGSSLETGVPSRFSGSGSGTDFTFTISSLQPEDLATYYCQQYDNLPITFGQGTRLEIK

SEQ ID NO: 24601 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctggtctatcctgcatccagtttgcaaagtggggtcccatcaaggttcagcggcagtggatctgggacagaattcactctcacaatcagcagcctgcagcctgaagattttgcaacttattactgtctacaggataatagtcatccattcactttcggccctgggaccaaagtggatatcaca

SEQ ID NO: 24602 - protein, 107 aa, Artificial Sequence
  Description of Artificial Sequence: Synthetic polypeptide
DIQMTQSPSSLSASVGDRVTITCRASQGIRNDLGWYQQKPGKAPKRLVYPASSLQSGVPSRFSGSGSGTEFTLTISSLQPEDFATYYCLQDNSHPFTFGPGTKVDIT

SEQ ID NO: 24603 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattaccagctggttaacttggtatcagcagagaccagggaaagcccctaaactcctgatctatgatacatccagtttgcaaagtggggtcccatcaaggttcagcggcagtggatctgggacagatttcattttcaccatcagcagcctgcagcctgaagattttgccacttattattgtcaacagggtaacagtttcccattcactttcggccaagggaccaaagtggatatcaaa

SEQ ID NO: 24604 - protein, 107 aa, Artificial Sequence
  Description of Artificial Sequence: Synthetic polypeptide
DIQMTQSPSSVSASVGDRVTITCRASQGITSWLTWYQQRPGKAPKLLIYDTSSLQSGVPSRFSGSGSGTDFIFTISSLQPEDFATYYCQQGNSFPFTFGQGTKVDIK

SEQ ID NO: 24605 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatattgcatccagtttgcaaagtggggtcccatcaaggttcagcggcagtggatctgggacagaattcactctcacaatcagcagcctgcagcctgaagattttgcaacttattactgtctacagcataatagttacccgtggacgttcggccaagggaccaaggtggaaatcaaa

SEQ ID NO: 24606 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYIASSLQSGVPSRFSGSGSGTEFTLTISSLQPEDFATYYCLQHNSYPWTFGQGTKVEIK

SEQ ID NO: 24607 - DNA, 321 bp, Artificial Sequence
  Description of Artificial Sequence: Synthetic polynucleotide
gacatccagatgacccagtctccatcttccgtgtctgcatctgtaggagacagagtcaccttcacttgtcgggcgagtcaggatattttcgactggttagcctggtatcagcagaaacccgggacagcccctaagctcctgatctatgctgcatccagtttgcaaagtggggtcccatcaaggttcagcggcagtggatctgggacaaatttcactctcaccgtcagcggcctgcagcctgaagattttgctacttactattgtcaacaggcttacagtttcccgtggacgttcggccaagggaccaaagtggaaatcaaa

SEQ ID NO: 24608 - protein, 107 aa, Artificial Sequence
  Description of Artificial Sequence: Synthetic polypeptide
DIQMTQSPSSVSASVGDRVTFTCRASQDIFDWLAWYQQKPGTAPKLLIYAASSLQSGVPSRFSGSGSGTNFTLTVSGLQPEDFATYYCQQAYSFPWTFGQGTKVEIK

SEQ ID NO: 24609 - DNA, 321 bp, Artificial Sequence
  Description of Artificial Sequence: Synthetic polynucleotide
gacatccagatgacccagtctccatcctccctgtctgcgtctgtaggagacagagtcaccatcacttgccgggcaagtcagggcattagaactgatttaggctggtatcagcagaaaccagggaaagcccctaagcgcctgatctatgctgcatccagtttacaaagtggggtcccatcaaggttcagcggcagtggatctgggacagaattcactctcacaatcagtagtctgcagcctgaagattttgcaacctattactgtctacagcataatagttacccgctcactttcggcggagggaccaaggtggagatcaaa

SEQ ID NO: 24610 - protein, 107 aa, Artificial Sequence
  Description of Artificial Sequence: Synthetic polypeptide
DIQMTQSPSSLSASVGDRVTITCRASQGIRTDLGWYQQKPGKAPKRLIYAASSLQSGVPSRFSGSGSGTEFTLTISSLQPEDFATYYCLQHNSYPLTFGGGTKVEIK

SEQ ID NO: 24611 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatggtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttccgtggacgttcggccaggggaccaaggtggaaatcaaa

SEQ ID NO: 24612 - protein, 112 aa, Artificial Sequence
  Description of Artificial Sequence: Synthetic polypeptide
DIVMTQTPLSLSVTPGQPASISCKSSQSLLHGDGKTYLYWYLQKPGQPPQLLIYEVSNRFSGVPDRFSGSGSGTDFTLKISRVEAEDVGVYYCMQSIQLPWTFGQGTKVEIK

SEQ ID NO: 24613 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgttgcatccagtttgcaaagtggggtcccatcaaggttcagcggcagtggatctgggacagaattcactctcacaatcagcagtctgcagcctgaagattttgcaacctattactgtctacagcataatagttacccgctcactttcggcggagggaccaaggtggagatcaaa

SEQ ID NO: 24614 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYVASSLQSGVPSRFSGSGSGTEFTLTISSLQPEDFATYYCLQHNSYPLTFGGGTKVEIK

SEQ ID NO: 24615 - DNA, 336 bp, Artificial Sequence
  Description of Artificial Sequence: Synthetic polynucleotide
gaaattgtgatgacccagactccactctctctgtccgtcacccctggacagccggcctccatctcctgcaagtctagtcagagcctcctacatggtgatggaaagacctatttgtattggtacctgcagaagccaggccagcctccacagctcctgatctatgaagtttccaaccggttctctggagtgccagaaaggttcagtggtagcgggtcagggacagatttcacactgaaaatcagccgggtggaggctgaggatgttggggtttattactgtatgcaaagtatacagattccgtggacgttcggccaagggaccaaggtggaaatcaaa

SEQ ID NO: 24616 - protein, 112 aa, Artificial Sequence
  Description of Artificial Sequence: Synthetic polypeptide
EIVMTQTPLSLSVTPGQPASISCKSSQSLLHGDGKTYLYWYLQKPGQPPQLLIYEVSNRFSGVPERFSGSGSGTDFTLKISRVEAEDVGVYYCMQSIQIPWTFGQGTKVEIK

SEQ ID NO: 24617 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatactgcatccagtttgcaaagtggggtcccatcaaggttcagcggcagtggatctgggacagaattcactctcacaatcagcagcctgcagcctgaagattttgcaacttattactgtctacagcataatagttacccattcactttcggccctgggaccaaagtggatatcaaa

SEQ ID NO: 24618 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASSLQSGVPSRFSGSGSGTEFTLTISSLQPEDFATYYCLQHNSYPFTFGPGTKVDIK

SEQ ID NO: 24619 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagagatgatttaggctggtatcagcagaaaccagggaaagcccctaggcgcctgatctatgctgcattcagcttgcaaagtggggtcccatcaaggttcagcggcagtggatctgggacagaattcactctcacaatcagcagcctgcagcctgaagattttgcaacttattactgtctacagcatactagttaccctcctactttcggcggagggaccaaggtggagatcaaa

SEQ ID NO: 24620 - protein, 107 aa, Artificial Sequence
  Description of Artificial Sequence: Synthetic polypeptide
DIQMTQSPSSLSASVGDRVTITCRASQDIRDDLGWYQQKPGKAPRRLIYAAFSLQSGVPSRFSGSGSGTEFTLTISSLQPEDFATYYCLQHTSYPPTFGGGTKVEIK

SEQ ID NO: 24621 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaggattagcagctatttaaattggtatcagcagaaaccagggaaagcccctaagctcctgatctttgctgcatccagttcgcaaagtggggtcccatcaaggttcagtggcagtggatctgggacagatttcactctcaccatcagcagtctgcaacctgaagattttgcaacttactactgtcaacagagttacattaccccgctcactttcggcggagggaccacggtggagatcaga

SEQ ID NO: 24622 - protein, 107 aa, Artificial Sequence
  Description of Artificial Sequence: Synthetic polypeptide
DIQMTQSPSSLSASVGDRVTITCRASQRISSYLNWYQQKPGKAPKLLIFAASSSQSGVPSRFSGSGSGTDFTLTISSLQPEDFATYYCQQSYITPLTFGGGTTVEIR

SEQ ID NO: 24623 - DNA, 324 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagaagtaatttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcactttattactgtcagcagtataataattggcctccgtggccgttcggccaagggaccaaggtggaaatcaaa

SEQ ID NO: 24624 - protein, 108 aa, Artificial Sequence
  Description of Artificial Sequence: Synthetic polypeptide
EIVMTQSPATLSVSPGERATLSCRASQSVRSNLAWYQQKPGQAPRLLIYGASTRATGIPARFSGSGSGTEFTLTISSLQSEDFALYYCQQYNNWPPWPFGQGTKVEIK

SEQ ID NO: 24625 - DNA, 321 bp, Artificial Sequence
  Description of Artificial Sequence: Synthetic polynucleotide
gacatccagatgacccagtctccatcctccctgtctgcatctgtaggagacagagtcaccgtcacttgccgggcaagtcaggccattagagatgatttaggctggtatcagcagagaccagggaaagcccctaagcgcctgatctatgctgcatccagtttgcaaagtggggtcccatcaaggttcagcggcagtggatctgggacagaatttattctcacaatcagcagcctgcagcctgaagattttgcaacttattactgtctacagcattataattaccctcgcagttttggccaggggaccaagctggagatcaaa

SEQ ID NO: 24626 - protein, 107 aa, Artificial Sequence
  Description of Artificial Sequence: Synthetic polypeptide
DIQMTQSPSSLSASVGDRVTVTCRASQAIRDDLGWYQQRPGKAPKRLIYAASSLQSGVPSRFSGSGSGTEFILTISSLQPEDFATYYCLQHYNYPRSFGQGTKLEIK

SEQ ID NO: 24627 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagtctgcagcctgaagattttgcaacctattactgtctacagcataatcgttacccgctcactttcggcggagggaccaaggtggagatcaaa

SEQ ID NO: 24628 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNRYPLTFGGGTKVEIK

SEQ ID NO: 24629 - DNA, 324 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcaacttagcctggtaccatcagaaacctggccaggctcccaggctcctcatctatggtgcatccaccagggccactggtatcccagccaggttcagtggcagtgggtctgggacagagttcactctcaccatcagcagcctgcagtctgaagattttgcactttattactgtcagcagtataataattggcctccgtggccgttcggccaagggaccaaggtggaaatcaaa

SEQ ID NO: 24630 - protein, 108 aa, Artificial Sequence
  Description of Artificial Sequence: Synthetic polypeptide
EIVMTQSPATLSVSPGERATLSCRASQSVSSNLAWYHQKPGQAPRLLIYGASTRATGIPARFSGSGSGTEFTLTISSLQSEDFALYYCQQYNNWPPWPFGQGTKVEIK

SEQ ID NO: 24631 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagctgaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttataactgtctacagcataatagttatccgctcactttcggcggagggaccaaggtggagatcaaa

SEQ ID NO: 24632 - protein, 107 aa, Artificial Sequence
  Description of Artificial Sequence: Synthetic polypeptide
DIQMTQSPSSLSASVGDRVTITCRASQGIRNDLGWYQLKPGKAPKRLIYAASSLQSGVPSRFSGSGSGTEFTLTISSLQPEDFATYNCLQHNSYPLTFGGGTKVEIK

SEQ ID NO: 24633 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatactgcatccagtttacaaagtggggtcccatcaaggttcagcggcagtggatctgggacagatttcactctcacaatcagcagcctgcagcctgaagattttgcaagttattactgtctacagcataatagttacccgttcactttcggcggagggaccaaggtggagatcaaa

SEQ ID NO: 24634 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASSLQSGVPSRFSGSGSGTDFTLTISSLQPEDFASYYCLQHNSYPFTFGGGTKVEIK

SEQ ID NO: 24635 - DNA, 321 bp, Artificial Sequence
  Description of Artificial Sequence: Synthetic polynucleotide
gacatccagatgacacagtctccatcctccctgtctgcatctgtaggagacagagtcaccatcacttgccgggcaagtcaggacattagagatgatttaggctggtatcagcagaaaccagggaaagcccctaggcgcctgatctatgctgcattcagcttgcaaagtggggtcccatcaaggttcagcggcagtggatctgggacagaattcactctcacaatcagcagcctgcagcctgaagattttgcaacttattactgtctacagcatactagttaccctcctactttcggcggagggaccaaggtggagatcaaa

SEQ ID NO: 24636 - protein, 107 aa, Artificial Sequence; identical to SEQ ID NO: 24620
  Description of Artificial Sequence: Synthetic polypeptide

SEQ ID NO: 24637 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaagtgatttaggctggtatcagcagagaccaggaaaagcccctaagcgcctgatctatgctgcatccagtttgcaaagtggggtcccatcaaggttcagcggcagtggatctgggacagaattcactctcacaatcagcagcctacagcctgaagattttgcaacttattactgtctgcagcatactatttaccctcctactttcggcggagggaccaaggtggagatcaaa

SEQ ID NO: 24638 - protein, 107 aa, Artificial Sequence
  Description of Artificial Sequence: Synthetic polypeptide
DIQMTQSPSSLSASVGDRVTITCRASQDIRSDLGWYQQRPGKAPKRLIYAASSLQSGVPSRFSGSGSGTEFTLTISSLQPEDFATYYCLQHTIYPPTFGGGTKVEIK

SEQ ID NO: 24639 - DNA, 321 bp, Artificial Sequence
  Description of Artificial Sequence: Synthetic polynucleotide
gacatccagatgacccagtctccatcctccctgtctgcatctgttggagacagagtcaccatcacttgccaggcgagtcaggacatttccaactttttaaattggtttcggcagaaaccaggaaaagcccctaactccctgatctacgatgcatccaatttggtaacaggggtcccatcaaggttcagtggacgtggatctgggacagattttactttcaccatcagcagcctgcagcctgaagattttgcaacatattactgtcaacagtatgataatctcccgatcaccttcggccaagggacacggctggagattaaa

SEQ ID NO: 24640 - protein, 107 aa, Artificial Sequence
  Description of Artificial Sequence: Synthetic polypeptide
DIQMTQSPSSLSASVGDRVTITCQASQDISNFLNWFRQKPGKAPNSLIYDASNLVTGVPSRFSGRGSGTDFTFTISSLQPEDFATYYCQQYDNLPITFGQGTRLEIK

SEQ ID NO: 24641 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcaggtatttaagttggtatcagcagaaaccagggagagcccctaacctccagatctatgctgcatccagtttgcaaagtggggtcccatcaaggttcagtggcagtggatctgggacagatttcactctcaccatcagcagtctgcaacctgaagattttgcaacttactactgtcaacagagttacaatatcccgatcaccttcggccaagggacacgactggagattaaa

SEQ ID NO: 24642 - protein, 107 aa, Artificial Sequence
  Description of Artificial Sequence: Synthetic polypeptide
DIQMTQSPSSLSASVGDRVTITCRASQSISRYLSWYQQKPGRAPNLQIYAASSLQSGVPSRFSGSGSGTDFTLTISSLQPEDFATYYCQQSYNIPITFGQGTRLEIK

SEQ ID NO: 24643 - DNA, 321 bp, Artificial Sequence
  Description of Artificial Sequence: Synthetic polynucleotide
gacatccagatgacccagtctccatcctccctgtctgcatctgttggagacagagtcaccatcacttgccgggcaagtcagaacatttacagctatttaaattggtatcagcagaaaccagggaaagaccctaaactcctgatctatgctgcatccagtttgcatagtggggtcccgtcacggttcagtggcagtggttctgggacagatttcactctcaccatcagcagtctgcaacctgaagattttgcaactttctactgtcaacagagttacagtactccgctcactttcggcggagggaccaaggtggagatcaaa

SEQ ID NO: 24644 - protein, 107 aa, Artificial Sequence
  Description of Artificial Sequence: Synthetic polypeptide
DIQMTQSPSSLSASVGDRVTITCRASQNIYSYLNWYQQKPGKDPKLLIYAASSLHSGVPSRFSGSGSGTDFTLTISSLQPEDFATFYCQQSYSTPLTFGGGTKVEIK

SEQ ID NO: 24645 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaagtgatttaggctggtatcagcagaaaccagggaaagcccctaagcgcctgatctatgctgcatccagtttgcaaagtggggtcccatcaaggttcaccggcagtggctctgggacagaattcactctcacaatcagcagcctgcagcctgaagcttttgcaatttattactgtctccagcatactatttaccctcctactttcggcggagggaccaaggtgtggatcaaa

SEQ ID NO: 24646 - protein, 107 aa, Artificial Sequence
  Description of Artificial Sequence: Synthetic polypeptide
DIQMTQSPSSLSASVGDRVTITCRASQDIRSDLGWYQQKPGKAPKRLIYAASSLQSGVPSRFTGSGSGTEFTLTISSLQPEAFAIYYCLQHTIYPPTFGGGTKVWIK

SEQ ID NO: 24647 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaagtgatttaggctggtatcagcagaaaccagggaaagcccctaagcgcctgatctatgctgcatccagtttgcaaagtggggtcccatcaaggttcaccggcagtggatctgggacagaattcactctcacaatcagcagcgtgcagcctgaagattttgcaacttattactgtctccatcatcctatttaccctcctactttcggcggagggaccaaggtgtggatcaaa

SEQ ID NO: 24648 - protein, 107 aa, Artificial Sequence
  Description of Artificial Sequence: Synthetic polypeptide
DIQMTQSPSSLSASVGDRVTITCRASQDIRSDLGWYQQKPGKAPKRLIYAASSLQSGVPSRFTGSGSGTEFTLTISSVQPEDFATYYCLHHPIYPPTFGGGTKVWIK

SEQ ID NO: 24649 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcagggcattagaaatgatttaggctggtttcagcagaaaccagggaaagcccctaagcgcctgatctatactgcatccagtttgcaaagtggggtcccatcaaggttcagcggcagtggatctgggacagaattcactctcacaattagcagcctgcagcctgaagattttgcaacttattactgtctacagcataatagttacccgctcactttcggcggagggaccaaggtggaggtcaaa

SEQ ID NO: 24650 - protein, 107 aa, Artificial Sequence
  Description of Artificial Sequence: Synthetic polypeptide
DIQMTQSPSSLSASVGDRVTITCRTSQGIRNDLGWFQQKPGKAPKRLIYTASSLQSGVPSRFSGSGSGTEFTLTISSLQPEDFATYYCLQHNSYPLTFGGGTKVEVK

SEQ ID NO: 24651 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatgtaggctggtatcagcagaaaccagggaaagcccctgagcgcctgatctatgctgcatccagtttgcaacgtggggtcccatcaaggttcagcggcagtggatctgggacagaattcactctcacaatcagcagcctgcagcctgaagattttgcaagatattactgtctacagcattatagttaccctcctactttcggcggagggaccaaggtggagatcaaa

SEQ ID NO: 24652 - protein, 107 aa, Artificial Sequence
  Description of Artificial Sequence: Synthetic polypeptide
DIQMTQSPSSLSASVGDRVTITCRASQDIRNDVGWYQQKPGKAPERLIYAASSLQRGVPSRFSGSGSGTEFTLTISSLQPEDFARYYCLQHYSYPPTFGGGTKVEIK

SEQ ID NO: 24653 - DNA, 321 bp, Artificial Sequence
  Description of Artificial Sequence: Synthetic polynucleotide
gacatccagatgacccagtctccatcctcactgtctgcatttgtaggagacagagtcaccatcacttgttgggcgagtcagggcattaacagttatttagcctggtttcagcagagaccagggaaagcccataagtccttgatctatgctgcatccagtttgcaaggtggggtcccatcaaagttcagcggcagtggatctgggacagatttcattctcaccatcagcagcctgcagcgtgaagattttgcaacttattactgccaacagtttaatagttaccctctgacgttcggccaagggaccaaggtggaaatcaaa

SEQ ID NO: 24654 - protein, 107 aa, Artificial Sequence
  Description of Artificial Sequence: Synthetic polypeptide
DIQMTQSPSSLSAFVGDRVTITCWASQGINSYLAWFQQRPGKAHKSLIYAASSLQGGVPSKFSGSGSGTDFILTISSLQREDFATYYCQQFNSYPLTFGQGTKVEIK

SEQ ID NO: 24655 - DNA, 321 bp, Artificial Sequence
  Description of Artificial Sequence: Synthetic polynucleotide
gacatccagatgacccagtctccgtcttccgtgtctgcaactgtaggagacagagtcaccagcacttgtcgggcgagtcagggtattagtaagtggttagcctggtatcagcagaagccagggaaagcccctaaactcctgatctatgctgcatccagtttgcaaagtggggtcccatcaaggttcagcggcagtggatctgggacagatttcactctcaccatcagcagcctgcagcctgaagactctgcaacttactattgtcaacaggctaacagtttccctttcactttcggccctgggaccaaagtggatatcaaa

SEQ ID NO: 24656 - protein, 107 aa, Artificial Sequence
  Description of Artificial Sequence: Synthetic polypeptide
DIQMTQSPSSVSATVGDRVTSTCRASQGISKWLAWYQQKPGKAPKLLIYAASSLQSGVPSRFSGSGSGTDFTLTISSLQPEDSATYYCQQANSFPFTFGPGTKVDIK

SEQ ID NO: 24657 - DNA, 321 bp, Artificial Sequence
  Description of Artificial Sequence: Synthetic polynucleotide
gacatccagatgacccagtttccatcttccctgtctacatctgtaggagacagagtcaccagcacttgccgggcaagtcagaacattaggaactttttaaattggtatcagcagaaacctgagaaagaccctaagctccagatctatggtgcatccactttgcaaagtggggtcccatcaaggttcagtggcagtggatttgggacagatttcactctcaccatcagtagtctgcaacctaaagattttgcaacttactactgtcaacagacttgcagtaccccgctcactttcggcggagggaccaaggtggagatcaaa

SEQ ID NO: 24658 - protein, 107 aa, Artificial Sequence
  Description of Artificial Sequence: Synthetic polypeptide
DIQMTQFPSSLSTSVGDRVTSTCRASQNIRNFLNWYQQKPEKDPKLQIYGASTLQSGVPSRFSGSGFGTDFTLTISSLQPKDFATYYCQQTCSTPLTFGGGTKVEIK

SEQ ID NO: 24659 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaaatggttagcctggtatcagcagaaaccagggaaagcccctaaacccctgatctatgctgcatccagtttgcagagtggggtcccaacaaggttcagcggcagtggatctgggacagatttcactctcaccatcagcagcctgcagcctgaagattttgcaatttactattgtcaacaggctaacagtttcccattcactttcggccctgggaccaaagtggatatcaaa

SEQ ID NO: 24660 - protein, 107 aa, Artificial Sequence
  Description of Artificial Sequence: Synthetic polypeptide
DIQMTQSPSSVSASVGDRVTITCRASQGISKWLAWYQQKPGKAPKPLIYAASSLQSGVPTRFSGSGSGTDFTLTISSLQPEDFAIYYCQQANSFPFTFGPGTKVDIK

SEQ ID NO: 24661 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagatggttagcctggtatcagcagaaaccagggaaagcccctgaactcctgatctatgctgcatcccgtttgcaaagtgggatcccatccaggttcagcggcagtggatctgggacagacttcactctcaccatcagcagcctgcagcctgaagattttgcaacttactattgtcaacaggctaacagtttccctttcactttcggccctgggaccaaagtggatatcaaa

SEQ ID NO: 24662 - protein, 107 aa, Artificial Sequence
  Description of Artificial Sequence: Synthetic polypeptide
DIQMTQSPSSVSASVGDRVTITCRASQGISRWLAWYQQKPGKAPELLIYAASRLQSGIPSRFSGSGSGTDFTLTISSLQPEDFATYYCQQANSFPFTFGPGTKVDIK

SEQ ID NO: 24663 - DNA, 339 bp, Artificial Sequence
  Description of Artificial Sequence: Synthetic polynucleotide
gacatcgtgatgacccagtctccagactccctgtctgtgtctttgggcgagagggccaccatcaactgcaagtccatccagagtgttttatacagatccaacaataagaactacttaacttggtatcagcagaaaccaggacagcctcgtaaactgttcatttattgggcatctacccgggaatccggggtccttgaccgattcagtggcagcgggtgtgggacagatttcactctcaccatcatcagcctgcaggctgaagatgtggcactttattactgtcagcaatattatagttctccgtgcagttttggccaggggaccaagctggagatcaaa

SEQ ID NO: 24664 - protein, 113 aa, Artificial Sequence
  Description of Artificial Sequence: Synthetic polypeptide
DIVMTQSPDSLSVSLGERATINCKSIQSVLYRSNNKNYLTWYQQKPGQPRKLFIYWASTRESGVLDRFSGSGCGTDFTLTIISLQAEDVALYYCQQYYSSPCSFGQGTKLEIK

SEQ ID NO: 24665 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattacttagcctggtttcagcagaaaccagggaaagcccctaagtccctgatctctgctgcatccagtttgcaaagtggggtcccatcaaagttcagcggcagtggatctgggacagatttcactctcaccatcagcagcctgcagcctgaagattttgcaacttattactgccaacagtataatagttacccattcactttcggccctgggaccaacgtggatatcaaa

SEQ ID NO: 24666 - protein, 107 aa, Artificial Sequence
  Description of Artificial Sequence: Synthetic polypeptide
DIQMTQSPSSLSASVGDRVTITCRASQGISNYLAWFQQKPGKAPKSLISAASSLQSGVPSKFSGSGSGTDFTLTISSLQPEDFATYYCQQYNSYPFTFGPGTNVDIK

SEQ ID NO: 24667 - DNA, 321 bp, Artificial Sequence
  Description of Artificial Sequence: Synthetic polynucleotide
gacatccagatgacccagtctccatcctccctgtctacatctgtaggagacagagtcaccatcacttgccgggcaagtcagagcattatcagctatttaaattggtatcagcagaaaccagggaaagcccctaaactcctgatctatgttgcatccagtttgcaaggtggggtcccatcaaggttcaatggcagtggatctgggacagatttcactctcaccatcagcagtctgcaacctgaagattttgcaacttactactgtcaacagagttacagtaccccgtacactttcggcggggggaccaaggtggagatcaaa

SEQ ID NO: 24668 - protein, 107 aa, Artificial Sequence
  Description of Artificial Sequence: Synthetic polypeptide
DIQMTQSPSSLSTSVGDRVTITCRASQSIISYLNWYQQKPGKAPKLLIYVASSLQGGVPSRFNGSGSGTDFTLTISSLQPEDFATYYCQQSYSTPYTFGGGTKVEIK

SEQ ID NO: 24669 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcaacagaaaccagggaaagcccctaagcgcctgatctatactgcatccaatttgcaaagtggggtcccatcaaggttcagcggcagtggatctgggacagaattcactctcacaatcagcagcctgcagcctgaagattttgcaacttattactgtctacaacatagttcttaccccatcaccttcggccaagggacacgactggagattaaa

SEQ ID NO: 24670 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASNLQSGVPSRFSGSGSGTEFTLTISSLQPEDFATYYCLQHSSYPITFGQGTRLEIK

SEQ ID NO: 24671 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaagtgatttaggctggtatcagcagaaaccagggaaagcccctaagcgcctgatctatgctgcatccagtttgcaaagtggggtcccatccaggttcagcggcagtggatctgggacagaattcactctcacagtcatcagcctgcagcctgaagattttgcaacttattactgtctacagcatactatttaccctcctactttcggcggagggaccaaggtggggatcaaa

SEQ ID NO: 24672 - protein, 107 aa, Artificial Sequence
  Description of Artificial Sequence: Synthetic polypeptide
DIQMTQSPSSLSASVGDRVTITCRASQDIRSDLGWYQQKPGKAPKRLIYAASSLQSGVPSRFSGSGSGTEFTLTVISLQPEDFATYYCLQHTIYPPTFGGGTKVGIK

SEQ ID NO: 24673 - DNA, 321 bp, Artificial Sequence
  Description of Artificial Sequence: Synthetic polynucleotide
gacatccagatgacccagtctccatcttccgtgtctgcatctgtaggcgacagactcaccatcacttgtcgggcgagtcagggtattagccggtggttagcctggtatcagcagaaagtggggaaagtccccaaactcctgatctatgctgcatccaggttgcaaagtggggtcccatcaaggttcagcggcagtggatctgggacagctttcactctcaccatcggcagcctgcagcctgaagattttgcaacttactattgtcaacaggctaacagtttcccgttcactttcggccctgggaccaaagtggatctcaaa

SEQ ID NO: 24674 - protein, 107 aa, Artificial Sequence
  Description of Artificial Sequence: Synthetic polypeptide
DIQMTQSPSSVSASVGDRLTITCRASQGISRWLAWYQQKVGKVPKLLIYAASRLQSGVPSRFSGSGSGTAFTLTIGSLQPEDFATYYCQQANSFPFTFGPGTKVDLK

SEQ ID NO: 24675 - DNA, 321 bp, Artificial Sequence
  Description of Artificial Sequence: Synthetic polynucleotide
gacatccagatgacccagtctccatcctccctgtctacttctgtaggagacagagtcaccatcacttgccgggcaagtcagagcattatcagctatttaaattggtatcagcagaaaccagggaaagcccctaaactcctgatctatgttgcatccagtttgcaaagtggggtcccatcaaggttcagtggcagtggatctgggacagatttcactctcaccatcagcagtctgcaacctgaagattttgcgacttactactgtcaacagagttacagtaccccgtacactttcggcggagggaccaagatggagatcaaa

SEQ ID NO: 24676 - protein, 107 aa, Artificial Sequence
  Description of Artificial Sequence: Synthetic polypeptide
DIQMTQSPSSLSTSVGDRVTITCRASQSIISYLNWYQQKPGKAPKLLIYVASSLQSGVPSRFSGSGSGTDFTLTISSLQPEDFATYYCQQSYSTPYTFGGGTKMEIK

SEQ ID NO: 24677 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcaggacattagaagtgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaatttattactgtctacagcatactatttaccctcctactttcggcggagggaccaaggtggagatcaaa

SEQ ID NO: 24678 - protein, 107 aa, Artificial Sequence
  Description of Artificial Sequence: Synthetic polypeptide
DIQMTQSPSSLSASVGDRVTITCRTSQDIRSDLGWYQQKPGKAPKRLIYAASSLQSGVPSRFSGSGSGTEFTLTISSLQPEDFAIYYCLQHTIYPPTFGGGTKVEIK

SEQ ID NO: 24679 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaagtgatttaggctggtatcagcagaaaccagggaaagcccctaagcgcctgatctatgttgcatccagtttgcaaagtggggtcccatcaaggttcagcggcagtggatctgggacagaattcactctcacaatcagcagcctgcagcctgaagattttgcagcatattactgtctacagcatactatttaccctcctactttcggcggagggaccaaggtggagatcaaa

SEQ ID NO: 24680 - protein, 107 aa, Artificial Sequence
  Description of Artificial Sequence: Synthetic polypeptide
DIQMTQSPSSLSASVGDRVTITCRASQDIRSDLGWYQQKPGKAPKRLIYVASSLQSGVPSRFSGSGSGTEFTLTISSLQPEDFAAYYCLQHTIYPPTFGGGTKVEIK

SEQ ID NO: 24681 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcaggacatcagaaatgatttaggctggtatcagcagaaaccagggaaagcccctaagcgcctgatctttgctgcatccagtttgcaaagtggggtcccatcaagattcagcggcagtggatctgggacagaattcactctcacagtcagcagcctgcagcctgaagattttgcaacttattactgtctacagcataatagttaccctcctactttcggcggagggaccaaggtggagatcaaa

SEQ ID NO: 24682 - protein, 107 aa, Artificial Sequence
  Description of Artificial Sequence: Synthetic polypeptide
DIQMTQSPSSLSASVGDRVTITCRTSQDIRNDLGWYQQKPGKAPKRLIFAASSLQSGVPSRFSGSGSGTEFTLTVSSLQPEDFATYYCLQHNSYPPTFGGGTKVEIK

SEQ ID NO: 24683 - DNA, 321 bp, Artificial Sequence
  Description of Artificial Sequence: Synthetic polynucleotide
gacatccagatgacccagtctccatcctccctgtctgcatctgtgggagacagagtcaccatcacttgccgggcaagtcagaacattaacaggtatttaaattggtatcagcagaaaccagggaaagcccctaagctcctgatctatggtgcatccagtttgcaaagtggggtcccatcaaggttcagtggcagtggatctgggacagatttcactctcaccatcagcactctgcaacctgaagattttgcaacttactactgtcaacagacttacattaccccgctcactttcggcggagggaccaaggtggagatcaaa

SEQ ID NO: 24684 - protein, 107 aa, Artificial Sequence
  Description of Artificial Sequence: Synthetic polypeptide
DIQMTQSPSSLSASVGDRVTITCRASQNINRYLNWYQQKPGKAPKLLIYGASSLQSGVPSRFSGSGSGTDFTLTISTLQPEDFATYYCQQTYITPLTFGGGTKVEIK

SEQ ID NO: 24685 - DNA, 321 bp, Artificial Sequence
  Description of Artificial Sequence: Synthetic polynucleotide
gacatccagatgacccagtctccatcctccctgtctgcatctgtaggagacagaatcaccatcacttgccgggcaagtcaggacattagaagtgatttaggctggtatcagcagaaaccagggaaagcccctgagcgcctgatctatgctgcatccagtttgcaaagtggggtcccatcaaggttcagcggcagtggatctgggacagaattcactctcacaatcagcagcctgcagcctgaagattttgcaacttattactgtctacagcatactatttaccctcctactttcggcggagggaccaaggtggagatcaaa

SEQ ID NO: 24686 - protein, 107 aa, Artificial Sequence
  Description of Artificial Sequence: Synthetic polypeptide
DIQMTQSPSSLSASVGDRITITCRASQDIRSDLGWYQQKPGKAPERLIYAASSLQSGVPSRFSGSGSGTEFTLTISSLQPEDFATYYCLQHTIYPPTFGGGTKVEIK

SEQ ID NO: 24687 - DNA, 321 bp, Artificial Sequence
  Description of Artificial Sequence: Synthetic polynucleotide
gacatccagatgacccagtctccatcttccgtgtctgtgtctgtcggagacagagtcaccatcacttgtcgggcgagtcagggtattagcaggtggttagcctggtatcagcagaaacctgggaaagccccaaagctcctgatctatggtgcatacagtctgcaaagtggggtcccatcaaggttcagcggcagtggatctgggacagatttcactctcaccatcagcagcctgcagcctgaagattttgcaacttactattgtcaacaggctaacagtttcccattcactttcggccctgggaccaaagtggatatcaaa

SEQ ID NO: 24688 - protein, 107 aa, Artificial Sequence
  Description of Artificial Sequence: Synthetic polypeptide
DIQMTQSPSSVSVSVGDRVTITCRASQGISRWLAWYQQKPGKAPKLLIYGAYSLQSGVPSRFSGSGSGTDFTLTISSLQPEDFATYYCQQANSFPFTFGPGTKVDIK

SEQ ID NO: 24689 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcaactatttaaattggtatcaacagcaaacagggaaagcccctaagttcctgatttatgctgcatccagtttgcaaagtggggtcccatcaaggttcagtggcagtggatctgggacagatttcactctcaccatcagcagtctgcaacctgaagattttgcaacttactactgtcaacagagttacagtaccccattcactttcggccctgggaccaaagtggatatcaaa

SEQ ID NO: 24690 - protein, 107 aa, Artificial Sequence; identical to SEQ ID NO: 24566
  Description of Artificial Sequence: Synthetic polypeptide

SEQ ID NO: 24691 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagcttattagcaagtggttagcctggtatcagcagaaaccagggaaagcccctaaactcctgatctatgctgcatccagtttgcaaagtggggtcccattaaggttcagcggcagtggatctgggacagatttcactctcaccatcagcagcctgcagcctgaagattttgcaacttactattgtcaacaggctaacagtttcccattcactttcggccctgggaccaaagtggatatcaaa

SEQ ID NO: 24692 - protein, 107 aa, Artificial Sequence
  Description of Artificial Sequence: Synthetic polypeptide
DIQMTQSPSSVSASVGDRVTITCRASQLISKWLAWYQQKPGKAPKLLIYAASSLQSGVPLRFSGSGSGTDFTLTISSLQPEDFATYYCQQANSFPFTFGPGTKVDIK

SEQ ID NO: 24693 - DNA, 321 bp, Artificial Sequence
  Description of Artificial Sequence: Synthetic polynucleotide
gacatccagatgacccagtctccatcctccctgtctgcatctgtcggagacagagtcaccatcacttgccgggcaagtcaggacattagaaatgatttaggctggtatcagcagaaaccagggaaagcccctaagcgcctgatctatgctacatccagtttgcaaagtggggtcccatcaaggttcagcggcagtggatctgggacagaattcactctcacaatcagcagcctgcagcctgaagattttgcaacttattactgtctacagcataatagttaccctcctactttcggcggagggaccaaggtggagatcaaa

SEQ ID NO: 24694 - protein, 107 aa, Artificial Sequence
  Description of Artificial Sequence: Synthetic polypeptide
DIQMTQSPSSLSASVGDRVTITCRASQDIRNDLGWYQQKPGKAPKRLIYATSSLQSGVPSRFSGSGSGTEFTLTISSLQPEDFATYYCLQHNSYPPTFGGGTKVEIK

SEQ ID NO: 24695 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggccattagtaattatttagcctggtttcagcagaaaccagggaaagcccctaagtccctgatctatggtgcgtccggtttgcaaagtggggtcccatcaaagttcagcggcagtggatctgggacagatttcactctcaccatcagcagcctgcagcctgaagattttgcaacttattactgccaacagtataatagttacccattcactttcggccctgggaccaaagtggatttcaaa

SEQ ID NO: 24696 - protein, 107 aa, Artificial Sequence
  Description of Artificial Sequence: Synthetic polypeptide
DIQMTQSPSSLSASVGDRVTITCRASQAISNYLAWFQQKPGKAPKSLIYGASGLQSGVPSKFSGSGSGTDFTLTISSLQPEDFATYYCQQYNSYPFTFGPGTKVDFK

SEQ ID NO: 24697 - DNA, 321 bp, Artificial Sequence
  Description of Artificial Sequence: Synthetic polynucleotide
gacatccagatgacccagtctccatcctccctgtctacatctgtcggagacaaagtcaccatcacttgccgggcaagtcagagcattatcagctatttaaattggtatcagcagaaaccagggaaagcccctaaactcctgatctatgttgcatccagtttgcaaagtggggtcccatcaaggttcagtggcagtggatctgggacagatttcactctcaccatcagcagtctgcaacctgaagattttgcaacttactactgtcaacagagttacagtaccccgtacactttcggcggggggactaaggtggagatcaaa

SEQ ID NO: 24698 - protein, 107 aa, Artificial Sequence
  Description of Artificial Sequence: Synthetic polypeptide
DIQMTQSPSSLSTSVGDKVTITCRASQSIISYLNWYQQKPGKAPKLLIYVASSLQSGVPSRFSGSGSGTDFTLTISSLQPEDFATYYCQQSYSTPYTFGGGTKVEIK

SEQ ID NO: 24699 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcaccctcacaatcagcagcctgcagcctgaagattttgcaacatattactgtctacagcattatagttaccctcctactttcggcggagggaccaaggtggagatcaaa

SEQ ID NO: 24700 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHYSYPPTFGGGTKVEIK

SEQ ID NO: 24701 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaagtgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcatactatttaccctcccactttcggcggggggaccaaggtggagatcaaa

SEQ ID NO: 24702 - protein, 107 aa, Artificial Sequence
  Description of Artificial Sequence: Synthetic polypeptide
DIQMTQSPSSLSASVGDRVTITCRASQDIRSDLGWYQQKPGKAPKRLIYAASSLQSGVPSRFSGSGSGTEFTLTISSLQPEDFATYYCLQHTIYPPTFGGGTKVEIK

SEQ ID NO: 24703 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaagtgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcatactgtttaccctcctactttcggcggagggaccaaggtggagatcaaa

SEQ ID NO: 24704 - protein, 107 aa, Artificial Sequence
  Description of Artificial Sequence: Synthetic polypeptide
DIQMTQSPSSLSASVGDRVTITCRASQDIRSDLGWYQQKPGKAPKRLIYAASSLQSGVPSRFSGSGSGTEFTLTISSLQPEDFATYYCLQHTVYPPTFGGGTKVEIK

SEQ ID NO: 24705 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagtgaaagcccctaagcgcctgatctatgctgcacccagtttgcaaagtggggtcccatcaaggttcagcggcagtggatctgggacagaattcactctcacaatcagcagcctgcagcctgaacattttgcaacttattactgtctacagcataatagttacccgtggacgttcggccaggggaccaaggtggaaatcaaa

SEQ ID NO: 24706 - protein, 107 aa, Artificial Sequence
  Description of Artificial Sequence: Synthetic polypeptide
DIQMTQSPSSLSASVGDRVTITCRASQGIRNDLGWYQQKPVKAPKRLIYAAPSLQSGVPSRFSGSGSGTEFTLTISSLQPEHFATYYCLQHNSYPWTFGQGTKVEIK

SEQ ID NO: 24707 - DNA, 321 bp, Artificial Sequence
  Description of Artificial Sequence: Synthetic polynucleotide
gacatccagatgacccagtctccatcttccgtgtctgcatctgtaggcgacagagtcaccatcacttgtcgggcgagtcagggtattagccggtggttagcctggtatcagcagaaagtggggaaagtccccaaactcctgatctatgctgcatccaggttgcaaagtggggtcccatcaaggttcagcggcagtggatctgggacagatttcactctcaccatcggcagcctgcagcctgaagattttgcaacttactattgtcaacaggctaacattttcccgttcactttcggccctgggaccaaagtggatctcaaa

SEQ ID NO: 24708 - protein, 107 aa, Artificial Sequence
  Description of Artificial Sequence: Synthetic polypeptide
DIQMTQSPSSVSASVGDRVTITCRASQGISRWLAWYQQKVGKVPKLLIYAASRLQSGVPSRFSGSGSGTDFTLTIGSLQPEDFATYYCQQANIFPFTFGPGTKVDLK

SEQ ID NO: 24709 - DNA, 321 bp, Artificial Sequence
  Description of Artificial Sequence: Synthetic polynucleotide
gacatccagatgacccagtctccatcctccctgtctacatttgtaggagacagagtcaccattacttgtcgggcaagtcagagaattatcagctatttaaattggtttcagcagaaaccagggaaagcccctaaactcctgatctatgttgcatccagtttgcaaagtggggtcccgtcaaggttcagtggcagtggatctgggacatatttcactctcaccatcagcagtctgcaacctgaagattttgcgacttactactgtcaacagagttacagtaccccgtacactttcggcggagggaccaagatggagatcaaa

SEQ ID NO: 24710 - protein, 107 aa, Artificial Sequence
  Description of Artificial Sequence: Synthetic polypeptide
DIQMTQSPSSLSTFVGDRVTITCRASQRIISYLNWFQQKPGKAPKLLIYVASSLQSGVPSRFSGSGSGTYFTLTISSLQPEDFATYYCQQSYSTPYTFGGGTKMEIK

SEQ ID NO: 24711 - DNA, 321 bp, Artificial Sequence
  Description of Artificial Sequence: Synthetic polynucleotide
gacatccagatgacccagtctccatcctccctgtctacatctgtaggagacagagtcaccatcacttgccgggcaagtcagatcattatcagctatttaaattggtatcagcagaaaccagggaaagcccctaaactcctgatctttgttgcatccagtttgcaaagtggggtcccatcaaggttcagtggcagtggatctgggacagatttcactctcaccatcagcagtctgcaacctgaagattttgcaacttactactgtcaacagagttacagtaccccgtacactttcggcggggggaccaaggtggagatcaaa

SEQ ID NO: 24712 - protein, 107 aa, Artificial Sequence
  Description of Artificial Sequence: Synthetic polypeptide
DIQMTQSPSSLSTSVGDRVTITCRASQIIISYLNWYQQKPGKAPKLLIFVASSLQSGVPSRFSGSGSGTDFTLTISSLQPEDFATYYCQQSYSTPYTFGGGTKVEIK

SEQ ID NO: 24713 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattttcaactatttaaattggtatcagcagaaaccaggaaaagcccctaacctcctgatctacgatgcctccaatttggaaacaggggtcccatcaaggttcagtggaagtggatctgggacagattttactttcaccatcagcagcctgcagcctgaagatattgcgacatatttctgtcaacagtatgataatctcccgatcaccttcggccaagggacacgactggatattaga

SEQ ID NO: 24714 - protein, 107 aa, Artificial Sequence
  Description of Artificial Sequence: Synthetic polypeptide
DIQMTQSPSSLSASVGDRVTITCQASQDIFNYLNWYQQKPGKAPNLLIYDASNLETGVPSRFSGSGSGTDFTFTISSLQPEDIATYFCQQYDNLPITFGQGTRLDIR

SEQ ID NO: 24715 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagatggttagcctggtatcagcagaaaccagggaaagcccctgaactcctgatctatgctgcatcccgtttgcaaagtgggatcccatccaggttcagcggcagtggatctgggacagacttcactctcaccatcagcagcctgcagcctgaagattttgcaacttactattgtcaacaggctaacagtttcccattcactttcggccctgggaccaaagtggatatcaaa

SEQ ID NO: 24716 - protein, 107 aa, Artificial Sequence; identical to SEQ ID NO: 24662
  Description of Artificial Sequence: Synthetic polypeptide

SEQ ID NO: 24717 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattaacaattatttagcctggtttcaacagaaaccagggaaagcccctaagtccctgatctacgctgcatccagtttgcaaagtggggtcccatcaaagttcagcggcagtggatctgggacagatttcactctcaccatcagcagcctgcagcctgaagattttgcaacttattactgccaacagtttaatagttaccctccgacgttcggccaagggaccaaggtggaaatcaaa

SEQ ID NO: 24718 - protein, 107 aa, Artificial Sequence
  Description of Artificial Sequence: Synthetic polypeptide
DIQMTQSPSSLSASVGDRVTITCRASQGINNYLAWFQQKPGKAPKSLIYAASSLQSGVPSKFSGSGSGTDFTLTISSLQPEDFATYYCQQFNSYPPTFGQGTKVEIK

SEQ ID NO: 24719 - DNA, 333 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatagtgatggaaagacctatttgtattggtacctgcagaagccaggccagcctccacagctcctgatctatgaagtttccaaccggttctctggagtgccagataggttcagtggcagcgggtcagggacagatttcacactaaaaatcagccgggtggaggctgaggatgttggggtttattactgcatgcaaagtaaacagcttcctcctttcggcggagggaccaaggtggagatcaga

SEQ ID NO: 24720 - protein, 111 aa, Artificial Sequence
  Description of Artificial Sequence: Synthetic polypeptide
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSKQLPPFGGGTKVEIR

SEQ ID NO: 24721 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaagtgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcatactatttaccctcctactttcggcggagggaccaaggtggagatcaaa

SEQ ID NO: 24722 - protein, 107 aa, Artificial Sequence; identical to SEQ ID NO: 24702
  Description of Artificial Sequence: Synthetic polypeptide

SEQ ID NO: 24723 - DNA, 321 bp, Artificial Sequence
  Description of Artificial Sequence: Synthetic polynucleotide
gacatccagatgatccagtctccatcctccctgtctgcatctgtaggagacagagtcaccatcacttaccgggcaagtcagagcattagcagctatttaaattggtatcagcagaaaccagcgaaagcccctaagctccacatctatggtgcatccagtttccaaagttgggtcccatcaaggttcagtggcagtggatcttcgacagatttcacgctcaccatcatcagtatgcaacctggagattatgcaacttactactgtcaccagagttacaatctcccgatcaccttcggccaagggacccgactggagattaaa

SEQ ID NO: 24724 - protein, 107 aa, Artificial Sequence
  Description of Artificial Sequence: Synthetic polypeptide
DIQMIQSPSSLSASVGDRVTITYRASQSISSYLNWYQQKPAKAPKLHIYGASSFQSWVPSRFSGSGSSTDFTLTIISMQPGDYATYYCHQSYNLPITFGQGTRLEIK

SEQ ID NO: 24725 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcaggacattagaaatgatttaggctggtatcagcagaaaccagggaaagcccctaagcgcctgatctttgctgcatccagtttgcaaagtggggtcccatcaagattcagcggcagtggatctgggacagaattcactctcacaatcagcagcctgcagcctgaagattttgcaacttattactgtctacaccacaatagttaccctcctaagtttggcggagggatcaaggtggagatcaca

SEQ ID NO: 24726 - protein, 107 aa, Artificial Sequence
  Description of Artificial Sequence: Synthetic polypeptide
DIQMTQSPSSLSASVGDRVTITCRTSQDIRNDLGWYQQKPGKAPKRLIFAASSLQSGVPSRFSGSGSGTEFTLTISSLQPEDFATYYCLHHNSYPPKFGGGIKVEIT

SEQ ID NO: 24727 - DNA, 321 bp, Artificial Sequence
  Description of Artificial Sequence: Synthetic polynucleotide
gacatccagatgacccagtctccctcttccgtgtctgcatctgtaggagacagagtcaccatcacttgtcgggcgagtcagggtattagcagctggttagcctggtatcagcagaaaccagggaaagcccctaagctcctgatctatggtgcatccagtttgcaaagtggggtcccatcaaggttcagcgccagtggatctgggacagatttcactctcaccatcagcagcctgcagcctgaagattttgcgacttactgttgtcaacagtctgacagtttccctcggacgttcggccaagggaccaaggtggaaatcaaa

SEQ ID NO: 24728 - protein, 107 aa, Artificial Sequence; identical to SEQ ID NO: 24540
  Description of Artificial Sequence: Synthetic polypeptide

SEQ ID NO: 24729 - DNA, 321 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtgttggtcatctatcaagataggaagcggccctcagggatccctgagcgattctctggctccaactctgggaacacagccactctgaccatcagcgggacccagactatggatgaggctgactattactgtcaggcgtgggacagcagctcttatgtggtattcggcggagggaccaagctgaccgtccta

SEQ ID NO: 24730 - protein, 107 aa, Artificial Sequence
  Description of Artificial Sequence: Synthetic polypeptide
SYELTQPPSVSVSPGQTASITCSGDKLGDKYACWYQQKPGQSPVLVIYQDRKRPSGIPERFSGSNSGNTATLTISGTQTMDEADYYCQAWDSSSYVVFGGGTKLTVL

SEQ ID NO: 24731 - DNA, 318 bp, Artificial Sequence
  Description of Artificial Sequence: Synthetic polynucleotide
tcctatgaactgactcagccaccctcagtgtccgtgtccccaggacagacagccagcatcacctgctctggagataaattgggggataaatatgcttactggtatcagcagaagccaggccagtcccctgtgttggtcatctatcaagatagtaagcggtcctcagggatccctgagcgattctctggctccaactctgggaacacagccactctgaccatcagcgggacccaggctatggatgaggctgactattactgtcaggcgtgggacaacagcactgtggtattcggcggagggaccaagctgaccgtccta

SEQ ID NO: 24732 - protein, 106 aa, Artificial Sequence
  Description of Artificial Sequence: Synthetic polypeptide
SYELTQPPSVSVSPGQTASITCSGDKLGDKYAYWYQQKPGQSPVLVIYQDSKRSSGIPERFSGSNSGNTATLTISGTQAMDEADYYCQAWDNSTVVFGGGTKLTVL

SEQ ID NO: 24733 - DNA, 318 bp, Artificial Sequence
  Description of Artificial Sequence: Synthetic polynucleotide
tcctatgagctgagtcagccaccctcagtgtccgtgtccccaggacagacagccagcatcacctgctctggagataaattgggggaaaaatatgcttgctggtatcagcagaagccaggccagtcccctgtgctggtcatctatcaagataggaagcggccctcagggatccctgagcgattctctggctccaactctgggaacaaagccactctgaccatcagcgggacccaggctatggatgaggctgactattactgtcaggcgtgggtcaacaacactatgatattcggcggagggaccaagctgaccgtccta

SEQ ID NO: 24734 - protein, 106 aa, Artificial Sequence
  Description of Artificial Sequence: Synthetic polypeptide
SYELSQPPSVSVSPGQTASITCSGDKLGEKYACWYQQKPGQSPVLVIYQDRKRPSGIPERFSGSNSGNKATLTISGTQAMDEADYYCQAWVNNTMIFGGGTKLTVL

SEQ ID NO: 24735 - DNA, 345 bp, Artificial Sequence
  Description of Artificial Sequence: Synthetic polynucleotide
ctgcctgtgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacatcaccttctccaacctccagtctgacgatgaggaggagtatcactgtggagagagccacacgatcgatggccaagtcggtgtggtattcggcggagggaccaagctgaccgtccta

SEQ ID NO: 24736 - protein, 115 aa, Artificial Sequence
  Description of Artificial Sequence: Synthetic polypeptide
LPVLTQPPSASALLGASIKLTCTLSSEHSTYTIEWYQQRPGRSPQYIMKVKSDGSHSKGDGIPDRFMGSSSGADRYITFSNLQSDDEEEYHCGESHTIDGQVGVVFGGGTKLTVL

SEQ ID NO: 24737 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattggggaataaatatgcttgctggtatcagcagaagccaggccagtcccctgtggaggtcatctatcaagatagcaagcggcccttagggatccctgagcgattctctggctccaactctgggaacacagccactctgaccatcagcgggacccaggctatggatgaggctgactattactgtcaggcgtgggacagtagtactgtggtattcggcggagggaccaagctgaccgtccta

SEQ ID NO: 24738 - protein, 106 aa, Artificial Sequence
  Description of Artificial Sequence: Synthetic polypeptide
SYELTQPPSVSVSPGQTASITCSGDKLGNKYACWYQQKPGQSPVEVIYQDSKRPLGIPERFSGSNSGNTATLTISGTQAMDEADYYCQAWDSSTVVFGGGTKLTVL

SEQ ID NO: 24739 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggagaaatatgcttactggtatcagcagaagccaggccagtcccctgtgctggtcctctatcaagatagcaagcggccctcagggatccctgagcgattctctggctccaactctgggaacacagccactctgaccatcagcgggacccagactatggatgaggctgacttttactgtcaggcgtgggacaacaccactgtggtattcggcggagggaccaagctgaccgtccta

SEQ ID NO: 24740 - protein, 106 aa, Artificial Sequence
  Description of Artificial Sequence: Synthetic polypeptide
SYELTQPPSVSVSPGQTASITCSGDKLGEKYAYWYQQKPGQSPVLVLYQDSKRPSGIPERFSGSNSGNTATLTISGTQTMDEADFYCQAWDNTTVVFGGGTKLTVL

SEQ ID NO: 24741 - DNA, 333 bp, Artificial Sequence
  Description of Artificial Sequence: Synthetic polynucleotide
cagtctgtgctgactcagccaccctcagcgtctgggacccccgggcagagggtcaacatgtcttgttctggaaccaactccaacatcggaagttatactgtaaactggtaccagcagctcccaggaacggcccccaaactcctcatctatattaataatcagcggccctcaggggtccctgaccgattctctggctccaagtctggcacctcagcctccctggccatcagtgggctccagtctgaggatgaggctgattattactgtgcagcatgggatgacagcctgaatggtcatgtggtattcggcggaaggaccaagctgaccgtccta

SEQ ID NO: 24742 - protein, 111 aa, Artificial Sequence
  Description of Artificial Sequence: Synthetic polypeptide
QSVLTQPPSASGTPGQRVNMSCSGTNSNIGSYTVNWYQQLPGTAPKLLIYINNQRPSGVPDRFSGSKSGTSASLAISGLQSEDEADYYCAAWDDSLNGHVVFGGRTKLTVL

SEQ ID NO: 24743 - DNA, 318 bp, Artificial Sequence
  Description of Artificial Sequence: Synthetic polynucleotide
tcctatgagctgactcagccaccctcagtgtccgtgtccccaagacagacagtcagcatcacctgctctggagataaattgggggataaatatgcttgctggtatcagcagaagccaggccagtcccctgtgctggtcatctatcaagatcgcaagcggccctcagggatccctgagcgattctctggctccaactctgggaacacagccactctgaccatcagcgggacccaggctatggatgaggctgactattactgtcaggcgtgggacaacaacactgtgatattcggcggagggaccaagctgaccgtccta

SEQ ID NO: 24744 - protein, 106 aa, Artificial Sequence
  Description of Artificial Sequence: Synthetic polypeptide
SYELTQPPSVSVSPRQTVSITCSGDKLGDKYACWYQQKPGQSPVLVIYQDRKRPSGIPERFSGSNSGNTATLTISGTQAMDEADYYCQAWDNNTVIFGGGTKLTVL

SEQ ID NO: 24745 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggagaaatatgcttgctggtatcagcagaagccaggccagtcccctgtggtggtcatctatcaagataggaagcggccctcagggatccctgagcgattctctggctccaactctgggaacacagccactctgaccatcagcgggacccaggctatagatgaggctgactattactgtcaggcgtgggacagcagcactgcggtattcggcggagggaccaagttgaccgtccta

SEQ ID NO: 24746 - protein, 106 aa, Artificial Sequence
  Description of Artificial Sequence: Synthetic polypeptide
SYELTQPPSVSVSPGQTASITCSGDKLGEKYACWYQQKPGQSPVVVIYQDRKRPSGIPERFSGSNSGNTATLTISGTQAIDEADYYCQAWDSSTAVFGGGTKLTVL

SEQ ID NO: 24747 - DNA, 315 bp, Artificial Sequence
  Description of Artificial Sequence: Synthetic polynucleotide
tcctatgagctgactcagccaccctcaatgtccgtgtccccaggacagacagccagcatcacctgctctggatataaattgggggataaatatgcttgctggtttcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggtcaacaacactgtattcggcggagggaccaagctgaccgtccta

SEQ ID NO: 24748 - protein, 105 aa, Artificial Sequence
  Description of Artificial Sequence: Synthetic polypeptide
SYELTQPPSMSVSPGQTASITCSGYKLGDKYACWFQQKPGQSPVLVIYQDSKRPSGIPERFSGSNSGNTATLTISGTQAMDEADYYCQAWVNNTVFGGGTKLTVL

SEQ ID NO: 24749 - DNA, 315 bp, Artificial Sequence
  Description of Artificial Sequence: Synthetic polynucleotide
tcctatgagctgactcaggcaccctcagtgtccgtgtccccaggacagacagccagcatcacctgctctggagataaattgggggagaaatatgtttcctggtatcaggagaagccaggccagtcccctgtgctggtcatctatcaagatagtaagcggccctcagggatccctgagcgattctctggctccaactctgggaacacagccactctgaccatcagcgggacccaggctatggatgaggctgactattactgtcaggcgtgggacagcagcactgtattcggcggagggaccaagctgaccgtccta

SEQ ID NO: 24750 - protein, 105 aa, Artificial Sequence
  Description of Artificial Sequence: Synthetic polypeptide
SYELTQAPSVSVSPGQTASITCSGDKLGEKYVSWYQEKPGQSPVLVIYQDSKRPSGIPERFSGSNSGNTATLTISGTQAMDEADYYCQAWDSSTVFGGGTKLTVL

SEQ ID NO: 24751 - DNA, 318 bp, Artificial Sequence; identical to SEQ ID NO: 24743
  Description of Artificial Sequence: Synthetic polynucleotide

SEQ ID NO: 24752 - protein, 106 aa, Artificial Sequence; identical to SEQ ID NO: 24744
  Description of Artificial Sequence: Synthetic polypeptide

SEQ ID NO: 24753 - DNA, 321 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcacttatgtggtattcggcggagggaccaagctgaccgtccta

SEQ ID NO: 24754 - protein, 107 aa, Artificial Sequence
  Description of Artificial Sequence: Synthetic polypeptide
SYELTQPPSVSVSPGQTASITCSGDKLGDKYACWYQQKPGQSPVLVIYQDSKRPSGIPERFSGSNSGNTATLTISGTQAMDEADYYCQAWDSSTYVVFGGGTKLTVL

SEQ ID NO: 24755 - DNA, 318 bp, Artificial Sequence
  Description of Artificial Sequence: Synthetic polynucleotide
tcctatgagctgagtcagccaccctcagtgtccgtgtccccaggacagacagccagcatcacctgctctggagataaattgggggaaaaatatgcttgctggtatcagcagaagccaggccagtcccctgtgctggtcatctatcaagataggaagcggccctcagggatccctgagcgattctctggctccaactctgggaacaaagccactctgaccatcagcgggacccaggctatggatgaggctgactattactgtcaggcgtgggtcaataacactatgatattcggcggagggaccaagctgaccgtccta

SEQ ID NO: 24756 - protein, 106 aa, Artificial Sequence; identical to SEQ ID NO: 24734
  Description of Artificial Sequence: Synthetic polypeptide

SEQ ID NO: 24757 - DNA, 321 bp, Artificial Sequence
  Description of Artificial Sequence: Synthetic polynucleotide
tcctatgagttgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagtagcacttatgtggtattcggcggagggaccaagctgaccgtccta

SEQ ID NO: 24758 - protein, 107 aa, Artificial Sequence; identical to SEQ ID NO: 24754
  Description of Artificial Sequence: Synthetic polypeptide

SEQ ID NO: 24759 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggaaaaatatgcttactggtttcagcagaagccaggccagtcccctgtgatagtcatctatcaagataggaagcggccctcagggatccctgagcgattctctggctccaactctgggaacacagccactctgaccatcagcgggacgcaggctatggatgaggctgactattactgtcaggcgtgggacaacagcactgcggtattcggcggagggaccaagctgaccgtccta

SEQ ID NO: 24760 - protein, 106 aa, Artificial Sequence
  Description of Artificial Sequence: Synthetic polypeptide
SYELTQPPSVSVSPGQTASITCSGDKLGEKYAYWFQQKPGQSPVIVIYQDRKRPSGIPERFSGSNSGNTATLTISGTQAMDEADYYCQAWDNSTAVFGGGTKLTVL

SEQ ID NO: 24761 - DNA, 318 bp, Artificial Sequence; identical to SEQ ID NO: 24743
  Description of Artificial Sequence: Synthetic polynucleotide

SEQ ID NO: 24762 - protein, 106 aa, Artificial Sequence; identical to SEQ ID NO: 24744
  Description of Artificial Sequence: Synthetic polypeptide

SEQ ID NO: 24763 - DNA, 324 bp, Artificial Sequence; identical to SEQ ID NO: 24229
  Description of Artificial Sequence: Synthetic polynucleotide

SEQ ID NO: 24764 - protein, 108 aa, Artificial Sequence; identical to SEQ ID NO: 24230
  Description of Artificial Sequence: Synthetic polypeptide

SEQ ID NO: 24765 - DNA, 321 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtggggcaacagcactgctgtggtattcggcggagggaccaagctgaccgtcctg

SEQ ID NO: 24766 - protein, 107 aa, Artificial Sequence
  Description of Artificial Sequence: Synthetic polypeptide
SYELTQPPSVSVSPGQTASITCSGDKLGDKYACWYQQKPGQSPVLVIYQDSKRPSGIPERFSGSNSGNTATLTISGTQAMDEADYYCQAWGNSTAVVFGGGTKLTVL

SEQ ID NO: 24767 - DNA, 324 bp, Artificial Sequence
  Description of Artificial Sequence: Synthetic polynucleotide
tcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgataccgaccggccctcagggatccctgagcgattctctggctccaactctgggaacacggccaccctgaccatcagcagggtcgaagccggggatgaggccgactattactgtcaggtgtgggatagtagcagtgatcatgtggtattcggcggagggaccaagctgaccgtccta

SEQ ID NO: 24768 - protein, 108 aa, Artificial Sequence
  Description of Artificial Sequence: Synthetic polypeptide
SYVLTQPPSVSVAPGQTARITCGGNNIGSKSVHWYQQKPGQAPVLVVYDDTDRPSGIPERFSGSNSGNTATLTISRVEAGDEADYYCQVWDSSSDHVVFGGGTKLTVL

SEQ ID NO: 24769 - DNA, 318 bp, Artificial Sequence
  Description of Artificial Sequence: Synthetic polynucleotide
tcctatgagctgacgcagtcaccctcagtgtccgtgtccccaggacagacagccagcatcacctgctctggagataaattgggggataaatatgtttactggtatcagcagaagccaggccagtcccctgtggtggtcatctatcaagataggaagcggccctcagggatccctgagcgattctctggctccaactctgggaacacagccactctgaccatcagcgggacccaggctatggatgaggctgactattactgtcaggcgtgggacagcatcactgcagtattcggcggagggaccaagctgaccgtccga

SEQ ID NO: 24770 - protein, 106 aa, Artificial Sequence
  Description of Artificial Sequence: Synthetic polypeptide
SYELTQSPSVSVSPGQTASITCSGDKLGDKYVYWYQQKPGQSPVVVIYQDRKRPSGIPERFSGSNSGNTATLTISGTQAMDEADYYCQAWDSITAVFGGGTKLTVR

SEQ ID NO: 24771 - DNA, 315 bp, Artificial Sequence
  Description of Artificial Sequence: Synthetic polynucleotide
tcctatgagctgactcagccaccctcagtgtccgtgtccccaggacagacagccagcatcacctgctctggagataaattgggtaataaatatgcttgctggtatcagcagaagccaggccagtcccctgtgttggtcatctatcaagatagcaagcggccctcagggatccctgagcgattctctggctccaactctgggaacacagccactctgaccatcagcgggacccaggctatggatgaggctgactattactgtcaggcgtgggacagcagcactgttttcggcggagggaccaagctgaccgtccta

SEQ ID NO: 24772 - protein, 105 aa, Artificial Sequence
  Description of Artificial Sequence: Synthetic polypeptide
SYELTQPPSVSVSPGQTASITCSGDKLGNKYACWYQQKPGQSPVLVIYQDSKRPSGIPERFSGSNSGNTATLTISGTQAMDEADYYCQAWDSSTVFGGGTKLTVL

SEQ ID NO: 24773 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatttgtttattggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcaccaccgtggtattcggcggagggaccaagctgaccgtccta

SEQ ID NO: 24774 - protein, 106 aa, Artificial Sequence
  Description of Artificial Sequence: Synthetic polypeptide
SYELTQPPSVSVSPGQTASITCSGDKLGDKFVYWYQQKPGQSPVLVIYQDSKRPSGIPERFSGSNSGNTATLTISGTQAMDEADYYCQAWDSTTVVFGGGTKLTVL

SEQ ID NO: 24775 - DNA, 321 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgtttgctggtatcagcagaagccaggccagtcccctgtgctggtcatctatcaagatcgcaagcggccctcagggatccctgagcgattctctggctccaactctgggaacacagccactctgaccatcagcgggacccaggctatggatgaggctgattattactgtcaggcgtggggcaacagcactgctgtggtattcggcggagggaccaagctgaccgtcctg

SEQ ID NO: 24776 - protein, 107 aa, Artificial Sequence
  Description of Artificial Sequence: Synthetic polypeptide
SYELTQPPSVSVSPGQTASITCSGDKLGDKYVCWYQQKPGQSPVLVIYQDRKRPSGIPERFSGSNSGNTATLTISGTQAMDEADYYCQAWGNSTAVVFGGGTKLTVL

SEQ ID NO: 24777 - DNA, 315 bp, Artificial Sequence
  Description of Artificial Sequence: Synthetic polynucleotide
tcctatgagctgactcagccaccctcagtgtccgtgtccccaggacagacagccagcatcacctgctctggagataaattgggggaaaaatatgcttgctggtatcagcagaagccaggccagtcccctgtgctggtcatctatcaagatagaaagcggccctcagggatccctgagcgattctctggctccaactctgggaacacagccactctgaccatcagcgggacccaggctatggatgaggctgactattactgtcaggcgtgggacagcagcacggtattcggcggagggaccaaactgaccgtccta

SEQ ID NO: 24778 - protein, 105 aa, Artificial Sequence
  Description of Artificial Sequence: Synthetic polypeptide
SYELTQPPSVSVSPGQTASITCSGDKLGEKYACWYQQKPGQSPVLVIYQDRKRPSGIPERFSGSNSGNTATLTISGTQAMDEADYYCQAWDSSTVFGGGTKLTVL

SEQ ID NO: 24779 - DNA, 315 bp, Artificial Sequence
  Description of Artificial Sequence: Synthetic polynucleotide
tcctatgagctgactcagccaccctcagtgtccgtgtccccagggcagacagccagcatcacctgctctggagataaattgggaaataaatatgcttgctggtatcagcagaagccaggccagtcccctgtgctggtcatctatcaagattccaagcggccctcagggatccctgagcgattctctggctccaactctgggaacacagccactctgaccatcagcgggacccaggctatggatgaggctgactattactgtcaggcgtgggacagcagcactgtattcggcggagggaccaaactgaccgtccta

SEQ ID NO: 24780 - protein, 105 aa, Artificial Sequence; identical to SEQ ID NO: 24772
  Description of Artificial Sequence: Synthetic polypeptide

SEQ ID NO: 24781 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttactggtttcagcagaagccaggccagtcccctgtgatagtcatctatcaagataggaagcggccctcagggatccctgagcgattctctggctccaactctgggaacacagccactctgaccatcagcgggacgcaggctatggatgaggctgactattactgtcaggcgtgggacaacagcactgcggtattcggcggagggaccaagctgaccgtccta

SEQ ID NO: 24782 - protein, 106 aa, Artificial Sequence
  Description of Artificial Sequence: Synthetic polypeptide
SYELTQPPSVSVSPGQTASITCSGDKLGDKYAYWFQQKPGQSPVIVIYQDRKRPSGIPERFSGSNSGNTATLTISGTQAMDEADYYCQAWDNSTAVFGGGTKLTVL

SEQ ID NO: 24783 - DNA, 333 bp, Artificial Sequence; identical to SEQ ID NO: 24741
  Description of Artificial Sequence: Synthetic polynucleotide

SEQ ID NO: 24784 - protein, 111 aa, Artificial Sequence; identical to SEQ ID NO: 24742
  Description of Artificial Sequence: Synthetic polypeptide

SEQ ID NO: 24785 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggagccagcagtgacgttggtgattataactctgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcatcactgtggtattcggcggagggaccaaactgaccgtccta

SEQ ID NO: 24786 - protein, 110 aa, Artificial Sequence
  Description of Artificial Sequence: Synthetic polypeptide
QSALTQPASVSGSPGQSITISCTGASSDVGDYNSVSWYQQHPGKAPKLMIYEVSNRPSGVSNRFSGSKSGNTASLTISGLQAEDEADYYCSSYTSSITVVFGGGTKLTVL

SEQ ID NO: 24787 - DNA, 315 bp, Artificial Sequence
  Description of Artificial Sequence: Synthetic polynucleotide
tcctatgaagtgactcagccaccctcaatgtccgtgtccccaggacagacagccagcatcacctgctctggagataaattgggggataaatatgtttgctggtttcagcagaagccaggccagtcccctgtgttggtcatctatcaagatagcaagcggccctcagggatccctgagcgattctctggctccaactctgggaacacagccactctgaccatcagcgggacccaggctatggatgaggctgactattactgtcaggcgtgggtcaacaacactgtattcggcggagggaccaagctgaccgtccta

SEQ ID NO: 24788 - protein, 105 aa, Artificial Sequence
  Description of Artificial Sequence: Synthetic polypeptide
SYEVTQPPSMSVSPGQTASITCSGDKLGDKYVCWFQQKPGQSPVLVIYQDSKRPSGIPERFSGSNSGNTATLTISGTQAMDEADYYCQAWVNNTVFGGGTKLTVL

SEQ ID NO: 24789 - DNA, 318 bp, Artificial Sequence; identical to SEQ ID NO: 24221
  Description of Artificial Sequence: Synthetic polynucleotide

SEQ ID NO: 24790 - protein, 106 aa, Artificial Sequence; identical to SEQ ID NO: 24222
  Description of Artificial Sequence: Synthetic polypeptide

SEQ ID NO: 24791 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaggtccagccagactattttacacagctccaacaattacaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattattgtactcctccgacgttcggccaagggaccaaggtggaaatcaaa

SEQ ID NO: 24792 - protein, 113 aa, Artificial Sequence
  Description of Artificial Sequence: Synthetic polypeptide
DIVMTQSPDSLAVSLGERATINCRSSQTILHSSNNYNYLAWYQQKPGQPPKLLIYWASTRESGVPDRFSGSGSGTDFTLTISSLQAEDVAVYYCQQYYCTPPTFGQGTKVEIK

SEQ ID NO: 24793 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtggtggtcatctatcaagatatgaagcggccctcagggatccctgagcgattctctggctccaactctgggaacacagccactctgaccatcagcgggacgcaggctatggatgaggctgactattactgtcaggcgtgggacaacagcactgcggtattcggcggagggaccaagctgaccgtccta

SEQ ID NO: 24794 - protein, 106 aa, Artificial Sequence
  Description of Artificial Sequence: Synthetic polypeptide
SYELTQPPSVSVSPGQTASITCSGDKLGDKYACWYQQKPGQSPVVVIYQDMKRPSGIPERFSGSNSGNTATLTISGTQAMDEADYYCQAWDNSTAVFGGGTKLTVL

SEQ ID NO: 24795 - DNA, 321 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtacatccagcagggccactggcatcccagacaggttcagtggcagtgggtctgggacagacttcactctcaccatcagcagactggagcctgaagattttgcagtgtattactgtcagcagtatggtagttcacgcagttttggccaggggaccaagctggagatcaaa

SEQ ID NO: 24796 - protein, 107 aa, Artificial Sequence
  Description of Artificial Sequence: Synthetic polypeptide
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSRSFGQGTKLEIK

SEQ ID NO: 24797 - DNA, 321 bp, Artificial Sequence
  Description of Artificial Sequence: Synthetic polynucleotide
gacatccagatgacccagtctccatcctccctgtctgcatctgttggagacagagtcaccatcacttgccgggcaagtcagggcattagaaatgatttaggctggtatcagcagaaaccagggaaagcccctaagcgcctgatctatgttacatccagtttgcaaggtggggtcccatcaaggttcagcggcagtggatctgggacagaattcactctcacaatcagcagcctgcagcctgaagattttgcaacttattactgtctacaacataatagttacccgctcactttcggcggagggaccaaggtggagatcaaa

SEQ ID NO: 24798 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYVTSSLQGGVPSRFSGSGSGTEFTLTISSLQPEDFATYYCLQHNSYPLTFGGGTKVEIK

SEQ ID NO: 24799 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcatagtagttacccgctcactttcggcggagggaccaaggtggagatcaaa

SEQ ID NO: 24800 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHSSYPLTFGGGTKVEIK

SEQ ID NO: 24801 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagtcaccctctcactttcggcggagggaccaaggtggagatcaaa

SEQ ID NO: 24802 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSHPLTFGGGTKVEIK

SEQ ID NO: 24803 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcacctggttagcctggtatcaacagaaaccagggaaagcccctaaactcctgatctatgatgcatccagtttgcaaagtggggtcccatcaaggttcagcggcagtggatctgggacagatttcactctcaccatcagcagcctgcagcctgaagattttgcaacttactattgtcaacaggctaacagtttcccgtggacgttcggccaagggaccaaggtggaaatcaaa

SEQ ID NO: 24804 - protein, 107 aa, Artificial Sequence
  Description of Artificial Sequence: Synthetic polypeptide
DIQMTQSPSSVSASVGDRVTITCRASQGISTWLAWYQQKPGKAPKLLIYDASSLQSGVPSRFSGSGSGTDFTLTISSLQPEDFATYYCQQANSFPWTFGQGTKVEIK

SEQ ID NO: 24805 - DNA, 321 bp, Artificial Sequence; identical to SEQ ID NO: 24299
  Description of Artificial Sequence: Synthetic polynucleotide

SEQ ID NO: 24806 - protein, 107 aa, Artificial Sequence; identical to SEQ ID NO: 24244
  Description of Artificial Sequence: Synthetic polypeptide

SEQ ID NO: 24807 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcagggcattagaaatgatttaggctggtatcagcagaaaccagggaaagcccctaagcgcctgatttatgctgcatccaatttgcaaagtggggtcccatcaaggttcagcggcagtggatctgggacagaattcactctcacaatcagcagcctgcagcctgaagattttgcaacttattactgtctacagcatagtgcttacccgctcactttcggcggagggaccaaggtggagatcaaa

SEQ ID NO: 24808 - protein, 107 aa, Artificial Sequence
  Description of Artificial Sequence: Synthetic polypeptide
DIQMTQSPSSLSASVGDRVTITCRTSQGIRNDLGWYQQKPGKAPKRLIYAASNLQSGVPSRFSGSGSGTEFTLTISSLQPEDFATYYCLQHSAYPLTFGGGTKVEIK

SEQ ID NO: 24809 - DNA, 321 bp, Artificial Sequence
  Description of Artificial Sequence: Synthetic polynucleotide
gacatccagatgacccagtctccatcctccctgtctgcttctgtaggagacagagtcaccatcacttgccgggcaagtcaggccattagaaatgatttaggctggtatcagcagaaaccagggaaagcccctaagcgtctgatctatgctgcatccagtttgcaaagtggggtcccatcaaggttcagcggcagtggatctgggacagaattcactctcacaatcagcagcctgcagcctgaagattttgcaacttattactgtctacagcatagtagttacccgctcactttcggcggagggaccaaggtggagatcaaa

SEQ ID NO: 24810 - protein, 107 aa, Artificial Sequence
  Description of Artificial Sequence: Synthetic polypeptide
DIQMTQSPSSLSASVGDRVTITCRASQAIRNDLGWYQQKPGKAPKRLIYAASSLQSGVPSRFSGSGSGTEFTLTISSLQPEDFATYYCLQHSSYPLTFGGGTKVEIK

SEQ ID NO: 24811 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccactttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 24812 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGGGTKVEIK

SEQ ID NO: 24813 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatttatgctgcatccagtttgcaaagtggggtcccatcaaggttcagcggcagtggatctgggacagaattcactctcacaatcagcagcctgcagcctgaagattttgcaacttattactgtctacagcataatagttacccgttcactttcggcggagggaccaaggtggagatcaaa

SEQ ID NO: 24814 - protein, 107 aa, Artificial Sequence; identical to SEQ ID NO: 24348
  Description of Artificial Sequence: Synthetic polypeptide

SEQ ID NO: 24815 - DNA, 321 bp, Artificial Sequence; identical to SEQ ID NO: 24295
  Description of Artificial Sequence: Synthetic polynucleotide

SEQ ID NO: 24816 - protein, 107 aa, Artificial Sequence; identical to SEQ ID NO: 24296
  Description of Artificial Sequence: Synthetic polypeptide

SEQ ID NO: 24817 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacattagtagttatttaaattggtatcagcagaaaccagggaaagcccctaaactcctgatctatgctgcatccagtttgcaaagtggggtcccatcaaggttcagtggcagtggatctgggacagatttcactctcaccatcagcagtctgcaacctgaagattttgcaacttactactgtcaacagagttacaatacccccttcttcactttcggccctgggaccaaagtggatatcaaa

SEQ ID NO: 24818 - protein, 108 aa, Artificial Sequence
  Description of Artificial Sequence: Synthetic polypeptide
DIQMTQSPSSLSASVGDRVTITCRASQNISSYLNWYQQKPGKAPKLLIYAASSLQSGVPSRFSGSGSGTDFTLTISSLQPEDFATYYCQQSYNTPFFTFGPGTKVDIK

SEQ ID NO: 24819 - DNA, 321 bp, Artificial Sequence; identical to SEQ ID NO: 24247
  Description of Artificial Sequence: Synthetic polynucleotide

SEQ ID NO: 24820 - protein, 107 aa, Artificial Sequence; identical to SEQ ID NO: 24146
  Description of Artificial Sequence: Synthetic polypeptide

SEQ ID NO: 24821 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatggtgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 24822 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYGASSLQSGVPSRFSGSGSGTEFTLTISSLQPEDFATYYCLQHNSYPLTFGGGTKVEIK

SEQ ID NO: 24823 - DNA, 321 bp, Artificial Sequence; identical to SEQ ID NO: 24247
  Description of Artificial Sequence: Synthetic polynucleotide

SEQ ID NO: 24824 - protein, 107 aa, Artificial Sequence; identical to SEQ ID NO: 24146
  Description of Artificial Sequence: Synthetic polypeptide

SEQ ID NO: 24825 - DNA, 321 bp, Artificial Sequence; identical to SEQ ID NO: 24797
  Description of Artificial Sequence: Synthetic polynucleotide

SEQ ID NO: 24826 - protein, 107 aa, Artificial Sequence; identical to SEQ ID NO: 24798
  Description of Artificial Sequence: Synthetic polypeptide

SEQ ID NO: 24827 - DNA, 321 bp, Artificial Sequence
  Description of Artificial Sequence: Synthetic polynucleotide
gacatccagatgacccagtctccatcctcactgtttgcatttataggagacagagtcaccatcacttgtcgggcgagtcagggcattagcaattatttagcctggtttcagcagaaacctggaaaagcccctaagtccctgatttttgctgcatccagtttgcaaagtggggtcccatcaaagtttagcggcagtggatttgggacagatttcacttttcccatcagcagcctgcagcctgaagattttgcaaattattactgccaacagtattatagttacccattcactttcggccctgggacccaagtggatgtcaaa

SEQ ID NO: 24828 - protein, 107 aa, Artificial Sequence
  Description of Artificial Sequence: Synthetic polypeptide
DIQMTQSPSSLFAFIGDRVTITCRASQGISNYLAWFQQKPGKAPKSLIFAASSLQSGVPSKFSGSGFGTDFTFPISSLQPEDFANYYCQQYYSYPFTFGPGTQVDVK

SEQ ID NO: 24829 - DNA, 321 bp, Artificial Sequence
  Description of Artificial Sequence: Synthetic polynucleotide
gacatccagatgacccagtctccatcctcccggtctgcatttgttggagacagagtcaccatcacttaccgggcaagtcagggcattagaaatgatttaggctggtatcagcagaaaccagggaaagcccctcagcgcctgatctatgctgcatccagtctgcaaagtggggtcccatcaaggttcagcggcagtggatatgggactgaattcaatatcacaatcagcagcttgcagcctgaagattttgcaatttattactgtatacagcataatagttacctgtggacgttcggccaagggaccaaggtggaaatcaca

SEQ ID NO: 24830 - protein, 107 aa, Artificial Sequence
  Description of Artificial Sequence: Synthetic polypeptide
DIQMTQSPSSRSAFVGDRVTITYRASQGIRNDLGWYQQKPGKAPQRLIYAASSLQSGVPSRFSGSGYGTEFNITISSLQPEDFAIYYCIQHNSYLWTFGQGTKVEIT

SEQ ID NO: 24831 - DNA, 321 bp, Artificial Sequence
  Description of Artificial Sequence: Synthetic polynucleotide
gacttccagatgacccagtctccatcctccctgtctgcatctgtaggagacagagtcaccatcacttgccgggcaagtcagagtattctcagctatttaaattggtatcggcagaaaccagggagagcccctcaggtcctgatccatactacatccagtttgcaaagtggggtcccatcaaggttcagtggcagtggatctgggacagttttcactctcaccatcagcagtctgcaacctgaagattttgcaacttactactgtcaacagacttacagtaccccgctcactttcggcggagggaccagggtggagatcaac

SEQ ID NO: 24832 - protein, 107 aa, Artificial Sequence
  Description of Artificial Sequence: Synthetic polypeptide
DFQMTQSPSSLSASVGDRVTITCRASQSILSYLNWYRQKPGRAPQVLIHTTSSLQSGVPSRFSGSGSGTVFTLTISSLQPEDFATYYCQQTYSTPLTFGGGTRVEIN

SEQ ID NO: 24833 - DNA, 321 bp, Artificial Sequence
  Description of Artificial Sequence: Synthetic polynucleotide
gacatccagatgacccagtctccatcctccctgtctgcatctgtcggagacagagtcaccgtcacttgccgggcaagtcagaacatttacaggtatttaaattggtatcaggggagaccagggagagcccctaaactcatgatctatgctgcatccagttcgcaaagtggggtcccatcaagattcagtggcagtggatctgggacagatttcactgtcaccatcagtagtcttcaacctgaagattttgcaacttattactgtcaacagagttacagtccccctttcactttcggcggaggggccaaggtggagatcgac

SEQ ID NO: 24834 - protein, 107 aa, Artificial Sequence
  Description of Artificial Sequence: Synthetic polypeptide
DIQMTQSPSSLSASVGDRVTVTCRASQNIYRYLNWYQGRPGRAPKLMIYAASSSQSGVPSRFSGSGSGTDFTVTISSLQPEDFATYYCQQSYSPPFTFGGGAKVEID

SEQ ID NO: 24835 - DNA, 324 bp, Artificial Sequence
  Description of Artificial Sequence: Synthetic polynucleotide
gacatccagatgaccctgtctccatcctccctgtctgcatctgtaggagacagagtcaccatcacttgccgggcaattcagaacattagcagctatttaaattggtatcagcagaaaccagggaaagcccctaaactcgtgatctatgctgcatccagcttgcaaagtggggtcccatcaaggttcagtggcagaggatctgggacagatttcactctcaccatcggttgtgtgcaacgtgaagattttgcaacttactactgtcaacagagttacagaacccccttattcactttcggccctgggaccaaggttgatatcaaa

SEQ ID NO: 24836 - protein, 108 aa, Artificial Sequence
  Description of Artificial Sequence: Synthetic polypeptide
DIQMTLSPSSLSASVGDRVTITCRAIQNISSYLNWYQQKPGKAPKLVIYAASSLQSGVPSRFSGRGSGTDFTLTIGCVQREDFATYYCQQSYRTPLFTFGPGTKVDIK

SEQ ID NO: 24837 - DNA, 321 bp, Artificial Sequence
  Description of Artificial Sequence: Synthetic polynucleotide
gacgtccagatgacccagtctccatcctccctgtctgcatctgcaggagacagagtcaccatcacttgccgggcaagtcagaacatttacagctatttaaattggtatcagcagaaaccagggagagcccctaaggtcctgatccatactgcatccagtttgcaaagtggggtcccatcaaggttcagtggcagtggatctggggcagatttcactctcaccatcaacagtctgcaacctgaagattttgcaacttactactgtcagcagagttacagtccccctctcactttcggcggagggaccaaggtagagatcaaa

SEQ ID NO: 24838 - protein, 107 aa, Artificial Sequence
  Description of Artificial Sequence: Synthetic polypeptide
DVQMTQSPSSLSASAGDRVTITCRASQNIYSYLNWYQQKPGRAPKVLIHTASSLQSGVPSRFSGSGSGADFTLTINSLQPEDFATYYCQQSYSPPLTFGGGTKVEIK

SEQ ID NO: 24839 - DNA, 321 bp, Artificial Sequence
  Description of Artificial Sequence: Synthetic polynucleotide
gacatccagatgacccagtctccatcctccgcatctgcatctgtaggagtcagagtcaccatcatttgcctggcaagtcagggcattagaaatgatttaggctggtatcagcagaaaccagggaaagcccctaagcgcataatctatgttgcatgtagtttccaaagtggggtcccatcaaggttcagcggcagtggatatgggacagaattcactctcacaatcagcatcatgcagcctgaagatttcgcaacttattactgtctacaacataatctttacccgctcactttcggcggagggaccaaggtggagatcaaa

SEQ ID NO: 24840 - protein, 107 aa, Artificial Sequence
  Description of Artificial Sequence: Synthetic polypeptide
DIQMTQSPSSASASVGVRVTIICLASQGIRNDLGWYQQKPGKAPKRIIYVACSFQSGVPSRFSGSGYGTEFTLTISIMQPEDFATYYCLQHNLYPLTFGGGTKVEIK

SEQ ID NO: 24841 - DNA, 321 bp, Artificial Sequence
  Description of Artificial Sequence: Synthetic polynucleotide
gacatccagatgatccagtctccatcctccctgtttgcatgtgtaggagacagagtcatcatcacttgccgggcaagtcagggcattagaaatgatttagactggtatcagcagaaaccagggaaagcccctaagcgcctgatctatgctgcatccagtttgcaaagtggggtcccatcaaggttcagcggcagtggatctgggacagaattcactctcacaatcagcagcgtgcagcgtgaagattttgcaacttattactgtgtacagcataatagttacccgctcactttcggcggagggaccaaggtggagatcaga

SEQ ID NO: 24842 - protein, 107 aa, Artificial Sequence
  Description of Artificial Sequence: Synthetic polypeptide
DIQMIQSPSSLFACVGDRVIITCRASQGIRNDLDWYQQKPGKAPKRLIYAASSLQSGVPSRFSGSGSGTEFTLTISSVQREDFATYYCVQHNSYPLTFGGGTKVEIR

SEQ ID NO: 24843 - DNA, 324 bp, Artificial Sequence
  Description of Artificial Sequence: Synthetic polynucleotide
gacatccagatgacccagtctccatcctccccgtctgcatctgtaggagacagagtcaccatcactttccgggcaagtcagaacattattagttatttaaattggtatcagcagaaaccagggaaagcccgtaagctcgtgatctatggtgcatccagtttgcaaagtggggtcccatcaaggttcagtggcagtggatctgggacagatttcactctcaacatcagaagtctgcaacctgaagattttgcaacttactactgtcaacagagttacagtactcccttattcactttcggccctgggaccaaagtggatatcaaa

SEQ ID NO: 24844 - protein, 108 aa, Artificial Sequence
  Description of Artificial Sequence: Synthetic polypeptide
DIQMTQSPSSPSASVGDRVTITFRASQNIISYLNWYQQKPGKARKLVIYGASSLQSGVPSRFSGSGSGTDFTLNIRSLQPEDFATYYCQQSYSTPLFTFGPGTKVDIK

SEQ ID NO: 24845 - DNA, 321 bp, Artificial Sequence
  Description of Artificial Sequence: Synthetic polynucleotide
gacatccagatgacccagtctccatcctccctgtctgcatctgtaggacacagagtccacctcacttgccgggcaagtcggggcatcagaggtgatttaggttggtatcgccagaaaccagggaaagcccctaagcgcttgatctatgctgcatccaatttgcaaagtggggtcccatcaaggttcagcggcagtggatatgggacagaattcactctcacaatcggcagcctgcagcctgaagattttgcaacttattactgtctacagcattatagttaccctcggacgttcggccaagggaccaaggtggaaatcaaa

SEQ ID NO: 24846 - protein, 107 aa, Artificial Sequence
  Description of Artificial Sequence: Synthetic polypeptide
DIQMTQSPSSLSASVGHRVHLTCRASRGIRGDLGWYRQKPGKAPKRLIYAASNLQSGVPSRFSGSGYGTEFTLTIGSLQPEDFATYYCLQHYSYPRTFGQGTKVEIK

SEQ ID NO: 24847 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcaacaaaaaccagggaaagcccctaagcgcattatttattctgcatccagtttgcaaagtggggtcccatcaaggttcatcggcagtggatgtgggactgaattcactctcacaatcagcagcctgcagcgtgaagattttgcagcttattacagtgtacagcattatagttacccgttcactttcggcggagggaccaaggtggagatcaaa

SEQ ID NO: 24848 - protein, 107 aa, Artificial Sequence
  Description of Artificial Sequence: Synthetic polypeptide
DIQMTQSPSSLSASVGDRVTITCRASQGIRNDLGWYQQKPGKAPKRIIYSASSLQSGVPSRFIGSGCGTEFTLTISSLQREDFAAYYSVQHYSYPFTFGGGTKVEIK

SEQ ID NO: 24849 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacattagaaattatttaaattggtatcagcagaaatcagggagagcccctaagctcctgatctatgttgcatccagtttgcaaagtggggtcccatcaaggttcagtggcagtggatctgggacagaattcactctcaccatcaacagtctgcaacctgaagattttgcaatttatcactgtcatcagagtaacagtactcctctcacgttcggccaagggaccaaggtggaaatcaaa

SEQ ID NO: 24850 - protein, 107 aa, Artificial Sequence
  Description of Artificial Sequence: Synthetic polypeptide
DIQMTQSPSSLSASVGDRVTITCRASQNIRNYLNWYQQKSGRAPKLLIYVASSLQSGVPSRFSGSGSGTEFTLTINSLQPEDFAIYHCHQSNSTPLTFGQGTKVEIK

SEQ ID NO: 24851 - DNA, 321 bp, Artificial Sequence
  Description of Artificial Sequence: Synthetic polynucleotide
gatatccagatgacccaggctccatcctcactgtctgcttctgtaggagacagagtcaccatcacttgtcgggcgagtcaggacattagcaatcatttagtctggtttcagcagaaaccagggaaagcccctaagtccctgatctttgctgcatccagtttacaaagtggggtcccatcacagttcagcggcagtggatctggaacagatttcactctcaccatcagcatcctgcagcctgaggattttgcaacttattactgccaccagtataatagttaccccttcactttcggccctgggaccaaagtggatttcaaa

SEQ ID NO: 24852 - protein, 107 aa, Artificial Sequence
  Description of Artificial Sequence: Synthetic polypeptide
DIQMTQAPSSLSASVGDRVTITCRASQDISNHLVWFQQKPGKAPKSLIFAASSLQSGVPSQFSGSGSGTDFTLTISILQPEDFATYYCHQYNSYPFTFGPGTKVDFK

SEQ ID NO: 24853 - DNA, 321 bp, Artificial Sequence
  Description of Artificial Sequence: Synthetic polynucleotide
gacatccagatgacccagtctccatcctccctgtctccatctgtaggagacagagtcaccatcacttgccgggcaagtcagggcattagaaatgatttaggctggtatcagcagaaaccagggaaagcccctcagcgcctgatctctgctgcatccagtttgcaaagtggggtcccatcaaggttcagcggcagtggatctgggacagatttcactctcacaatcagcagtttgcagcctgaagattttgcaacttattactgtctacagcataatagttacccgctcactttcggcggagggaccaagatggagatcaaa

SEQ ID NO: 24854 - protein, 107 aa, Artificial Sequence
  Description of Artificial Sequence: Synthetic polypeptide
DIQMTQSPSSLSPSVGDRVTITCRASQGIRNDLGWYQQKPGKAPQRLISAASSLQSGVPSRFSGSGSGTDFTLTISSLQPEDFATYYCLQHNSYPLTFGGGTKMEIK

SEQ ID NO: 24855 - DNA, 321 bp, Artificial Sequence
  Description of Artificial Sequence: Synthetic polynucleotide
gacatccagatgatccagtctccatccttcctgtttgcatgtgtaggagacagagtcaccatcacttgccgggcaagtcagggcattagaaatgatttaggctggtatcagcagaaaccagggaaagcccctaagcgcctgatatatgctgcatccagtttgcaaagtggggtcccatcaaggttcagcggcagtgtatctgggacagaattcactctcacaatcagcagcctgcagcctgaagatttcgcaacttattactgtctacagcataatagttacccgctcactttcggcggagggaccaaggtggagatcaaa

SEQ ID NO: 24856 - protein, 107 aa, Artificial Sequence
  Description of Artificial Sequence: Synthetic polypeptide
DIQMIQSPSFLFACVGDRVTITCRASQGIRNDLGWYQQKPGKAPKRLIYAASSLQSGVPSRFSGSVSGTEFTLTISSLQPEDFATYYCLQHNSYPLTFGGGTKVEIK

SEQ ID NO: 24857 - DNA, 321 bp, Artificial Sequence
  Description of Artificial Sequence: Synthetic polynucleotide
gacatccagatgacccagtctccatcctcccggtctgcatttgttggagacagagtcaccatcacttgccgggcaagtcagggcattagaaatgatttagggtggtatcagcagaaaccagggaaagcccgtaagcgcctgatctatactgcatccagtttgcaaagtggggtcccatcaaggttcagcggcagtggatatgggactgaattcactatcacaatcagcagcttgcagcctgaagattttgcaacttattactgtatacagcataatagttacctgtggacgttcggccaagggaccaaggtggaaatcaaa

SEQ ID NO: 24858 - protein, 107 aa, Artificial Sequence
  Description of Artificial Sequence: Synthetic polypeptide
DIQMTQSPSSRSAFVGDRVTITCRASQGIRNDLGWYQQKPGKARKRLIYTASSLQSGVPSRFSGSGYGTEFTITISSLQPEDFATYYCIQHNSYLWTFGQGTKVEIK

SEQ ID NO: 24859 - DNA, 324 bp, Artificial Sequence
  Description of Artificial Sequence: Synthetic polynucleotide
gacatccagatgacccagtctccatcctccctgtctgcatctgtaggagacagagtctccatcacttgccgggcaagtcagaatattaacaactatttaaattggtatcagcagaaaccagggaaaggccctaaggtcctgatccttactgcatccagtttgcaaagtggggtcccatcaaggttcagtggcagtggatctgggacagatttcactctcaccatcaacagtctgcaacctgaagattttgcaacttactactgtcaacagagttacactacccccacgtggacgttcggccaagggaccaaggtggaaatcaaa

SEQ ID NO: 24860 - protein, 108 aa, Artificial Sequence
  Description of Artificial Sequence: Synthetic polypeptide
DIQMTQSPSSLSASVGDRVSITCRASQNINNYLNWYQQKPGKGPKVLILTASSLQSGVPSRFSGSGSGTDFTLTINSLQPEDFATYYCQQSYTTPTWTFGQGTKVEIK

SEQ ID NO: 24861 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttacaaagtggggtcccatcaaggttcagcggcagtggttctgggacagaattcactctcacagtcagcagcctgcagcctgaagattttgcaagttattactgtctacacaacagtagttaccctgttaagtttgggggagggataaaggtggagatcaca

SEQ ID NO: 24862 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTVSSLQPEDFASYYCLHNSSYPVKFGGGIKVEIT

SEQ ID NO: 24863 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagttcgcaaagtggtgtcccatcaaggttcagcggcagtcgatctgggacagaattcactctcacaatcagcagcctgcagcctgaagatcttgcagcttattactgtctacagcatcatagttacccgctcactttcggcggagggaccgaggtggagatctac

SEQ ID NO: 24864 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSSQSGVPSRFSGSRSGTEFTLTISSLQPEDLAAYYCLQHHSYPLTFGGGTEVEIY

SEQ ID NO: 24865 - DNA, 321 bp, Artificial Sequence
  Description of Artificial Sequence: Synthetic polynucleotide
gacatccagatgatccagtctccatcctccccgtctgcatctgtaggagacagagtcaccatcacttgccgggcaagtcagggcattagaaatgatttaggctggtatcagcagaaatcagggaaagcccctaagcgcctgatatatgttgcatccagtttgcaaagtggggtcccatcaaggttcagcggcagtggatctgggacagaattcactatcacaatcagcagcgtgcagcctgaagattttgcaacttattactgtatacagcataatagttatccgttcactttcggcggagggaccaaggtggagatcaaa

SEQ ID NO: 24866 - protein, 107 aa, Artificial Sequence
  Description of Artificial Sequence: Synthetic polypeptide
DIQMIQSPSSPSASVGDRVTITCRASQGIRNDLGWYQQKSGKAPKRLIYVASSLQSGVPSRFSGSGSGTEFTITISSVQPEDFATYYCIQHNSYPFTFGGGTKVEIK

SEQ ID NO: 24867 - DNA, 321 bp, Artificial Sequence
  Description of Artificial Sequence: Synthetic polynucleotide
gacatccagatgacccagtctccatcctccctgtttgcatctgtcggagacagagtcaccatcacttgccgggcaagtcagggcattagaaatgatttaggttggtatcagcagaaaccagggaaagcccctcagcgcctgatctatgctgcatccagtttgcaaagtggagtcccatcaaggttcagcggcagtggatttgggacagaattcactctcacaatcagcagcctgcagcttgaagattttgcaacttattactgtttacagcatgaaagttaccctctcactttcggcggagggaccaaggtggaaatcaaa

SEQ ID NO: 24868 - protein, 107 aa, Artificial Sequence
  Description of Artificial Sequence: Synthetic polypeptide
DIQMTQSPSSLFASVGDRVTITCRASQGIRNDLGWYQQKPGKAPQRLIYAASSLQSGVPSRFSGSGFGTEFTLTISSLQLEDFATYYCLQHESYPLTFGGGTKVEIK

SEQ ID NO: 24869 - DNA, 324 bp, Artificial Sequence
  Description of Artificial Sequence: Synthetic polynucleotide
gacatccagatgacccagtctccatcctccccgtctgcatctgtaggagacagagtcaccatcactttccgggcaagtcagagcattagaagttatttaaattggtatcagcagaaaccagggaaagcccataaactcgtgatctatggtacatccagtttgcaaagtggggtcccatcaaggttcagtggcagtggatctgggacagacttcactctcaccatcagcagtctgcaacctgaagattttgcaacttactactgtcaacagagttacagtacccccttgttcactttcggccctgggaccaaagtggatatcaaa

SEQ ID NO: 24870 - protein, 108 aa, Artificial Sequence
  Description of Artificial Sequence: Synthetic polypeptide
DIQMTQSPSSPSASVGDRVTITFRASQSIRSYLNWYQQKPGKAHKLVIYGTSSLQSGVPSRFSGSGSGTDFTLTISSLQPEDFATYYCQQSYSTPLFTFGPGTKVDIK

SEQ ID NO: 24871 - DNA, 321 bp, Artificial Sequence
  Description of Artificial Sequence: Synthetic polynucleotide
gacatccagatgacccagtctccatcctccctgtctgcatctgtaggcgacagagtcaccatcacttgccgggcaagtcataccattagaacctatttaaactggtatcagcagaaaccagggaaagcccctaagctcctgatctatgctgcatccagtttgcaaagtggggtcccatcaaggatcaatggcagtggatctgggacagatttcactctcaccatcaccaatctacagcctgaagattttgcaacttactactgtcaacagagttacaatatctcattcactttcggccctgggaccaaagtggatatcaaa

SEQ ID NO: 24872 - protein, 107 aa, Artificial Sequence
  Description of Artificial Sequence: Synthetic polypeptide
DIQMTQSPSSLSASVGDRVTITCRASHTIRTYLNWYQQKPGKAPKLLIYAASSLQSGVPSRINGSGSGTDFTLTITNLQPEDFATYYCQQSYNISFTFGPGTKVDIK

SEQ ID NO: 24873 - DNA, 321 bp, Artificial Sequence
  Description of Artificial Sequence: Synthetic polynucleotide
gacatccagatgacccagtctccatcctcccggtctgcatctgtaggagacagagtcaccatcacttgccaggcgagtcaggacattagcaactatttaaattggtgtcaacagaaaccagggaaagcccttaagctcttgatatacgatgcatccactttggaaacaggggtcccctcaaggttcagtggaagtggatctgggacagattttactttcaccatcagcagcgtgcagcctgaagatattgcaacatattactgccaacagtatgataatgtcccgatcaccttcggccaagggacacgactggagattaaa

SEQ ID NO: 24874 - protein, 107 aa, Artificial Sequence
  Description of Artificial Sequence: Synthetic polypeptide
DIQMTQSPSSRSASVGDRVTITCQASQDISNYLNWCQQKPGKALKLLIYDASTLETGVPSRFSGSGSGTDFTFTISSVQPEDIATYYCQQYDNVPITFGQGTRLEIK

SEQ ID NO: 24875 - DNA, 321 bp, Artificial Sequence
  Description of Artificial Sequence: Synthetic polynucleotide
gtcatccagatgacccagtctccatcctcactgtctgcctctgtaggagacagagtcaccatcacttgtcgggcgagtcagggcattagcaattatttagcctggtttcagcagaaaccagggaaagcccctaagtccctgatcaatgctgcatccagtgtgcagagtggggtcccatcaaaattcagcggcaatggatctgggacagacttcactctcaccatcagcagcctgcagcctgaggattttgcaacttattactgccaccagtatcacagttacccattcactttcggccctgggaccaaagtggatatcaaa

SEQ ID NO: 24876 - protein, 107 aa, Artificial Sequence
  Description of Artificial Sequence: Synthetic polypeptide
VIQMTQSPSSLSASVGDRVTITCRASQGISNYLAWFQQKPGKAPKSLINAASSVQSGVPSKFSGNGSGTDFTLTISSLQPEDFATYYCHQYHSYPFTFGPGTKVDIK

SEQ ID NO: 24877 - DNA, 321 bp, Artificial Sequence
  Description of Artificial Sequence: Synthetic polynucleotide
gacatccagatgacccagtctccatcctcactgtttgcatctgtaggagacagagtcaccatcacttgtcgggcgagtcagggcattagcaattatttagcctggtttcagcagaaaccagggaaagcccctaagcgcctgatctatactgcatccagtttgcaaagtggggtcccatcaaagttcagcggcagtggatttgggacagatttcactctcaccatcagcagcctgcagcctgaagattttgcaacttattactgccaacagtataatagttacccattcactttcggccctgggaccaaagtggatatcaaa

SEQ ID NO: 24878 - protein, 107 aa, Artificial Sequence
  Description of Artificial Sequence: Synthetic polypeptide
DIQMTQSPSSLFASVGDRVTITCRASQGISNYLAWFQQKPGKAPKRLIYTASSLQSGVPSKFSGSGFGTDFTLTISSLQPEDFATYYCQQYNSYPFTFGPGTKVDIK

SEQ ID NO: 24879 - DNA, 324 bp, Artificial Sequence
  Description of Artificial Sequence: Synthetic polynucleotide
gacattcagatgacccagtctccatcctccccgtctgcatctgtaggagacagagtcaccatcactttccgggcaagtcagaccattagtagttatttaaattggtatcagcagaaaccagggaaagcccctaaactcctgatctctgctgcatccagtttgcaaagtggggtcccatcaaggttcagtggcagtggatctgggacagatttcactctcaccatcagcagtctgcaacctgaagattttgcaacttactactgtcaacagagttacaatacccccttattcactttcggccctgggaccaaagtggttatcaaa

SEQ ID NO: 24880 - protein, 108 aa, Artificial Sequence
  Description of Artificial Sequence: Synthetic polypeptide
DIQMTQSPSSPSASVGDRVTITFRASQTISSYLNWYQQKPGKAPKLLISAASSLQSGVPSRFSGSGSGTDFTLTISSLQPEDFATYYCQQSYNTPLFTFGPGTKVVIK

SEQ ID NO: 24881 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacatttacagttatttaaattggtatcaggagaaaccagggagagcccctaagctcctgatctatgctacatccagtttgcaaagtggggtcccatcaaggttcggtggcagtggatctgggacagatttcactctcaccatcagcagtctacaacctgaagattttgcaacttactactgtcaacagaattacagtccccctctcactttcggcggagggaccaaggtggagatcgaa

SEQ ID NO: 24882 - protein, 107 aa, Artificial Sequence
  Description of Artificial Sequence: Synthetic polypeptide
DIQMTQSPSSLSASVGDRVTITCRASQNIYSYLNWYQEKPGRAPKLLIYATSSLQSGVPSRFGGSGSGTDFTLTISSLQPEDFATYYCQQNYSPPLTFGGGTKVEIE

SEQ ID NO: 24883 - DNA, 321 bp, Artificial Sequence
  Description of Artificial Sequence: Synthetic polynucleotide
gacatccagatgacccagtctccatcctccctgtctgcatctgtaggagaccgagtcaccatcacttgccggacaagtcagggcattagaaatgatttaggctggtatcagcacaaaccagggcaagcccctaagcgcctgatctatgctgcatccagtttacaaagtggggtcccatcaaggttcagcggcagtggatctgggacagaattcactctcacaatcagcagcctgcagcctgaagattttacagcttattactgtctgcagcattatagttaccctcggacgttcggccaagggaccaaggtggaaatcaag

SEQ ID NO: 24884 - protein, 107 aa, Artificial Sequence
  Description of Artificial Sequence: Synthetic polypeptide
DIQMTQSPSSLSASVGDRVTITCRTSQGIRNDLGWYQHKPGQAPKRLIYAASSLQSGVPSRFSGSGSGTEFTLTISSLQPEDFTAYYCLQHYSYPRTFGQGTKVEIK

SEQ ID NO: 24885 - DNA, 321 bp, Artificial Sequence
  Description of Artificial Sequence: Synthetic polynucleotide
gacatccagatgacccagtctccatcctccctgtctgcatttgtaggagacagagtcaccatcacttgccgggcaagtcagaacattatcagctatttaaattggtatcaacagaaaccagggaaagcccctaacctcatgatatatgttacatccagtttgcacagtggggtcccatcaaggttcagtggcagtggatctgggacagatttctctctcaccatcagcagtctccaacctgaggattttgcaacttactactgtcaacagagttacagtacccctttcactttcggccctgggaccaaagtggatatcaaa

SEQ ID NO: 24886 - protein, 107 aa, Artificial Sequence
  Description of Artificial Sequence: Synthetic polypeptide
DIQMTQSPSSLSAFVGDRVTITCRASQNIISYLNWYQQKPGKAPNLMIYVTSSLHSGVPSRFSGSGSGTDFSLTISSLQPEDFATYYCQQSYSTPFTFGPGTKVDIK

SEQ ID NO: 24887 - DNA, 321 bp, Artificial Sequence
  Description of Artificial Sequence: Synthetic polynucleotide
gaaatagtgatgacgcagtctccagccaccctgtctgtgtctccaggggaaagcgccaccctctcctgcagggccagtcagactgttagcagcaacttagcctggttccagcagaagcctggccaggctcccaggctcctcatcaatggtgcatccaccagggccactggtatcccagccaggttcagtggcagtgggtctgggacagagttcactctcaccatcagcagcctgcagtctgaagattttgcagtttatttctgtcagcagtatcatgactggcctccgacgttcggccaagggaccaaggtggaaatcaaa

SEQ ID NO: 24888 - protein, 107 aa, Artificial Sequence
  Description of Artificial Sequence: Synthetic polypeptide
EIVMTQSPATLSVSPGESATLSCRASQTVSSNLAWFQQKPGQAPRLLINGASTRATGIPARFSGSGSGTEFTLTISSLQSEDFAVYFCQQYHDWPPTFGQGTKVEIK

SEQ ID NO: 24889 - DNA, 321 bp, Artificial Sequence
  Description of Artificial Sequence: Synthetic polynucleotide
gacatccagatgacccagtctccatcctccctgtctgcatctgtaggagacagagtcaccttcacttgccgggcaagtcaggacattagaagtgatttaggctggtatcagcagaaaccagggaaagcccctacgcgcctgatctttgctgcatccagtttgcaaagtggggtcccatcaaggttcagcggcagtggatctgggacagaattcactctcacaatcaacagcctgcagcctgaagattttgcaacttattactgtctacagcattatagttaccctcggacgttcggccaagggaccaaggtggaaatcaaa

SEQ ID NO: 24890 - protein, 107 aa, Artificial Sequence
  Description of Artificial Sequence: Synthetic polypeptide
DIQMTQSPSSLSASVGDRVTFTCRASQDIRSDLGWYQQKPGKAPTRLIFAASSLQSGVPSRFSGSGSGTEFTLTINSLQPEDFATYYCLQHYSYPRTFGQGTKVEIK

SEQ ID NO: 24891 - DNA, 321 bp, Artificial Sequence
  Description of Artificial Sequence: Synthetic polynucleotide
gacatccagatgacccagtctccatcctccctgtctgcttctgtaggagacagagtcaccatcacttgccaggcgaatcaggacattaccaactttttaaattggtatcagctgaaaccagggaaagcccctaacctcctgatctccgatgcatccaatttggaaacaggggtcccatcaaggttcagtggaagtggatctgggacagattttactttcaccatcagcagcctgcagcctgaagatgttgcgacatattactgtcaacagtatgataatctcccgatcaccttcggccaagggacacgactggagattaaa

SEQ ID NO: 24892 - protein, 107 aa, Artificial Sequence
  Description of Artificial Sequence: Synthetic polypeptide
DIQMTQSPSSLSASVGDRVTITCQANQDITNFLNWYQLKPGKAPNLLISDASNLETGVPSRFSGSGSGTDFTFTISSLQPEDVATYYCQQYDNLPITFGQGTRLEIK

SEQ ID NO: 24893 - DNA, 321 bp, Artificial Sequence; identical to SEQ ID NO: 24891
  Description of Artificial Sequence: Synthetic polynucleotide

SEQ ID NO: 24894 - protein, 107 aa, Artificial Sequence; identical to SEQ ID NO: 24892
  Description of Artificial Sequence: Synthetic polypeptide

SEQ ID NO: 24895 - DNA, 321 bp, Artificial Sequence
  Description of Artificial Sequence: Synthetic polynucleotide
gacatccagatgacccagtctccatcctcactgtctgcctctgtaggagacagagtcaccatcacttgtcgggcgagtcagggcattaacaattatttagcctggtttcagcagaaaccagggaaagcccttaagtccctgatcaatgctgcatccagtgtgcagagtggggtcccatcaaagttcagcggcagtggatctgggacagacttcactctcaccatcagcagcctgcagcctgaagattttgcaacttattactgccaccagtatcacagttacccattcactttcggccctgggaccaaagtggatatcgta

SEQ ID NO: 24896 - protein, 107 aa, Artificial Sequence
  Description of Artificial Sequence: Synthetic polypeptide
DIQMTQSPSSLSASVGDRVTITCRASQGINNYLAWFQQKPGKALKSLINAASSVQSGVPSKFSGSGSGTDFTLTISSLQPEDFATYYCHQYHSYPFTFGPGTKVDIV

SEQ ID NO: 24897 - DNA, 321 bp, Artificial Sequence
  Description of Artificial Sequence: Synthetic polynucleotide
gacatccagatgacccagtctccatcctccctgtctgcttctgtaggcgacagagtcaccatcacttgccgggcaagtcagggcattagaaatgatttaggctggtatcagcagaaaccagggaaagcccctacgcgcctgatctatgctgcatccagtttgcacagtggggtcccatcacggttcagcggcagtggatctgggacagaattcactctcacaatcagcagcctgcagcctgaagatcttgcaacttattactgtctacaacattatagtttccctcggacgttcggccgagggaccaaggtggaaatcaaa

SEQ ID NO: 24898 - protein, 107 aa, Artificial Sequence
  Description of Artificial Sequence: Synthetic polypeptide
DIQMTQSPSSLSASVGDRVTITCRASQGIRNDLGWYQQKPGKAPTRLIYAASSLHSGVPSRFSGSGSGTEFTLTISSLQPEDLATYYCLQHYSFPRTFGRGTKVEIK

SEQ ID NO: 24899 - DNA, 321 bp, Artificial Sequence
  Description of Artificial Sequence: Synthetic polynucleotide
gacatccagatgacccagtctccatcctccctgtctgcatctgttggagacagagtcaccatcacttgccgggcaagtcagaacatttacaggtatttaaattggtatcaggagaaaccagggagagcccctaagctcctgatctatactgcatccagtttacaaagtggggtcccatcaaggttcagtggcagtgactctgggacagatttcactctcaccatcagcagtctgcaacctgaagattttgcaacttactactgtcaacagagttacagtccccctctcactttcggcggagggaccaaggtggagatcaaa

SEQ ID NO: 24900 - protein, 107 aa, Artificial Sequence
  Description of Artificial Sequence: Synthetic polypeptide
DIQMTQSPSSLSASVGDRVTITCRASQNIYRYLNWYQEKPGRAPKLLIYTASSLQSGVPSRFSGSDSGTDFTLTISSLQPEDFATYYCQQSYSPPLTFGGGTKVEIK

SEQ ID NO: 24901 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggcaagcccctaagcgcctgatctatgctgcatccagtttacaaagtggggtcccatcaaggttcagcggcagtggatctgggacagaattcactctcacaatcagcagcctgcagcctgaagatcttgcaacttatcactgtctacagcataatagttacccgctcactttcggcggagggaccaaggtggagatcaaa

SEQ ID NO: 24902 - protein, 107 aa, Artificial Sequence
  Description of Artificial Sequence: Synthetic polypeptide
DIQMTQSPSSLSASVGDRVTITCRASQGIRNDLGWYQQKPGQAPKRLIYAASSLQSGVPSRFSGSGSGTEFTLTISSLQPEDLATYHCLQHNSYPLTFGGGTKVEIK

SEQ ID NO: 24903 - DNA, 321 bp, Artificial Sequence
  Description of Artificial Sequence: Synthetic polynucleotide
gacatccagatgacccagtctccatcctccctggctgcatctgtaggagacagagtcaccatcacttgccgggcaagtcagaccattatcagctatttaaattggtatcagcagaaaccagggaaagcccctaaacttctgatccatactgcatccagtttgcaaagtggggtcccatcaaggttcagtggcagtggatctgggacagatttcactctctccatcagcagtctgcaacctgaagattttgcaacttactactgtcaacagacttacagtactccgctcactttcggcggagggaccaaggtggagatcaaa

SEQ ID NO: 24904 - protein, 107 aa, Artificial Sequence
  Description of Artificial Sequence: Synthetic polypeptide
DIQMTQSPSSLAASVGDRVTITCRASQTIISYLNWYQQKPGKAPKLLIHTASSLQSGVPSRFSGSGSGTDFTLSISSLQPEDFATYYCQQTYSTPLTFGGGTKVEIK

SEQ ID NO: 24905 - DNA, 321 bp, Artificial Sequence
  Description of Artificial Sequence: Synthetic polynucleotide
gacatccagatgacccagtctccatcctccctgtttgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatttgggacagaattcactctcacaatcagcagcctgcagcttgaagattttgcaacttattactgtttacagcatgataattaccctctcactttcggcggagggaccaaggtggagatcaaa

SEQ ID NO: 24906 - protein, 107 aa, Artificial Sequence
  Description of Artificial Sequence: Synthetic polypeptide
DIQMTQSPSSLFASVGDRVTITCRASQGIRNDLGWYQQKPGKAPKRLIYAASSLQSGVPSRFSGSGFGTEFTLTISSLQLEDFATYYCLQHDNYPLTFGGGTKVEIK

SEQ ID NO: 24907 - DNA, 321 bp, Artificial Sequence
  Description of Artificial Sequence: Synthetic polynucleotide
gacatccagatgacccagtctccatcctccctgtctgcatctgtaggagacagagtcaccatcgcttgccgggcaagtcaaaacattatcagctatttaaattggtatcaacagaaaccagggaaagcccctaaattcctgatctatactgcatccagtttgcaaagtggggtcccatcaaggttcagtggcagtggatctgggacagatttcactctcaccatcagcagtctgcaacctgaagattttgcaatttactactgtcaacagacttacagtaccccgctcactttcggcggcgggaccaaggtggagatcaaa

SEQ ID NO: 24908 - protein, 107 aa, Artificial Sequence
  Description of Artificial Sequence: Synthetic polypeptide
DIQMTQSPSSLSASVGDRVTIACRASQNIISYLNWYQQKPGKAPKFLIYTASSLQSGVPSRFSGSGSGTDFTLTISSLQPEDFAIYYCQQTYSTPLTFGGGTKVEIK

SEQ ID NO: 24909 - DNA, 321 bp, Artificial Sequence
  Description of Artificial Sequence: Synthetic polynucleotide
gacatccagatgacccagtctccatcctccctgtctgcatctgttggagacagagtcaccatcacttgccgggcaagtcagaacatttacaggtatttaaattggtatcaggagaaaccagggagagcccctaaactcctgatctatactgcatccagtttgcaaagtggggtcccatcaaggttcagtggcagtgactctgggacagatttcactctcaccatcagcagtctgcaacctgaagattttgcaacttactactgtcaacagagttacagtccccctctcactttcggcggagggaccaaggtggagatcaaa

SEQ ID NO: 24910 - protein, 107 aa, Artificial Sequence; identical to SEQ ID NO: 24900
  Description of Artificial Sequence: Synthetic polypeptide

SEQ ID NO: 24911 - DNA, 321 bp, Artificial Sequence
  Description of Artificial Sequence: Synthetic polynucleotide
gacatccaggtgacccagtctccatcttccctgtctgcatctgtaggagacagagtcaccatcactagccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtgtacagcataatagttacccgctcactttcggcggagggaccaaggtggcgatcaaa

SEQ ID NO: 24912 - protein, 107 aa, Artificial Sequence
  Description of Artificial Sequence: Synthetic polypeptide
DIQVTQSPSSLSASVGDRVTITSRASQGIRNDLGWYQQKPGKAPKRLIYAASSLQSGVPSRFSGSGSGTEFTLTISSLQPEDFATYYCVQHNSYPLTFGGGTKVAIK

SEQ ID NO: 24913 - DNA, 324 bp, Artificial Sequence
  Description of Artificial Sequence: Synthetic polynucleotide
gacatccagatgacccagtctccatcctccctgtctgcatctataggagacagagtcaccatcacttgccgggcaagtcagagcattagcagttatttaaattggtatcagcagaaaccagggaaagcccctaagctcctgatctttgctgcatccagtttgcaaaatggggtcccatcaaggttcagtggcagtggatctgggacagatttcactctcaccatcagcagtctgcaacctgaagattttgcaacttactactgtcaacagacttacagtagccctccattcactttcgcccctgggaccaaagtggatatcaaa

SEQ ID NO: 24914 - protein, 108 aa, Artificial Sequence
  Description of Artificial Sequence: Synthetic polypeptide
DIQMTQSPSSLSASIGDRVTITCRASQSISSYLNWYQQKPGKAPKLLIFAASSLQNGVPSRFSGSGSGTDFTLTISSLQPEDFATYYCQQTYSSPPFTFAPGTKVDIK

SEQ ID NO: 24915 - DNA, 327 bp, Artificial Sequence
  Description of Artificial Sequence: Synthetic polynucleotide
ggcgtccagatgacccagtctccatcctccctgtctgcatctgtaggagacagagtcaccatcacttgccgggcaagtcagagcattagcggctatttaaattggtatcagcagaaaccagggaaagcccctaagctcctgatctatgctgcatccagtttgcaaagtggggtcccatcaaggttcagtggcggtggatctgggacagatttcactctcaccatcagcagtctacaacctgaagattttgcaacttactactgtcaacagacttacaatacccctccggagcgcagttttggccaggggaccaagctggagatcaaa

SEQ ID NO: 24916 - protein, 109 aa, Artificial Sequence
  Description of Artificial Sequence: Synthetic polypeptide
GVQMTQSPSSLSASVGDRVTITCRASQSISGYLNWYQQKPGKAPKLLIYAASSLQSGVPSRFSGGGSGTDFTLTISSLQPEDFATYYCQQTYNTPPERSFGQGTKLEIK

SEQ ID NO: 24917 - DNA, 339 bp, Artificial Sequence
  Description of Artificial Sequence: Synthetic polynucleotide
gacatcgtgatgacccagtctccagactccctggctgtgtctctgggcgagagggccaccctcaactgcaagtccagccagagtgttttatacagctccaacaataacaactacttaacttggtaccagcagaaacctggacagcgacctaagttgctcatttactgggcatctacccgggaatccggggtccctgaccgattcagtggcagcgggtctgggacaaatttcactctcaccatcagcagcctgcaggctgaagatgtggcagtttattactgtcagcaatattatagtactcctccgacgttcggccaagggaccaaggtggaaatcaaa

SEQ ID NO: 24918 - protein, 113 aa, Artificial Sequence
  Description of Artificial Sequence: Synthetic polypeptide
DIVMTQSPDSLAVSLGERATLNCKSSQSVLYSSNNNNYLTWYQQKPGQRPKLLIYWASTRESGVPDRFSGSGSGTNFTLTISSLQAEDVAVYYCQQYYSTPPTFGQGTKVEIK

SEQ ID NO: 24919 - DNA, 321 bp, Artificial Sequence
  Description of Artificial Sequence: Synthetic polynucleotide
gacatccaaatgacccagtctccatcctccctgtctgcatctgtcggagacagtgtcaccatcacttgccgggcaagtcaggacattagaaatcatttaggctggtatcagcataaaccagggaaagcccctaagcgcctgatctatgctgcatccagtttgcaaagtggggtcccatctaggttcagcggcagtggatctgggacagaattcactctcacaatcagcagcctgcagcctgaagattttgcaacttattactgtctacagtataatagttacccattcactttcggccctgggaccaaagtggatatcaac

SEQ ID NO: 24920 - protein, 107 aa, Artificial Sequence
  Description of Artificial Sequence: Synthetic polypeptide
DIQMTQSPSSLSASVGDSVTITCRASQDIRNHLGWYQHKPGKAPKRLIYAASSLQSGVPSRFSGSGSGTEFTLTISSLQPEDFATYYCLQYNSYPFTFGPGTKVDIN

SEQ ID NO: 24921 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattagtaattatttagcctggtttcagcagaaaccagggaaagcccctaagtccctgatctctgctgcatccagtttgcaaagtggggtcccatcaaaattcagcggcagtggatctgggacagatttcactctcaccatcagcagcctgcagcctgaagattttgcaacttattactgccaacagtatcatagttacccgtggacgttcggccaagggaccaaggtggaaatcaat

SEQ ID NO: 24922 - protein, 107 aa, Artificial Sequence
  Description of Artificial Sequence: Synthetic polypeptide
DIQMTQSPSSLSASVGDRVTITCRASQDISNYLAWFQQKPGKAPKSLISAASSLQSGVPSKFSGSGSGTDFTLTISSLQPEDFATYYCQQYHSYPWTFGQGTKVEIN

SEQ ID NO: 24923 - DNA, 321 bp, Artificial Sequence
  Description of Artificial Sequence: Synthetic polynucleotide
gacatccagatgacccagtctccttcctccctgtctgcatctgtaggagacagagtcaccatcacttgccgggcaagtcagggcattagaaatgatttaggctgctatcagcagaaaccagggaaagcccctaagcgcctgatctatgctgcatccagtttgcaaagtggggtcccatcaaggttcagcggcaatggatatgggacagaattcactctcacaatcagcagcctgcagcctgaagattttgcaacttattactgtctacagcataatagttacccgtggacgttcggccaagggaccaaggtggaaatcaaa

SEQ ID NO: 24924 - protein, 107 aa, Artificial Sequence
  Description of Artificial Sequence: Synthetic polypeptide
DIQMTQSPSSLSASVGDRVTITCRASQGIRNDLGCYQQKPGKAPKRLIYAASSLQSGVPSRFSGNGYGTEFTLTISSLQPEDFATYYCLQHNSYPWTFGQGTKVEIK

SEQ ID NO: 24925 - DNA, 318 bp, Artificial Sequence; identical to SEQ ID NO: 24733
  Description of Artificial Sequence: Synthetic polynucleotide

SEQ ID NO: 24926 - protein, 106 aa, Artificial Sequence; identical to SEQ ID NO: 24734
  Description of Artificial Sequence: Synthetic polypeptide

SEQ ID NO: 24927 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattaacaattatttagcctggtttcagcagaaatcagggaaagcccctaagtccctgatctctgttgcatccagtttgcaaactggggtcccatcaaggttcagcggcagtggatctgggacagatttcactctcaccatcagcagcctgcagcctgaagattttgcaacttattactgccaacagtataatagttaccctctcactttcggcggagggaccaaggtggagatcaaa

SEQ ID NO: 24928 - protein, 107 aa, Artificial Sequence
  Description of Artificial Sequence: Synthetic polypeptide
DIQMTQSPSSLSASVGDRVTITCRASQGINNYLAWFQQKSGKAPKSLISVASSLQTGVPSRFSGSGSGTDFTLTISSLQPEDFATYYCQQYNSYPLTFGGGTKVEIK

SEQ ID NO: 24929 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaggtggttagcctggtatcagcagaaaccagggaaagcccctaagctcctgatctatggtgcatccagtttgcaaagtggggtcccatcaaggttcagcggcagtggatctgggacagatttcactctcaccatcagcagcctgcagcctgaagattttgcaatttattattgtcaacaggctaacagtttcccattcactttcggccctgggaccaaagtggatatcaaa

SEQ ID NO: 24930 - protein, 107 aa, Artificial Sequence
  Description of Artificial Sequence: Synthetic polypeptide
DIQMTQSPSSVSASVGDRVTITCRASQGISRWLAWYQQKPGKAPKLLIYGASSLQSGVPSRFSGSGSGTDFTLTISSLQPEDFAIYYCQQANSFPFTFGPGTKVDIK

SEQ ID NO: 24931 - DNA, 327 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcgactatttaaattggtatcagcagaaaccagggaaagcccctaaactcctgatctttgatacaaccagtttgcaaagtggggtcccatcaaggttcagtggcagtggatctgggacagatttcactctcaccatcaacagtctgcaacctgaagattttgcaacttactactgtcaacagacttacaatacccctccggagcgcagttttggccaggggaccaagctggagatcaaa

SEQ ID NO: 24932 - protein, 109 aa, Artificial Sequence
  Description of Artificial Sequence: Synthetic polypeptide
DIQMTQSPSSLSASVGDRVTITCRASQSISDYLNWYQQKPGKAPKLLIFDTTSLQSGVPSRFSGSGSGTDFTLTINSLQPEDFATYYCQQTYNTPPERSFGQGTKLEIK

SEQ ID NO: 24933 - DNA, 321 bp, Artificial Sequence
  Description of Artificial Sequence: Synthetic polynucleotide
gacatccagatgacccagtctccatcctccctgtctgcatctgtaacagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcagtctcacaatcagcagcctgcagcctgaagattttgcaacttattactgtctacagcataatagttaccctctcactttcggcggagggaccaaggtggagatcaaa

SEQ ID NO: 24934 - protein, 107 aa, Artificial Sequence
  Description of Artificial Sequence: Synthetic polypeptide
DIQMTQSPSSLSASVTDRVTITCRASQGIRNDLGWYQQKPGKAPKRLIYAASSLQSGVPSRFSGSGSGTEFSLTISSLQPEDFATYYCLQHNSYPLTFGGGTKVEIK

SEQ ID NO: 24935 - DNA, 321 bp, Artificial Sequence
  Description of Artificial Sequence: Synthetic polynucleotide
gacatccagatgacccagtctccatcctccctgtctgcgtctgtaggagacagagtcaccatcacttgccgggcaagtcagggcattagaaatgatttaggctggtatcagcagaaaccagggaaagcccctaagcgcctgatctatactgcatccagtttgcaaagtggggtcccatcaaggttcagcggcagtggatctgggacagaattcactctcacaatcagcagcctgcagcctgaagattttgcaacttattactgtctacaacataatagttacccgtggacgttcggcctagggaccaaggtggtcatcaaa

SEQ ID NO: 24936 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASSLQSGVPSRFSGSGSGTEFTLTISSLQPEDFATYYCLQHNSYPWTFGLGTKVVIK

SEQ ID NO: 24937 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcacatcaaggttcagcggcagtggatctgggacagaattcactctcacaatcagcagcctgcagcctgaagattttgcaacttattactgtctacagcatagtagttacccgttcactttcgtcggagggaccaaagtggagatcaaa

SEQ ID NO: 24938 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVTSRFSGSGSGTEFTLTISSLQPEDFATYYCLQHSSYPFTFVGGTKVEIK

SEQ ID NO: 24939 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcagaacattatcagctatttaaattggtatcagcagaaaccagggaaagcccctaaggtcctgatctatactgcatccaatttgcaaactggggtcccatcagggttcagtggcagtggatctgggacagatttcactctcaccatcagcagtctgcaacctgaagattttgcaacttactactgtcaacagcctcacagtcccccgctcactttcggcggagggaccaaggtggagatcaaa

SEQ ID NO: 24940 - protein, 107 aa, Artificial Sequence
  Description of Artificial Sequence: Synthetic polypeptide
DIQMTQSPSSLSASVGDRVTITCRTSQNIISYLNWYQQKPGKAPKVLIYTASNLQTGVPSGFSGSGSGTDFTLTISSLQPEDFATYYCQQPHSPPLTFGGGTKVEIK

SEQ ID NO: 24941 - DNA, 321 bp, Artificial Sequence
  Description of Artificial Sequence: Synthetic polynucleotide
gacatccagatgacccagtctccatcctccctgtctgcatctgtgggagacagagtcaccatcacttgccgggcaagtcagggcattggaaatgatttaggctggtatcagcagaaaccagggaaagcccctaagcgcctgatctatgctgcatccagtttgcaaagtggggtcccatcacggttcagcggcagtgtatctgggacagaattcactctcccaatcagcagcctgcagcctgaagattttgcaacttattactgtctacaacattatacttaccctcggacgttcggccaagggaccaaggtggaaatcaaa

SEQ ID NO: 24942 - protein, 107 aa, Artificial Sequence
  Description of Artificial Sequence: Synthetic polypeptide
DIQMTQSPSSLSASVGDRVTITCRASQGIGNDLGWYQQKPGKAPKRLIYAASSLQSGVPSRFSGSVSGTEFTLPISSLQPEDFATYYCLQHYTYPRTFGQGTKVEIK

SEQ ID NO: 24943 - DNA, 321 bp, Artificial Sequence; identical to SEQ ID NO: 24483
  Description of Artificial Sequence: Synthetic polynucleotide

SEQ ID NO: 24944 - protein, 107 aa, Artificial Sequence; identical to SEQ ID NO: 24484
  Description of Artificial Sequence: Synthetic polypeptide

SEQ ID NO: 24945 - DNA, 321 bp, Artificial Sequence
  Description of Artificial Sequence: Synthetic polynucleotide
gacatccagatgacccagtctccatcctccctgtctgcatctggaggagacagagtcaccatcacttgccgggcaagtcagggcattagaaacgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagctttatagttaccctcggacgttcggccaggggaccaaggtggatatcaaa

SEQ ID NO: 24946 - protein, 107 aa, Artificial Sequence
  Description of Artificial Sequence: Synthetic polypeptide
DIQMTQSPSSLSASGGDRVTITCRASQGIRNDLGWYQQKPGKAPKRLIYAASSLQSGVPSRFSGSGSGTEFTLTISSLQPEDFATYYCLQLYSYPRTFGQGTKVDIK

SEQ ID NO: 24947 - DNA, 321 bp, Artificial Sequence
  Description of Artificial Sequence: Synthetic polynucleotide
gacatccagatgacccagtctccatcctccctgtttgcatctgtaggagacagagtcaccatcacttgccgggcaagtcagggcattagaaatgatttaggctggtatcagcagaaaccagggaaagcccataagcgccttatatatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 24948 - protein, 107 aa, Artificial Sequence
  Description of Artificial Sequence: Synthetic polypeptide
DIQMTQSPSSLFASVGDRVTITCRASQGIRNDLGWYQQKPGKAHKRLIYAASSLQSGVPSRFSGSGSGTEFTLTISSLQPEDFATYYCLQHNSYPLTFGGGTKVEIK

SEQ ID NO: 24949 - DNA, 321 bp, Artificial Sequence
  Description of Artificial Sequence: Synthetic polynucleotide
gacatccagatgacccagtctccatcctccctgtttgcatctgtaggagacagagtcaccatcacttgccgggcaagtcagggcattagaaatgatttaggctggtatgagcagaaaccagggaaagcccctaagcgcctgatctatactgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 24950 - protein, 107 aa, Artificial Sequence
  Description of Artificial Sequence: Synthetic polypeptide
DIQMTQSPSSLFASVGDRVTITCRASQGIRNDLGWYEQKPGKAPKRLIYTASSLQSGVPSRFSGSGSGTEFTLTISSLQPEDFATYYCLQHNSYPLTFGGGTKVEIK

SEQ ID NO: 24951 - DNA, 321 bp, Artificial Sequence
  Description of Artificial Sequence: Synthetic polynucleotide
gacatccagatgacccagtctccatcctccctgtctgcttctgtaggcgacagagtcaccatcacttgccgggcaagtcagggcattagaaatgatttaggctggtatcagcagaaaccagggaaagcccctacgcgcctgatctatgctgcatccagtttgcacagtggggtcccatcacggttcagcggcagtggatctgggacagaattcactctcacaatcagcagcctgcagcctgaagatcttgcaacttattactgtctacaacattatagtttccctcggacgttcggccaagggaccaaggtggaaatcaaa

SEQ ID NO: 24952 - protein, 107 aa, Artificial Sequence
  Description of Artificial Sequence: Synthetic polypeptide
DIQMTQSPSSLSASVGDRVTITCRASQGIRNDLGWYQQKPGKAPTRLIYAASSLHSGVPSRFSGSGSGTEFTLTISSLQPEDLATYYCLQHYSFPRTFGQGTKVEIK

SEQ ID NO: 24953 - DNA, 324 bp, Artificial Sequence
  Description of Artificial Sequence: Synthetic polynucleotide
gacatccagatgacccagtctccatcctccctgtctgcatctgtaggagacagagtcaccatcacttgccggacaagtcagagcattagtacttatttaaattggtatcagcagaaaccagggaaagcccctaagctcctgatctttgctgcatccagtttgcaaagtggggtcccatcaaggttcagtggcagtggatctgggacagatttcactctcaccatcagcagtctgcaacctgaagattttgcaacttacttctgtcaacagagttacagaaccccctttttcactttcggccctgggaccaaagtggatatcaaa

SEQ ID NO: 24954 - protein, 108 aa, Artificial Sequence
  Description of Artificial Sequence: Synthetic polypeptide
DIQMTQSPSSLSASVGDRVTITCRTSQSISTYLNWYQQKPGKAPKLLIFAASSLQSGVPSRFSGSGSGTDFTLTISSLQPEDFATYFCQQSYRTPFFTFGPGTKVDIK

SEQ ID NO: 24955 - DNA, 321 bp, Artificial Sequence
  Description of Artificial Sequence: Synthetic polynucleotide
gacatccagatgacccagtctccatcctccctgtctgcatctgtaggagacagaggcaccatcacttgccgggcaagtcagggcattagaagtaatttaggctggtatcagcagaaaccagggaaagcccctaagcgcctgatctatgctgcatccagtttggaaagtggggtcccatcaaggttcagcggcagtggatctgggacagaattcactctcacaatcagcagcctgcagcctgaagattttgcaacttatttctgtctacaggataatagttatccgttcactttcggcggagggaccaaggtggagatcaaa

SEQ ID NO: 24956 - protein, 107 aa, Artificial Sequence
  Description of Artificial Sequence: Synthetic polypeptide
DIQMTQSPSSLSASVGDRGTITCRASQGIRSNLGWYQQKPGKAPKRLIYAASSLESGVPSRFSGSGSGTEFTLTISSLQPEDFATYFCLQDNSYPFTFGGGTKVEIK

SEQ ID NO: 24957 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcggtggatctgggacaatattcactctcacaatcagcagcctgcagcctgaagattttgcaacttattactgtctacagcataatagttacgcgctcactttcggcggagggaccaaggtggagatcaaa

SEQ ID NO: 24958 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGGGSGTIFTLTISSLQPEDFATYYCLQHNSYALTFGGGTKVEIK

SEQ ID NO: 24959 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagagaccagggaaagcccctaagcgcctgatctatgctgcatccagtttgcaaagtggggtcccatcaaggttcagcggcagtggatctgggacagaattcactctcacaatcagcagcctgcagcctgaagattctgcaacttattactgtctacatcaatatagttaccctcggacgttcggccaagggaccaaggtggaaatcaaa

SEQ ID NO: 24960 - protein, 107 aa, Artificial Sequence
  Description of Artificial Sequence: Synthetic polypeptide
DIQMTQSPSSLSASVGDRVTITCRASQGIRNDLGWYQQRPGKAPKRLIYAASSLQSGVPSRFSGSGSGTEFTLTISSLQPEDSATYYCLHQYSYPRTFGQGTKVEIK

SEQ ID NO: 24961 - DNA, 321 bp, Artificial Sequence
  Description of Artificial Sequence: Synthetic polynucleotide
gacatccagatgacccagtcgccatccgcactgtctgcatctgtaggagacagagtcaccatcacttgtcgggcgagtcaggacattaggaattatttagcctggtttcagcagaaaccagggaaagcccctaagtccctgatctctgttgcatccagtttgcaaagtggggtcccatcaaggttcagcgggagtggatctgggacagatttcactctcaccatcagcagcctgcagcctgaagattttgcaacttattattgccaacagtataatagttaccctctcactttcggcggagggaccaaggtggagatcaaa

SEQ ID NO: 24962 - protein, 107 aa, Artificial Sequence
  Description of Artificial Sequence: Synthetic polypeptide
DIQMTQSPSALSASVGDRVTITCRASQDIRNYLAWFQQKPGKAPKSLISVASSLQSGVPSRFSGSGSGTDFTLTISSLQPEDFATYYCQQYNSYPLTFGGGTKVEIK

SEQ ID NO: 24963 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcatagtaattaccctctcactttcggcggagggaccatggtggagatcaga

SEQ ID NO: 24964 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHSNYPLTFGGGTMVEIR

SEQ ID NO: 24965 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagctattatttagcctggtttcagcagaaaccagggaaagcccctaagtccctgatctatgttgcatccagtttgcaaagtggggtcccatcaaagttcagcggcagtggatctgggacagatttcactctcaccatcagcagcctgcagcctgaagattttgcaacttattactgccaacagtataatagttacccattcactttcggccctgggaccaaagtggatatcaat

SEQ ID NO: 24966 - protein, 107 aa, Artificial Sequence
  Description of Artificial Sequence: Synthetic polypeptide
DIQMTQSPSSLSASVGDRVTITCRASQGISYYLAWFQQKPGKAPKSLIYVASSLQSGVPSKFSGSGSGTDFTLTISSLQPEDFATYYCQQYNSYPFTFGPGTKVDIN

SEQ ID NO: 24967 - DNA, 321 bp, Artificial Sequence
  Description of Artificial Sequence: Synthetic polynucleotide
gacatccagatgacccagtctccatcctccctgtctgcatctataggagacagagtcaccatcacttgccgggcaagtcaggccattagaaatgatttagactggtatcagcagaaaccagggaaagcccctaagcgccttatctatgctgcatccagtttgcaaagtggggtcccatcaaggttcagcggcagtggatctgggacagaattcactctcacaatcagcagcctgcagactgaagattttgcaacttattactgtctacagcataatagttatccgctcactttcggcggagggaccaaggtggagatcaaa

SEQ ID NO: 24968 - protein, 107 aa, Artificial Sequence
  Description of Artificial Sequence: Synthetic polypeptide
DIQMTQSPSSLSASIGDRVTITCRASQAIRNDLDWYQQKPGKAPKRLIYAASSLQSGVPSRFSGSGSGTEFTLTISSLQTEDFATYYCLQHNSYPLTFGGGTKVEIK

SEQ ID NO: 24969 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaagccagggaaagtccctaagcgcctgatctatgctgcatccagtttgcaaagtggggtcccatcaaggttcagcggcagtggatctgggacagaattcactctcacaatcagcagcctgcagcctgaagattttgcaacttattactgtctactgcattatagttaccctcggacgttcggccgagggaccaaggtggaaatcaaa

SEQ ID NO: 24970 - protein, 107 aa, Artificial Sequence
  Description of Artificial Sequence: Synthetic polypeptide
DIQMTQSPSSLSASVGDRVTITCRASQGIRNDLGWYQQKPGKVPKRLIYAASSLQSGVPSRFSGSGSGTEFTLTISSLQPEDFATYYCLLHYSYPRTFGRGTKVEIK

SEQ ID NO: 24971 - DNA, 321 bp, Artificial Sequence; identical to SEQ ID NO: 24935
  Description of Artificial Sequence: Synthetic polynucleotide

SEQ ID NO: 24972 - protein, 107 aa, Artificial Sequence; identical to SEQ ID NO: 24936
  Description of Artificial Sequence: Synthetic polypeptide

SEQ ID NO: 24973 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccctcaagattcagtggaagtggatctgggacagattttactttcaccatcagcagcctgcaacctgaggatgttgcaacatattactgtcaacagtatgataatctcccgatcaccttcggccaagggacacgactggacattaaa

SEQ ID NO: 24974 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDVATYYCQQYDNLPITFGQGTRLDIK

SEQ ID NO: 24975 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtgggatcccatcaaggttcagcggcagtggatttgggacagaattcactctcacaatcagcagcctgcagcctgaagattttgcaacttattactgtctacagcatagtaattaccctctcactttcggcggagggaccaaggtggagatcaaa

SEQ ID NO: 24976 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGIPSRFSGSGFGTEFTLTISSLQPEDFATYYCLQHSNYPLTFGGGTKVEIK

SEQ ID NO: 24977 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattaacaactatttaaattggtatcagcagaaactagggacagcccctaagctcctgatctacgatggatccaatttggaaacaggggtcccatcaaggttcagtggaagtggatctgggacagattttactttcaccatcagcagcctgcagcctgaagatattgcaacatattactgtcaacagtatgaaaatctcccgatcactttcggccaagggacacgactggagattaaa

SEQ ID NO: 24978 - protein, 107 aa, Artificial Sequence
  Description of Artificial Sequence: Synthetic polypeptide
DIQMTQSPSSLSASVGDRVTITCQASQDINNYLNWYQQKLGTAPKLLIYDGSNLETGVPSRFSGSGSGTDFTFTISSLQPEDIATYYCQQYENLPITFGQGTRLEIK

SEQ ID NO: 24979 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattaccaactatttaaattggtatcagcagaaaccagggaaagcccctaacctcctgatctacgatgcatccaatttggaaacaggggtcccatcaaggttcagtggaagtggatctgggacagattttactttcaccatcagcagcctgcagcctgaagatattgcgacatattactgtcaacagtatgataatctcccgatcaccttcgcccaagggacacgactggagattaaa

SEQ ID NO: 24980 - protein, 107 aa, Artificial Sequence
  Description of Artificial Sequence: Synthetic polypeptide
DIQMTQSPSSLSASVGDRVTITCQASQDITNYLNWYQQKPGKAPNLLIYDASNLETGVPSRFSGSGSGTDFTFTISSLQPEDIATYYCQQYDNLPITFAQGTRLEIK

SEQ ID NO: 24981 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctttgctgcatccagtttgcaaagtggcgtcccatcacggttcagcggcagtggatctgggacagaattcactctcacaatcagcagcctgcagcctgaagattttgcaacttattactgtctacagcataatagttacccgctcactttcggcggagggaccaaggtggagatcaga

SEQ ID NO: 24982 - protein, 107 aa, Artificial Sequence
  Description of Artificial Sequence: Synthetic polypeptide
DIQMTQSPSSLSASVGDRVTITCRASQGIRNDLGWYQQKPGKAPKRLIFAASSLQSGVPSRFSGSGSGTEFTLTISSLQPEDFATYYCLQHNSYPLTFGGGTKVEIR

SEQ ID NO: 24983 - DNA, 321 bp, Artificial Sequence
  Description of Artificial Sequence: Synthetic polynucleotide
gacatccagatgacccagtctccatcctccctgtctgcctctgtaggagacagagtcaccatcccttgccgggcgagtcaggacattagcaattatttagcctggtatcagcagaaaccagggaaagttcctaagctcctgatctatgctgcatacattttgcaatcaggggtcccatctcggttcagtggcagtggatctgggacagatttcactctcaccatcagcagcctgcagcctgaagatgttgcagcttattactgtcaaaagtatgacagtgccccattcactttcggccctgggaccaaagtggatatcaaa

SEQ ID NO: 24984 - protein, 107 aa, Artificial Sequence
  Description of Artificial Sequence: Synthetic polypeptide
DIQMTQSPSSLSASVGDRVTIPCRASQDISNYLAWYQQKPGKVPKLLIYAAYILQSGVPSRFSGSGSGTDFTLTISSLQPEDVAAYYCQKYDSAPFTFGPGTKVDIK

SEQ ID NO: 24985 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattatcagctatttaaattggtatctgcagaaaccagggaaagcccctaagttcctgatctatactgcatccagtttgcaaagtggggtcccatcaaggttcagtggcagtggatctgggacagatttcactctcaccatcagcagtctgcaacctgaagattttgcaacttactactgtcaacagacttacagtaccccgctcactttcggcggagggaccaaggtggagatcaag

SEQ ID NO: 24986 - protein, 107 aa, Artificial Sequence
  Description of Artificial Sequence: Synthetic polypeptide
DIQMTQSPSSLSASVGDRVTITCRASQSIISYLNWYLQKPGKAPKFLIYTASSLQSGVPSRFSGSGSGTDFTLTISSLQPEDFATYYCQQTYSTPLTFGGGTKVEIK

SEQ ID NO: 24987 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagtagttatttaaattggtatcagcagaaaccagggaaagcccccaagctcctgatctttgctgcatccagtttgcaaagtggggtcccatcaaggttcagtggcagtggatctgggacagatttcactctcaccatcagcagtctgcaacctgaagattttgcaacttacttctgtcaacagagttacagaaccccctttttcactttcggccctgggaccaaagtggatatcaaa

SEQ ID NO: 24988 - protein, 108 aa, Artificial Sequence
  Description of Artificial Sequence: Synthetic polypeptide
DIQMTQSPSSLSASVGDRVTITCRASQSISSYLNWYQQKPGKAPKLLIFAASSLQSGVPSRFSGSGSGTDFTLTISSLQPEDFATYFCQQSYRTPFFTFGPGTKVDIK

SEQ ID NO: 24989 - DNA, 321 bp, Artificial Sequence
  Description of Artificial Sequence: Synthetic polynucleotide
gacctccagatgacccagtctccatcctccctgtctgcatctgtaggagaccgagtcaccatcacttgccgggcaagtcagagcattttcagctacttaaattggtatcagcagaaaccagggaaagcccctaagctcctgatctgtactgcatccagtttgcaaaatggggtcccatcaaggttcagtggcagtggatctgggacagatttcactctcaccatcagcagtctacagcctgaggattttgcaacttactactgtcaacagacttacagtcttccgctcactttcggcggagggaccaaggtggagatcaaa

SEQ ID NO: 24990 - protein, 107 aa, Artificial Sequence
  Description of Artificial Sequence: Synthetic polypeptide
DLQMTQSPSSLSASVGDRVTITCRASQSIFSYLNWYQQKPGKAPKLLICTASSLQNGVPSRFSGSGSGTDFTLTISSLQPEDFATYYCQQTYSLPLTFGGGTKVEIK

SEQ ID NO: 24991 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctaatctctgctgcatccagtttgcaaagtggggtcccatcaaacttcagcggcagtggatctgggacagatttcactctcaccatcagcagcctgcagcctgaagattttgcaacttattactgccaacagtatcatagttacccattcactttcggccctgggaccaaagtggatatcaaa

SEQ ID NO: 24992 - protein, 107 aa, Artificial Sequence
  Description of Artificial Sequence: Synthetic polypeptide
DIQMTQSPSSLSASVGDRVTITCRASQGISNYLAWFQQKPGKAPKSLISAASSLQSGVPSNFSGSGSGTDFTLTISSLQPEDFATYYCQQYHSYPFTFGPGTKVDIK

SEQ ID NO: 24993 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaagttattactgtctacagcataatagttacccgctcactttcggcggagggaccaaggtggagatcaat

SEQ ID NO: 24994 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFASYYCLQHNSYPLTFGGGTKVEIN

SEQ ID NO: 24995 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacattagcagctatttaaattggtatcagcagaaaccagggaaagcccctaagctcctgatctatgctgcatccagtttgcaaagtggggtcccatcaaggttcagtggcagaggatctgggacagatttcactctcaccatcagtagtctgcaacctgaagattttgcaacttactactgtcaacagagttacagaacccccttattcactttcggccctgggaccaaggttgatttcaaa

SEQ ID NO: 24996 - protein, 108 aa, Artificial Sequence
  Description of Artificial Sequence: Synthetic polypeptide
DIQMTQSPSSLSASVGDRVTITCRASQNISSYLNWYQQKPGKAPKLLIYAASSLQSGVPSRFSGRGSGTDFTLTISSLQPEDFATYYCQQSYRTPLFTFGPGTKVDFK

SEQ ID NO: 24997 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagttcaat

SEQ ID NO: 24998 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEFN

SEQ ID NO: 24999 - DNA, 321 bp, Artificial Sequence
  Description of Artificial Sequence: Synthetic polynucleotide
gacatccagatgacccagtctccatcctcactgtctgcttctgtaggagacagagtcaccatcacttgtcgggcgagtcagggcattagcaattatttagcctggtttcagcagaaaccagggaaagcccctaagtccctgatctctgctgcatccagtttgcaaagtggggtcccatcaaagttcagcggcagtggatctgggacagatttcactctcaccatcagcagcctgcagcctgaagattttgcaacttattactgccaacagtataatagttacccattcactttcggccctgggaccaaagtggatatcaaa

SEQ ID NO: 25000 - protein, 107 aa, Artificial Sequence; identical to SEQ ID NO: 24484
  Description of Artificial Sequence: Synthetic polypeptide

SEQ ID NO: 25001 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattaacaactatttaaattggtatcaacagaaaccagggaaagcccctaagctcctgatatacgatgcatccaatttggaaacaggggtcccatcaaggttcagtggaagtggatctgggacagattttactttcaccatcagcagtctgcagcctgaagatattacaacatattactgtcaacagtatgaaaatctcccgatcaccttcggccaagggacacgactggagattaaa

SEQ ID NO: 25002 - protein, 107 aa, Artificial Sequence
  Description of Artificial Sequence: Synthetic polypeptide
DIQMTQSPSSLSASVGDRVTITCQASQDINNYLNWYQQKPGKAPKLLIYDASNLETGVPSRFSGSGSGTDFTFTISSLQPEDITTYYCQQYENLPITFGQGTRLEIK

SEQ ID NO: 25003 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattcgaaatcatttaggctggtatcagcagaaaccagggaaagcccctaagcgcctgatctatgctgcctccagtttgcaaagtggggtcccatcaaggttcagcggcagtggatctgggacagaattcactctcacagtcagcagcctgcagcctgaagattttgcaacttattactgtctacagtataatggttacccattcactttcggccctgggaccaaagtggatatcaaa

SEQ ID NO: 25004 - protein, 107 aa, Artificial Sequence
  Description of Artificial Sequence: Synthetic polypeptide
DIQMTQSPSSLSASVGDRVTITCRASQGIRNHLGWYQQKPGKAPKRLIYAASSLQSGVPSRFSGSGSGTEFTLTVSSLQPEDFATYYCLQYNGYPFTFGPGTKVDIK

SEQ ID NO: 25005 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcagggcattagcaactctttaaattggtatcagcagaaaccaggaaaagcccctaaactcctgatctacgatgcatccaatttggaaacaggggtcccatcaaggttcagtggaagtggagctgggacagattttactttcaccatcagcagcctgcagcctgaagatattgcaacatattactgtcaacaatatgataatctcccgctcactttcggcggagggaccaaggtggagatcaaa

SEQ ID NO: 25006 - protein, 107 aa, Artificial Sequence
  Description of Artificial Sequence: Synthetic polypeptide
DIQMTQSPSSLSASVGDRVTITCQASQGISNSLNWYQQKPGKAPKLLIYDASNLETGVPSRFSGSGAGTDFTFTISSLQPEDIATYYCQQYDNLPLTFGGGTKVEIK

SEQ ID NO: 25007 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcgtccagtgtgcaaactggggtcccatcaaggttcagcggcagtggatctgggacagaattcactctcacaatcagcagcctgcagcctgaagattttgcaatttattactgtctacagcataatagttacccgctcactttcggcggagggaccaaggtggagatcaaa

SEQ ID NO: 25008 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSVQTGVPSRFSGSGSGTEFTLTISSLQPEDFAIYYCLQHNSYPLTFGGGTKVEIK

SEQ ID NO: 25009 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcattatagttaccctcggacgttcggccaagggaccaaggtggaagtcaaa

SEQ ID NO: 25010 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHYSYPRTFGQGTKVEVK

SEQ ID NO: 25011 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagtattaataattatttaaattggtatcagcagaaaccagggaaagcccctaagctcctgatctatgctacatccagtttgcaaaatggggtcccatcaaggttcagtggcagtggatctgggacagatttcactctcaccatcagcagtctgcaacctgaagattttgcaacttactactgtcaacagagttacagtacccccttattcactttcggccctgggaccaaagtggatatcaat

SEQ ID NO: 25012 - protein, 108 aa, Artificial Sequence
  Description of Artificial Sequence: Synthetic polypeptide
DIQMTQSPSSLSASVGDRVTITCRASQSINNYLNWYQQKPGKAPKLLIYATSSLQNGVPSRFSGSGSGTDFTLTISSLQPEDFATYYCQQSYSTPLFTFGPGTKVDIN

SEQ ID NO: 25013 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccggggaaagcccctaagcgcctgatctatgctgcatccagtgtgcaaagtggggtcccatcaaggttcagcggcagtggatctgggacagaattcactctcacaatcagcagcctgcagcctgaagattttgcaatttattactgtctacagcataatagttacccgctcactttcggcggagggaccaaggtggagatcaaa

SEQ ID NO: 25014 - protein, 107 aa, Artificial Sequence; identical to SEQ ID NO: 24274
  Description of Artificial Sequence: Synthetic polypeptide

SEQ ID NO: 25015 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattaacaactatttaaattggtgtcaacagaaaccagggaaagcccctaagctcttgatatacgatgcatccaatttggaaacaggggtcccatcaaggttcagtggaagtggatctgggacagattttactttcaccatcagcagcctgcagcctgaagatattgcaacatattactgtcaacagtatgataatctcccgatcaccttcggccaagggacacgactggagattaaa

SEQ ID NO: 25016 - protein, 107 aa, Artificial Sequence
  Description of Artificial Sequence: Synthetic polypeptide
DIQMTQSPSSLSASVGDRVTITCQASQDINNYLNWCQQKPGKAPKLLIYDASNLETGVPSRFSGSGSGTDFTFTISSLQPEDIATYYCQQYDNLPITFGQGTRLEIK

SEQ ID NO: 25017 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaactggggtcccatcaagattcagcggcagtggatctgggacagaattcattctcacaatcagcagcctgcagcctgaagattttgcaacttattactgtctacagcataatagttaccctctcactttcggcggagggaccaaggtggagatcaaa

SEQ ID NO: 25018 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQTGVPSRFSGSGSGTEFILTISSLQPEDFATYYCLQHNSYPLTFGGGTKVEIK

SEQ ID NO: 25019 - DNA, 324 bp, Artificial Sequence
  Description of Artificial Sequence: Synthetic polynucleotide
gacatccagatgacccagtctcaatcctccctgtctgcatctgtaggagacagagtcaccatcacttgccgggcaagtcagagcattgccagttatttaaattggtatcagcagaaaccagggaaagcccctaaactcctgatctatggtgcatccagtttgcaaagtggggtcccatcaaggttcagtggcagtggatctgggacagatttcactctcaccatcagcagtctccaacctgaagattttgcaacttactactgtcaacagagttacagtacccccttattcagtttcggccctgggaccaaagtggatatcaaa

SEQ ID NO: 25020 - protein, 108 aa, Artificial Sequence
  Description of Artificial Sequence: Synthetic polypeptide
DIQMTQSQSSLSASVGDRVTITCRASQSIASYLNWYQQKPGKAPKLLIYGASSLQSGVPSRFSGSGSGTDFTLTISSLQPEDFATYYCQQSYSTPLFSFGPGTKVDIK

SEQ ID NO: 25021 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttacaaagtggggtcccatcaaggttcagcggcagtggttctgggacagaattcactctcacagtcagcagcctgcagcctgaagattttgcaacttattactgtctacagcatagtagttaccctctcactttcggcggagggaccaaggtggagatcaaa

SEQ ID NO: 25022 - protein, 107 aa, Artificial Sequence; identical to SEQ ID NO: 24418
  Description of Artificial Sequence: Synthetic polypeptide

SEQ ID NO: 25023 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagctattatttagcctggtttcagcagaaaccagggaaagcccctaagtccctgatctatgttgcatccagtttgcaaagtggggtcccatcaaagttcagcggcagtggatctgggacagatttcactctcaccatcagcagcctgcagcctgaagattttgcaacttattactgccaacagtatgatagttacccattcactttcggccctgggaccaaagtggatatcaaa

SEQ ID NO: 25024 - protein, 107 aa, Artificial Sequence
  Description of Artificial Sequence: Synthetic polypeptide
DIQMTQSPSSLSASVGDRVTITCRASQGISYYLAWFQQKPGKAPKSLIYVASSLQSGVPSKFSGSGSGTDFTLTISSLQPEDFATYYCQQYDSYPFTFGPGTKVDIK

SEQ ID NO: 25025 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatactgcatccagtttgcaaagtggggtcccatcaaggttcaacggcagtggatctgggacagaattcactctcacaatcagcagcctgcagcctgaagattttgcaacttattactgtctacagcatagtagttacccgctcactttcggcggagggaccaaggtggagatcaaa

SEQ ID NO: 25026 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASSLQSGVPSRFNGSGSGTEFTLTISSLQPEDFATYYCLQHSSYPLTFGGGTKVEIK

SEQ ID NO: 25027 - DNA, 321 bp, Artificial Sequence
  Description of Artificial Sequence: Synthetic polynucleotide
gacatccagatgacccagtctccatcctccctgtttgcatctgtaggagacagagtcaccatcacttgccgggcaagtcagggcattagaaatgatttaggctggtatcagcagaaaccagggaaagcccctaagcgccttatctatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 25028 - protein, 107 aa, Artificial Sequence
  Description of Artificial Sequence: Synthetic polypeptide
DIQMTQSPSSLFASVGDRVTITCRASQGIRNDLGWYQQKPGKAPKRLIYAASSLQSGVPSRFSGSGSGTEFTLTISSLQPEDFATYYCLQHNSYPLTFGGGTKVEIK

SEQ ID NO: 25029 - DNA, 336 bp, Artificial Sequence
  Description of Artificial Sequence: Synthetic polynucleotide
gatattgtgatgactcagtctccactctccctgcccgtcacccctggtgagccggcctccatctcctgcaggtctagtcagagcctcctccatagtaatggatacaactatttggattggtacctgcagaagccagggcagtctccacaggtcctgatctatttgggttctaatcgggcctccggggtccctgacaggttcagtggcagtggatcaggcacagattttactctgaaaatcagcagagtggaggctgaggatgttggggtttattactgcatgcaagctctacaaactcctatcaccttcggccaagggacacgactggagattaaa

SEQ ID NO: 25030 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQVLIYLGSNRASGVPDRFSGSGSGTDFTLKISRVEAEDVGVYYCMQALQTPITFGQGTRLEIK

SEQ ID NO: 25031 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcgtccagtttgcaaagtggggtcccatcaaggttcagcggcagtggatctgggacagaattcactctcacaatcagcagcctgcagcctgaagattttgcaacttattactgtctacaccatagtaattaccctctcactttcggcggagggaccaaggtggagatcgaa

SEQ ID NO: 25032 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLHHSNYPLTFGGGTKVEIE

SEQ ID NO: 25033 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccaaccagagagttttatccagctccaacaatcacaactacttagcttggtaccagcagagaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattttagtactccattcactttcggccctgggaccaaagtggatatcaaa

SEQ ID NO: 25034 - protein, 113 aa, Artificial Sequence
  Description of Artificial Sequence: Synthetic polypeptide
DIVMTQSPDSLAVSLGERATINCKSNQRVLSSSNNHNYLAWYQQRPGQPPKLLIYWASTRESGVPDRFSGSGSGTDFTLTISSLQAEDVAVYYCQQYFSTPFTFGPGTKVDIK

SEQ ID NO: 25035 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtaccagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgtaacttattactgtctacagcataatagttatccgtggacgttcggccaagggaccaaggtggaaatcaaa

SEQ ID NO: 25036 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFVTYYCLQHNSYPWTFGQGTKVEIK

SEQ ID NO: 25037 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagagatattttaggctggtatcagcagaaaccagggaaagcccctaagcgcctgatctatgctgcatccagtttgcaaaatggggtcccatcaaggttcagcggcagtggatctgggacagaattcactctcacaatcagcagcctgcagcctgaagattttgcaacttattactgtctacagtatcatagttacccattcactttcggccctgggaccaaagtggatgtcaaa

SEQ ID NO: 25038 - protein, 107 aa, Artificial Sequence
  Description of Artificial Sequence: Synthetic polypeptide
DIQMTQSPSSLSASVGDRVTITCRASQGIRDILGWYQQKPGKAPKRLIYAASSLQNGVPSRFSGSGSGTEFTLTISSLQPEDFATYYCLQYHSYPFTFGPGTKVDVK

SEQ ID NO: 25039 - DNA, 336 bp, Artificial Sequence
  Description of Artificial Sequence: Synthetic polynucleotide
gatattgtgatgactcagtctccactctccctgcccgtcacccctggagagccggcctccatctcctgcaggtctagtcagagcctcctgcatagtaagggatacaactatttggattggtacctgcagaagccagggcagtctccacaggtcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctctcaccttcggccaagggacacgactggagattaaa

SEQ ID NO: 25040 - protein, 112 aa, Artificial Sequence
  Description of Artificial Sequence: Synthetic polypeptide
DIVMTQSPLSLPVTPGEPASISCRSSQSLLHSKGYNYLDWYLQKPGQSPQVLIYLGSNRASGVPDRFSGSGSGTDFTLKISRVEAEDVGVYYCMQALQTPLTFGQGTRLEIK

SEQ ID NO: 25041 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcaacagaaaccagggaaagcccctaagcgcctgatctatgctgcatccagtttgcaaagtggggtcccatcaaggttcagcggcagtggatctgggacagaattcactctcacagtcagcagcctgcagcctgaagattttgctacttattactgtctacaacatactagttacccgctcactttcggcggagggaccaaggtggagatcaaa

SEQ ID NO: 25042 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTVSSLQPEDFATYYCLQHTSYPLTFGGGTKVEIK

SEQ ID NO: 25043 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcaacagaaaccagggaaagcccctaagcgcctgatctatgctgcatccagtttgcaaagtggggtcccatcaaggttcaacggcagtggatctgggacagaattcactctcacaatcagcagcctgcagcctgaagattttgcaacttattactgtctacagcatagtagttacccgctcactttcggcggagggaccaaggtggagatcaaa

SEQ ID NO: 25044 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFNGSGSGTEFTLTISSLQPEDFATYYCLQHSSYPLTFGGGTKVEIK

SEQ ID NO: 25045 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagtaattatttaaattggtatcagcagaaaccagggaaagcccctaagctcctgatctatgctgcatccagtttacaaagtggggtcccatcaaggttcagtggcagtggatctgggacagatttcactctcaccatcagcagtctgcaacctgaagattttgcaacttacttctgtcaacagagttacagaaccccctttttcactttcggccctgggaccaaagtggatatcaaa

SEQ ID NO: 25046 - protein, 108 aa, Artificial Sequence
  Description of Artificial Sequence: Synthetic polypeptide
DIQMTQSPSSLSASVGDRVTITCRASQSISNYLNWYQQKPGKAPKLLIYAASSLQSGVPSRFSGSGSGTDFTLTISSLQPEDFATYFCQQSYRTPFFTFGPGTKVDIK

SEQ ID NO: 25047 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgtctgatctatgctgcatccagtgtgcaaagtggggtcccatcaaggttcagcggcagtggatctgggacagaattcactctcacaatcagcagcctgcagcctgaagattttgcaatttattactgtctacagcataatagttacccgctcactttcggcggagggaccaaggtggagatcaaa

SEQ ID NO: 25048 - protein, 107 aa, Artificial Sequence; identical to SEQ ID NO: 24274
  Description of Artificial Sequence: Synthetic polypeptide

SEQ ID NO: 25049 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattaacaactatttaaattggtatcagcagaaaccagggagagcccctaagctcctgatctacgatgcatccaatttggaaacaggggtcccatcaaggttcagtggaagtggctctgggacagattttactttcaccatcagcagtctgcagcctgaagatattgcaacatattactgtcaacagtttgataatctcccgatcaccttcggccaagggacacgactggagattaaa

SEQ ID NO: 25050 - protein, 107 aa, Artificial Sequence
  Description of Artificial Sequence: Synthetic polypeptide
DIQMTQSPSSLSASVGDRVTITCQASQDINNYLNWYQQKPGRAPKLLIYDASNLETGVPSRFSGSGSGTDFTFTISSLQPEDIATYYCQQFDNLPITFGQGTRLEIK

SEQ ID NO: 25051 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattatcagctatttaaattggtatcagcagaaaccagggaaagcccctaagttcctgatctatactacatccagtttgcaaagtggggtcccatcaaggttcagtggcagtggatctgggacagatttcactctcaccatcagtagtctgcaacctgaagattttgcaacttactactgtcagcagacttacagtaccccgctcactttcggcggagggaccaaggtggagatcaaa

SEQ ID NO: 25052 - protein, 107 aa, Artificial Sequence
  Description of Artificial Sequence: Synthetic polypeptide
DIQMTQSPSSLSASVGDRVTITCRASQSIISYLNWYQQKPGKAPKFLIYTTSSLQSGVPSRFSGSGSGTDFTLTISSLQPEDFATYYCQQTYSTPLTFGGGTKVEIK

SEQ ID NO: 25053 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagaatgttttatacaactccaacaataacaactacttagcttggtaccagcagaaaccaggacagcctcctaagctgctcatttactgggcatctacccggaaatccggggtccctgaccgattcagtggcagcgggtctgggacagatttcactctcaccatcagcagcctgcaggctgaagatgtggcagtttattactgtcagcaatattatactactccgtgcagttttggccaggggaccaagctggagatcaaa

SEQ ID NO: 25054 - protein, 113 aa, Artificial Sequence
  Description of Artificial Sequence: Synthetic polypeptide
DIVMTQSPDSLAVSLGERATINCKSSQNVLYNSNNNNYLAWYQQKPGQPPKLLIYWASTRKSGVPDRFSGSGSGTDFTLTISSLQAEDVAVYYCQQYYTTPCSFGQGTKLEIK

SEQ ID NO: 25055 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacatttatagttatttaaattggtatcagcagaaaccagggaaagcccctaagctcctgatctatgctgcatccagtttgcaaagtggggtcccatcaaggttcagtggcagtggatctgggacagatttcactctcaccatcagcagtctacaacctgaagattttgcaacttactactgtcaacagagttacaatacccccttattcactttcggccctgggaccaaagtggatatcaaa

SEQ ID NO: 25056 - protein, 108 aa, Artificial Sequence
  Description of Artificial Sequence: Synthetic polypeptide
DIQMTQSPSSLSASVGDRVTITCRASQNIYSYLNWYQQKPGKAPKLLIYAASSLQSGVPSRFSGSGSGTDFTLTISSLQPEDFATYYCQQSYNTPLFTFGPGTKVDIK

SEQ ID NO: 25057 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaagtgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgtggacgttcggccaagggaccaaggtggaaatcaaa

SEQ ID NO: 25058 - protein, 107 aa, Artificial Sequence
  Description of Artificial Sequence: Synthetic polypeptide
DIQMTQSPSSLSASVGDRVTITCRASQGIRSDLGWYQQKPGKAPKRLIYAASSLQSGVPSRFSGSGSGTEFTLTISSLQPEDFATYYCLQHNSYPWTFGQGTKVEIK

SEQ ID NO: 25059 - DNA, 321 bp, Artificial Sequence; identical to SEQ ID NO: 24257
  Description of Artificial Sequence: Synthetic polynucleotide

SEQ ID NO: 25060 - protein, 107 aa, Artificial Sequence; identical to SEQ ID NO: 24146
  Description of Artificial Sequence: Synthetic polypeptide

SEQ ID NO: 25061 - DNA, 321 bp, Artificial Sequence; identical to SEQ ID NO: 24299
  Description of Artificial Sequence: Synthetic polynucleotide

SEQ ID NO: 25062 - protein, 107 aa, Artificial Sequence; identical to SEQ ID NO: 24244
  Description of Artificial Sequence: Synthetic polypeptide

SEQ ID NO: 25063 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgccttatctatactgcatccagtttgcaaagtggggtcccatcaaggttcagcggcagtggatctgggacagaattcactctcacaatcagcagcctgcagcctgaagattttgcaacttattactgtctacagcataatagttacccgtggacgttcggccaagggaccaaggtggaaatcaaa

SEQ ID NO: 25064 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASSLQSGVPSRFSGSGSGTEFTLTISSLQPEDFATYYCLQHNSYPWTFGQGTKVEIK

SEQ ID NO: 25065 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacaacataatagttacccgtggacgttcggccaagggaccaaggtggaaatcaaa

SEQ ID NO: 25066 - protein, 107 aa, Artificial Sequence; identical to SEQ ID NO: 24244
  Description of Artificial Sequence: Synthetic polypeptide

SEQ ID NO: 25067 - DNA, 318 bp, Artificial Sequence
  Description of Artificial Sequence: Synthetic polynucleotide
tcctatgagctgactcagccaccctcagtgtccgtgtccccaggacggacagccagcatcacctgctctggagataaattggggaataaatatgcttactggtatcagcagaagccaggccagtcccctgtgctggtcatctatcaagatagaaagcggccctcagggatccctgagcgattctctggctccaactctgggaacacagccactctgaccatcagcgggacccagactatggatgaggctgactattactgtcaggcgtggaacaacagcactgtggtattcggcggagggaccaagctgaccgtccta

SEQ ID NO: 25068 - protein, 106 aa, Artificial Sequence
  Description of Artificial Sequence: Synthetic polypeptide
SYELTQPPSVSVSPGRTASITCSGDKLGNKYAYWYQQKPGQSPVLVIYQDRKRPSGIPERFSGSNSGNTATLTISGTQTMDEADYYCQAWNNSTVVFGGGTKLTVL

SEQ ID NO: 25069 - DNA, 318 bp, Artificial Sequence
  Description of Artificial Sequence: Synthetic polynucleotide
ccctatgagctgactcagccaccctcagtgtccgtgtccccaggacagacagccagcatcacctgctctggagataaattgggggataaatatgtttactggtatcagcagaagtcaggccagtcccctgtgctggtcatctatcaagatagcaagcggccctcagggatccctgagcgattctctggctccaactctggaaacacagccgctctgaccatcagcgggacccaggctatggatgaggctgactattactgtcaggcgtgggacagcagcactgtggttttcggcggagggaccaagctgaccgtccta

SEQ ID NO: 25070 - protein, 106 aa, Artificial Sequence
  Description of Artificial Sequence: Synthetic polypeptide
PYELTQPPSVSVSPGQTASITCSGDKLGDKYVYWYQQKSGQSPVLVIYQDSKRPSGIPERFSGSNSGNTAALTISGTQAMDEADYYCQAWDSSTVVFGGGTKLTVL

SEQ ID NO: 25071 - DNA, 324 bp, Artificial Sequence
  Description of Artificial Sequence: Synthetic polynucleotide
gacatccagatgacccagtctccatcctccctatctgcatctgtaggagacagagtcaccatcacttgccggtcaagtcagagcattaacagctatttaaattggtatcagcagaaacctgggaaagcccctaagctcctgatctttgctgcatccagtttgcacagtggggtcccatcaaggttcagtggcagtggatctgggacggatttcactctcaccatcagcagtctgcaacctgaagattttgcaacttactactgtcaacagggttacaatacccccacgtggacgttcggccaagggaccaaggtggaaatcaat

SEQ ID NO: 25072 - protein, 108 aa, Artificial Sequence
  Description of Artificial Sequence: Synthetic polypeptide
DIQMTQSPSSLSASVGDRVTITCRSSQSINSYLNWYQQKPGKAPKLLIFAASSLHSGVPSRFSGSGSGTDFTLTISSLQPEDFATYYCQQGYNTPTWTFGQGTKVEIN

SEQ ID NO: 25073 - DNA, 327 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacattaacgactatttaaattggtatcagcagaaaccagggaaagcccctaagctcctgatctatgctgcatccaatttgcaaagtggggtcccagcaaggttcagtggcagtcgatctgggacagatttcactctcaccatcagcagtctgcaacctgaagattttgcaacttactactgtcaacagacttacaatacccctccggagcgcagttttggccaggggaccaagctggagatcaaa

SEQ ID NO: 25074 - protein, 109 aa, Artificial Sequence
  Description of Artificial Sequence: Synthetic polypeptide
DIQMTQSPSSLSASVGDRVTITCRASQNINDYLNWYQQKPGKAPKLLIYAASNLQSGVPARFSGSRSGTDFTLTISSLQPEDFATYYCQQTYNTPPERSFGQGTKLEIK

SEQ ID NO: 25075 - DNA, 324 bp, Artificial Sequence
  Description of Artificial Sequence: Synthetic polynucleotide
gacatccagatgacccagtctccatcctcccagtctgcatctgtaggagacagagtcaccatcacttgccgggcgagtcagggcattagcaattatttagcctggtatcagcagaaaccagggagagttcctaagctcctgatctatgctgcatccactttgcaatcaggggtcccatctcggttcagtggcagtggatctgggacagatttcactctcaccatcagcagcctgcagcctgacgatgttgcaacttattactgtcaaaagtataacagtgcccctccgctcaccttcggccaagggacacgactggagattaaa

SEQ ID NO: 25076 - protein, 108 aa, Artificial Sequence
  Description of Artificial Sequence: Synthetic polypeptide
DIQMTQSPSSQSASVGDRVTITCRASQGISNYLAWYQQKPGRVPKLLIYAASTLQSGVPSRFSGSGSGTDFTLTISSLQPDDVATYYCQKYNSAPPLTFGQGTRLEIK

SEQ ID NO: 25077 - DNA, 321 bp, Artificial Sequence
  Description of Artificial Sequence: Synthetic polynucleotide
gacatccagatgacccagtctccatcctccctgtctgcatctgcaggagacagagtcaccatcacttgccggacaagtcagaatattagcaactatttaaattggtatcagcagaaaccaggaaaagcccctaagctcctgatctatgttgcgtccagtttcccaagtggggtcccatcaaggttcagtggcagtggatctgggacagagttcactctcaccatcagcagtctgcaacctgaagattttgcaacttactactgtcaacagagtaactttttcccgctcactttcggcggagggaccaaggtggagatcata

SEQ ID NO: 25078 - protein, 107 aa, Artificial Sequence
  Description of Artificial Sequence: Synthetic polypeptide
DIQMTQSPSSLSASAGDRVTITCRTSQNISNYLNWYQQKPGKAPKLLIYVASSFPSGVPSRFSGSGSGTEFTLTISSLQPEDFATYYCQQSNFFPLTFGGGTKVEII

SEQ ID NO: 25079 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcgggacattagcaattatttagcctggtttcagcagaaaccagggaaagcccctaagtccctgatctctactgcatccagtttgcaaagtggggtcccatcaaagttcagtggcagtggatctgggacagatttcactctcaccatcagcagcctgcagcctgaagattttgcaatttattactgccaacagtatcatagttacccattcactttcggccctgggaccaaagtggatatccaa

SEQ ID NO: 25080 - protein, 107 aa, Artificial Sequence
  Description of Artificial Sequence: Synthetic polypeptide
DIQMTQSPSSLSASVGDRVTITCRASRDISNYLAWFQQKPGKAPKSLISTASSLQSGVPSKFSGSGSGTDFTLTISSLQPEDFAIYYCQQYHSYPFTFGPGTKVDIQ

SEQ ID NO: 25081 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttggaaagtggggtcccatcaaggttcagcggcagtggatctgggacagaattcactctcacagtcagcagcctgcagcctgaagattttgcaacttattactgtctacatcataataattacctccccatcaccttcggccaagggacacgactggagattaaa

SEQ ID NO: 25082 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASSLESGVPSRFSGSGSGTEFTLTVSSLQPEDFATYYCLHHNNYLPITFGQGTRLEIK

SEQ ID NO: 25083 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcataccattaccagctatttaaattggtatcagcagaaaccagggaaagcccctaagttcctgatctatgctacatccaatctccaaagtggggtcccatcaaggttcagtggcagtggatctgggacagatttcacttttaccatcagcagtctgcaacctgaagattttgcaatttactactgtcaacagagttacaacttcccgctcactttcggcggagggaccaaggtggagatcaaa

SEQ ID NO: 25084 - protein, 107 aa, Artificial Sequence
  Description of Artificial Sequence: Synthetic polypeptide
DIQMTQSPSSLSASVGDRVTITCRASHTITSYLNWYQQKPGKAPKFLIYATSNLQSGVPSRFSGSGSGTDFTFTISSLQPEDFAIYYCQQSYNFPLTFGGGTKVEIK

SEQ ID NO: 25085 - DNA, 318 bp, Artificial Sequence
  Description of Artificial Sequence: Synthetic polynucleotide
tcctatgagctgactcagccaccctcagtgtccgtgtccccaggacagacagtcagcatcacctgctctggagataaattgggggataaatatgcttgctggtatcagcagaagccaggccagtcccctgtgctggtcatctatcaagatagcaagcggccctcagggacccctgagcgattctctggctccaactctgggaacacagccactctgaccatcagcgggacccaggctatggatgaggctgactattactgtcaggcgtgggacaacaacactgtggtattcggcggagggaccaagctgaccgtccta

SEQ ID NO: 25086 - protein, 106 aa, Artificial Sequence
  Description of Artificial Sequence: Synthetic polypeptide
SYELTQPPSVSVSPGQTVSITCSGDKLGDKYACWYQQKPGQSPVLVIYQDSKRPSGTPERFSGSNSGNTATLTISGTQAMDEADYYCQAWDNNTVVFGGGTKLTVL

SEQ ID NO: 25087 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattggggaataaatatgcttactggtatcagcagaagccaggccagtcccctgtgttggtcatctatcaagatagaaagaggccctcagggatccctgagcgattctctggctccaactctgggaacacagccactctgaccatcagcgggacccaggctatggatgaggctgacttttactgtcaggcgtgggacaacagcactgtggtattcggcggagggaccaggctgaccgtccta

SEQ ID NO: 25088 - protein, 106 aa, Artificial Sequence
  Description of Artificial Sequence: Synthetic polypeptide
SYELTQPPSVSVSPGQTASITCSGDKLGNKYAYWYQQKPGQSPVLVIYQDRKRPSGIPERFSGSNSGNTATLTISGTQAMDEADFYCQAWDNSTVVFGGGTRLTVL

SEQ ID NO: 25089 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacgttggtggttataactctgtctcctggtaccaacagcacccagacaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaaggagcagcactgtggtattcggcggagggaccaagctgaccgtccta

SEQ ID NO: 25090 - protein, 110 aa, Artificial Sequence
  Description of Artificial Sequence: Synthetic polypeptide
QSALTQPASVSGSPGQSITISCTGTSSDVGGYNSVSWYQQHPDKAPKLMIYEVSNRPSGVSNRFSGSKSGNTASLTISGLQAEDEADYYCSSYTRSSTVVFGGGTKLTVL

SEQ ID NO: 25091 - DNA, 339 bp, Artificial Sequence
  Description of Artificial Sequence: Synthetic polynucleotide
gacatcgtgatgacccagtctccagactccctggctgtgtctctgggcgagagggccaccatcacctgcaagtccagccagagtgttttacacagctccaacaataacaactacttagcttggtaccagcagaaaccaggacagcctcctaagctactcatttactgggcatctacccggaaatccggggtccctgaccgattcagtggcagcgggtctgggacagatttcactctcaccatcagcagcctgcaggctgaagatgtggcagtttatttctgtcagcaatattatagtactccgtgcagttttggccaggggaccaagctggagatcaaa

SEQ ID NO: 25092 - protein, 113 aa, Artificial Sequence
  Description of Artificial Sequence: Synthetic polypeptide
DIVMTQSPDSLAVSLGERATITCKSSQSVLHSSNNNNYLAWYQQKPGQPPKLLIYWASTRKSGVPDRFSGSGSGTDFTLTISSLQAEDVAVYFCQQYYSTPCSFGQGTKLEIK

SEQ ID NO: 25093 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggagaaatatgcttgctggtatcagcagaagccaggccagtcccctgtgttggtcatctatcaagatagaaagcggccctcagggatccctgagcgatactctggctccaacactgggaacacagccactctgaccatcagcgggacccaggctatggatgaggctgactattactgtcaggcgtgggacagcagcactgcggtattcggcggagggaccaagctgaccgtccta

SEQ ID NO: 25094 - protein, 106 aa, Artificial Sequence
  Description of Artificial Sequence: Synthetic polypeptide
SYELTQPPSVSVSPGQTASITCSGDKLGEKYACWYQQKPGQSPVLVIYQDRKRPSGIPERYSGSNTGNTATLTISGTQAMDEADYYCQAWDSSTAVFGGGTKLTVL

SEQ ID NO: 25095 - DNA, 321 bp, Artificial Sequence
  Description of Artificial Sequence: Synthetic polynucleotide
gacatccagatgacccagtctccatcctcactgtctacatctgtaggagacagagtcaccatcacttgtcgggcgagtcaggacattagcaattatttagcctggtttcagcagaaaccagggaaagcccctaagcgcctgatctatgctgcatccactttgcaaagtggggtcccatcaaagttcagcggcagtggatctgggacagatttcactctcaccatcagcagcctgcagcctgaagattttgcaacttattactgccaacagtataatagttacccattcactttcggccctgggaccaaagtggatctcaag

SEQ ID NO: 25096 - protein, 107 aa, Artificial Sequence
  Description of Artificial Sequence: Synthetic polypeptide
DIQMTQSPSSLSTSVGDRVTITCRASQDISNYLAWFQQKPGKAPKRLIYAASTLQSGVPSKFSGSGSGTDFTLTISSLQPEDFATYYCQQYNSYPFTFGPGTKVDLK

SEQ ID NO: 25097 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattaccaagtggttagcctggtatcagcagaaaccagggaaagcccctaaagtcctgatctatgctgcatccagtttgcaaagtcgggtcccatcaaggttcagcggcagtagatctgggacagatttcactctcaccatcagcagcctgcagcctgaagattttgcaacttactattgtcaacaggctaacagtttcccattcactttcggccctgggaccaaagtggatatcaaa

SEQ ID NO: 25098 - protein, 107 aa, Artificial Sequence
  Description of Artificial Sequence: Synthetic polypeptide
DIQMTQSPSSVSASVGDRVTITCRASQGITKWLAWYQQKPGKAPKVLIYAASSLQSRVPSRFSGSRSGTDFTLTISSLQPEDFATYYCQQANSFPFTFGPGTKVDIK

SEQ ID NO: 25099 - DNA, 318 bp, Artificial Sequence
  Description of Artificial Sequence: Synthetic polynucleotide
tcctatgaactgactcagccaccctcagtgtccgtgtccccaggacagacagccagcatcacctgctctggagaaaaattgggggataaatatgtttgttggtatcagcagaagccaggccagtcccctgtggtggtcatctatcaagatagcaagcggccctcagggatccctgagcgattctctggctccaactctgggaacacagccactctgaccatcagcgggacccaggctatggatgaggctgactattactgtcaggcgtggaacagcagcaatgtggtattcggcggagggaccaagctgaccgtccta

SEQ ID NO: 25100 - protein, 106 aa, Artificial Sequence
  Description of Artificial Sequence: Synthetic polypeptide
SYELTQPPSVSVSPGQTASITCSGEKLGDKYVCWYQQKPGQSPVVVIYQDSKRPSGIPERFSGSNSGNTATLTISGTQAMDEADYYCQAWNSSNVVFGGGTKLTVL

SEQ ID NO: 25101 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtattttattcagctccaacaataacaactacttagcttggtaccagcagaaaccaggacaacctcctaagttgctcatttactgggcatctacccgggaatccggggtccctgaccgattcagtggcagcgggtctgggacagatttcactctcaccatcagcagcctgcaggctgaagatgtggcagtttatttctgtcagcaatattctagtactccgtggacgttcggccaagggaccaaggtggaaatcaaa

SEQ ID NO: 25102 - protein, 113 aa, Artificial Sequence
  Description of Artificial Sequence: Synthetic polypeptide
DIVMTQSPDSLAVSLGERATINCKSSQSILFSSNNNNYLAWYQQKPGQPPKLLIYWASTRESGVPDRFSGSGSGTDFTLTISSLQAEDVAVYFCQQYSSTPWTFGQGTKVEIK

SEQ ID NO: 25103 - DNA, 339 bp, Artificial Sequence
  Description of Artificial Sequence: Synthetic polynucleotide
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaactgggactctggggtcccagacagattcagcggcagtgggtcaggcactgatttcacactgaaaatcagctgggtggaggctgaggatgttggggtttgttactgcatgcaaggtgcacactggcctccgatcaccttcggccaagggacacgactggagattaaa

SEQ ID NO: 25104 - protein, 113 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNWDSGVPDRFSGSGSGTDFTLKISWVEAEDVGVCYCMQGAHWPPITFGQGTRLEIK

SEQ ID NO: 25105 - DNA, 339 bp, Artificial Sequence
  Description of Artificial Sequence: Synthetic polynucleotide
gacatcgtgatgacccagtctccagactccctgactgtgtctctgggcgagagggccaccatcaactgcaagtccagccagagtgttttatacagctccaacaataagaactacttagcttggtaccagcagaaacctggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtgcagttttggccaggggaccaggctggagatcaaa

SEQ ID NO: 25106 - protein, 113 aa, Artificial Sequence
  Description of Artificial Sequence: Synthetic polypeptide
DIVMTQSPDSLTVSLGERATINCKSSQSVLYSSNNKNYLAWYQQKPGQPPKLLIYWASTRESGVPDRFSGSGSGTDFTLTISSLQAEDVAVYYCQQYYSTPCSFGQGTRLEIK

SEQ ID NO: 25107 - DNA, 339 bp, Artificial Sequence
  Description of Artificial Sequence: Synthetic polynucleotide
gacatcgtgctgacccagtctccagacttcctggctatgtctctgggcgagagggccaccatcaactgcaagtccagccagagtgttttataccactccaacaattacaactacttagcttggtaccagcagaaaccaaaacagcctcctaagctgctcatttactgggcatctacccgggagtccggggtccctgaccgattcagtggcagcgggtctgggacatatttcactctcaccatcagcagcctccaggctgaagatgtggcagtttattactgtcagcaatattacagtactccgtgcagttttggccaggggaccaacctggagatcaaa

SEQ ID NO: 25108 - protein, 113 aa, Artificial Sequence
  Description of Artificial Sequence: Synthetic polypeptide
DIVLTQSPDFLAMSLGERATINCKSSQSVLYHSNNYNYLAWYQQKPKQPPKLLIYWASTRESGVPDRFSGSGSGTYFTLTISSLQAEDVAVYYCQQYYSTPCSFGQGTNLEIK

SEQ ID NO: 25109 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagacttcactctcactatcagcagcctgcaggctgaagatgtggcagtttattactgtcagcaatattatagtagtccgtgcagttttggccaggggaccaggctggagatcaaa

SEQ ID NO: 25110 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSSPCSFGQGTRLEIK

SEQ ID NO: 25111 - DNA, 321 bp, Artificial Sequence; identical to SEQ ID NO: 24659
  Description of Artificial Sequence: Synthetic polynucleotide

SEQ ID NO: 25112 - protein, 107 aa, Artificial Sequence; identical to SEQ ID NO: 24660
  Description of Artificial Sequence: Synthetic polypeptide

SEQ ID NO: 25113 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaattacaactacttagcttggtaccagctgaaaccaggacagcctcctaagctgctcatttactgggcatctacccggaaatccggggtccctgaccgattcagtggcagcgggtctgggacagatttcactctcaccatcagcagcctgcagactgaagatgtggcactttattactgtcaacaatattatacttctccgtgcagttttggccaggggaccaagctggagatcaaa

SEQ ID NO: 25114 - protein, 113 aa, Artificial Sequence
  Description of Artificial Sequence: Synthetic polypeptide
DIVMTQSPDSLAVSLGERATINCKSSQSVLYSSNNYNYLAWYQLKPGQPPKLLIYWASTRKSGVPDRFSGSGSGTDFTLTISSLQTEDVALYYCQQYYTSPCSFGQGTKLEIK

SEQ ID NO: 25115 - DNA, 339 bp, Artificial Sequence
  Description of Artificial Sequence: Synthetic polynucleotide
gacatcgtgatgacccagtcgccagactccctggctgtgtctctgggcgagagggccaccatcaactgcaagtccagccagagtgttttacacagctccaacaataagaactacttagcttggtatcagcagaaaccaggacagcctcctaagctgctcatttactgggcatctacccgggaatccggggtccctgaccgcttcagtggcagcgggtctgggacagatttcactctcgccatcagcagcctgcaggctgaagatgtggcactttatcactgtcagcaatattatagttctccgtgcagttttggccaggggaccgggctggagatcaaa

SEQ ID NO: 25116 - protein, 113 aa, Artificial Sequence
  Description of Artificial Sequence: Synthetic polypeptide
DIVMTQSPDSLAVSLGERATINCKSSQSVLHSSNNKNYLAWYQQKPGQPPKLLIYWASTRESGVPDRFSGSGSGTDFTLAISSLQAEDVALYHCQQYYSSPCSFGQGTGLEIK

SEQ ID NO: 25117 - DNA, 321 bp, Artificial Sequence
  Description of Artificial Sequence: Synthetic polynucleotide
gacatccagatgacccagtctccatcctcactgtctgcatctataggagacagagtcaccatcacttgtcgggcgagtcagggcattagcaattatttagcctggtttcagcagaaaccagggaaagcccctaggtccctgatctatgctgcatccagtttacaaagtggggtcccatcaacgttcagcggcagtggatctgggacagatttcactctcaccatcagcagcctgcagcctgaagattttgcaacttattactgccaacagtataatagttatccattcactttcggccctgggaccaaagtggatatcaaa

SEQ ID NO: 25118 - protein, 107 aa, Artificial Sequence
  Description of Artificial Sequence: Synthetic polypeptide
DIQMTQSPSSLSASIGDRVTITCRASQGISNYLAWFQQKPGKAPRSLIYAASSLQSGVPSTFSGSGSGTDFTLTISSLQPEDFATYYCQQYNSYPFTFGPGTKVDIK

SEQ ID NO: 25119 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacatgagaagtgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcatactatttcccctcctactttcggcggagggaccaaggtggagatcaaa

SEQ ID NO: 25120 - protein, 107 aa, Artificial Sequence
  Description of Artificial Sequence: Synthetic polypeptide
DIQMTQSPSSLSASVGDRVTITCRASQDMRSDLGWYQQKPGKAPKRLIYAASSLQSGVPSRFSGSGSGTEFTLTISSLQPEDFATYYCLQHTISPPTFGGGTKVEIK

SEQ ID NO: 25121 - DNA, 333 bp, Artificial Sequence
  Description of Artificial Sequence: Synthetic polynucleotide
gatgttgtgatgactcagtctccactctccctgtccgtcacccttggacagccggcctccatctcctgcaggtcaagtcaaagcctcgtatacagtgatggaaacacctacttgaattggtttcagcagaggccaggccaatctccaaggcgcctaatttataaggtttctaactgggactctggggtcccagacagattcagcggcagtgggtcaggcacagatttcacactgaaaatcagcagggtggaggctgaggatgttggggtttattactgcatgcaaggtatacactggctcactttcggcggagggaccaaggtggagatcaaa

SEQ ID NO: 25122 - protein, 111 aa, Artificial Sequence
  Description of Artificial Sequence: Synthetic polypeptide
DVVMTQSPLSLSVTLGQPASISCRSSQSLVYSDGNTYLNWFQQRPGQSPRRLIYKVSNWDSGVPDRFSGSGSGTDFTLKISRVEAEDVGVYYCMQGIHWLTFGGGTKVEIK

SEQ ID NO: 25123 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattagcaattatttggcctggtttcagcagaaaccagggaaagcccctacgtccctgatctatgctgcatctagtttgcaaagtggggtcccatcaaagttcagcggcagtggatctgggacagatttcactctcaccatcagcagcctgcagcctgaagattttgcaactttttactgccaacagtatcatagttacccgctcaccttcggccaagggacacgactggaaattaaa

SEQ ID NO: 25124 - protein, 107 aa, Artificial Sequence
  Description of Artificial Sequence: Synthetic polypeptide
DIQMTQSPSSLSASVGDRVTITCRASQDISNYLAWFQQKPGKAPTSLIYAASSLQSGVPSKFSGSGSGTDFTLTISSLQPEDFATFYCQQYHSYPLTFGQGTRLEIK

SEQ ID NO: 25125 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaagtgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttatttctgtctacagcatactatttaccctcctactttcggcggagggaccaaggtggagatcaaa

SEQ ID NO: 25126 - protein, 107 aa, Artificial Sequence
  Description of Artificial Sequence: Synthetic polypeptide
DIQMTQSPSSLSASVGDRVTITCRASQDIRSDLGWYQQKPGKAPKRLIYAASSLQSGVPSRFSGSGSGTEFTLTISSLQPEDFATYFCLQHTIYPPTFGGGTKVEIK

SEQ ID NO: 25127 - DNA, 321 bp, Artificial Sequence
  Description of Artificial Sequence: Synthetic polynucleotide
gacgtccagatgacccagtctccatcctccctgtctgcatctttaggagacagagtcaccatcacttgccgggcaagtcagagcattagaagctatttaaattggtatcagcagaaaccagggaaagcccctaacctcctgatctatagtgcatccagtttgcaaagtggggtcccatcaaggttcagtggcagtggatctgggacagatttcactctcaccatcagcagtctgcaacctgaagattttgcaaattactactgtcaacagagttacagtatcccgatcaccttcggccaagggacacgactggagattaaa

SEQ ID NO: 25128 - protein, 107 aa, Artificial Sequence
  Description of Artificial Sequence: Synthetic polypeptide
DVQMTQSPSSLSASLGDRVTITCRASQSIRSYLNWYQQKPGKAPNLLIYSASSLQSGVPSRFSGSGSGTDFTLTISSLQPEDFANYYCQQSYSIPITFGQGTRLEIK

SEQ ID NO: 25129 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaattacaactacttagcttggtaccagctgaaaccaggacagcctcctaagctgctcatttactgggcatctacccggaaatccggggtccctgaccgattcagtggcagcgggtctgggacagatttcactctcaccatcagcagcctgcagactgaagatgtggcactttattactgtcagcaatattatacttctccgtgcagttttggccaggggaccaagctggagatcaaa

SEQ ID NO: 25130 - protein, 113 aa, Artificial Sequence; identical to SEQ ID NO: 25114
  Description of Artificial Sequence: Synthetic polypeptide

SEQ ID NO: 25131 - DNA, 321 bp, Artificial Sequence
  Description of Artificial Sequence: Synthetic polynucleotide
gacatccagatgacccagtctccatcctccctgtccgcatctgtaggagacagagtcaccatcacttgccgggcaagtcaggacattagaagtgatttaggctggtatcagcagaaaccagggaaagcccctaagcgcctgatctatgctacatccagtttgcaaagtggggtcccatcaaggttcagcggcagtggatctgggacagaattcactctcacaatcagcagcctgcagcctgaagattttgcaacttattactgtctacagcatactatttaccctcctactttcggcggagggaccaaggtggagatcaaa

SEQ ID NO: 25132 - protein, 107 aa, Artificial Sequence
  Description of Artificial Sequence: Synthetic polypeptide
DIQMTQSPSSLSASVGDRVTITCRASQDIRSDLGWYQQKPGKAPKRLIYATSSLQSGVPSRFSGSGSGTEFTLTISSLQPEDFATYYCLQHTIYPPTFGGGTKVEIK

SEQ ID NO: 25133 - DNA, 345 bp, Artificial Sequence
  Description of Artificial Sequence: Synthetic polynucleotide
ctgcctgtgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctgggggtgaccgctacctcaccttctccaacctccagtctgacgatgaggatgagtatcactgtggagagagccacccgattgatggccaagtcggtgtggtattcggcggagggaccaagctgaccgtccta

SEQ ID NO: 25134 - protein, 115 aa, Artificial Sequence
  Description of Artificial Sequence: Synthetic polypeptide
LPVLTQPPSASALLGASIKLTCTLSSEHSTYTIEWYQQRPGRSPQYIMKVKSDGSHSKGDGIPDRFMGSSSGGDRYLTFSNLQSDDEDEYHCGESHPIDGQVGVVFGGGTKLTVL

SEQ ID NO: 25135 - DNA, 321 bp, Artificial Sequence; identical to SEQ ID NO: 24753
  Description of Artificial Sequence: Synthetic polynucleotide

SEQ ID NO: 25136 - protein, 107 aa, Artificial Sequence; identical to SEQ ID NO: 24754
  Description of Artificial Sequence: Synthetic polypeptide

SEQ ID NO: 25137 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacaacataatagttacccgctcactttcggcggagggaccaaggtggcgatcaaa

SEQ ID NO: 25138 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVAIK

SEQ ID NO: 25139 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaatcagggaaagcccctaagtctctgatctctgctgcaaccagtttgcaaagtggggtcccatcacagttcagcggcagtggatctgggacagatttcactctcaccatcagcagcctgcagcctgaagattttgcaacttattactgccaacagtattatagttacccgatcaccttcggccaagggacacgactggagattaaa

SEQ ID NO: 25140 - protein, 107 aa, Artificial Sequence
  Description of Artificial Sequence: Synthetic polypeptide
DIQMTQSPSSLSASVGDRVTITCRASQGISNYLAWFQQKSGKAPKSLISAATSLQSGVPSQFSGSGSGTDFTLTISSLQPEDFATYYCQQYYSYPITFGQGTRLEIK

SEQ ID NO: 25141 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagatggttagcctggtatcagcagaaaccagggagagcccctgaactcctgatctatgctgcatcccgtttgcaaagtgggatcccatccaggttcagcggcagtggatctgggacagacttcactctcaccatcagcagcctgcagcctgaagattttgcaacttactattgtcaacaggctaacagtttcccattcactttcggccctgggaccaaagtggataacaaa

SEQ ID NO: 25142 - protein, 107 aa, Artificial Sequence
  Description of Artificial Sequence: Synthetic polypeptide
DIQMTQSPSSVSASVGDRVTITCRASQGISRWLAWYQQKPGRAPELLIYAASRLQSGIPSRFSGSGSGTDFTLTISSLQPEDFATYYCQQANSFPFTFGPGTKVDNK

SEQ ID NO: 25143 - DNA, 318 bp, Artificial Sequence
  Description of Artificial Sequence: Synthetic polynucleotide
tcctatgagctgactcagccaccctcagtgtccgtgtccccaggacagacagtcagcatcacctgctctggagataaattgggggataaatatgcttgctggtatcagcagaagccaggccagtcccctgtgctggtcatctatcaagatcgcaagcggccctcagggatccctgagcgattctctggctccaactctgggaacacagccactctgaccatcagcgggacccaggctatggatgaggctgactattactgtcaggcgtgggacaacaacactgtggtattcggcggagggaccaagctgaccgtccta

SEQ ID NO: 25144 - protein, 106 aa, Artificial Sequence
  Description of Artificial Sequence: Synthetic polypeptide
SYELTQPPSVSVSPGQTVSITCSGDKLGDKYACWYQQKPGQSPVLVIYQDRKRPSGIPERFSGSNSGNTATLTISGTQAMDEADYYCQAWDNNTVVFGGGTKLTVL

SEQ ID NO: 25145 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaattatttaggctggtttcagcagaaaccagggaaagcccctaagcgcctgatctatggtgcatccagtttgcaaagtggggtcccatcaaggatcagcggcagtggatctgggacagaattcactctcacaatcagcagcctgcagcctgaagattttgcaacttattactgtctacagtatcatagttatctattcactttcggccctgggaccaaagtggatatcaaa

SEQ ID NO: 25146 - protein, 107 aa, Artificial Sequence
  Description of Artificial Sequence: Synthetic polypeptide
DIQMTQSPSSLSASVGDRVTITCRASQGIRNYLGWFQQKPGKAPKRLIYGASSLQSGVPSRISGSGSGTEFTLTISSLQPEDFATYYCLQYHSYLFTFGPGTKVDIK

SEQ ID NO: 25147 - DNA, 315 bp, Artificial Sequence
  Description of Artificial Sequence: Synthetic polynucleotide
tcctatgagctgactcagccaccctcagtgtccgtgtccccaggacagacagccagcatcacctgctctggagataaattgggggaaaaatatgcttgctggtatcagcagaagccaggccagtcccctgtactggtcatctatcaagataagaagcggccctcagggatccctgagcgattctctggctccaactctgggaacacagccactctgaccatcagcgggacccaggctatggatgaggctgactattactgtcaggcgtgggacagcagcactgtattcggcggagggaccaaactgaccgtccta

SEQ ID NO: 25148 - protein, 105 aa, Artificial Sequence
  Description of Artificial Sequence: Synthetic polypeptide
SYELTQPPSVSVSPGQTASITCSGDKLGEKYACWYQQKPGQSPVLVIYQDKKRPSGIPERFSGSNSGNTATLTISGTQAMDEADYYCQAWDSSTVFGGGTKLTVL

SEQ ID NO: 25149 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacataagtaattatttagcctggtttcagcagaaaccagggaaagcccctaagtccctgatctatgctacacccagtttgcagagtggggtcccatcaaagttcagcggcagtggatctgggacagagttcactctcaccatcagcagcctgcagcctgaagattttgcaacttattactgccaacagtataatagttacccgctcactttcggcggagggaccaaggtggagatcaaa

SEQ ID NO: 25150 - protein, 107 aa, Artificial Sequence
  Description of Artificial Sequence: Synthetic polypeptide
DIQMTQSPSSLSASVGDRVTITCRASQDISNYLAWFQQKPGKAPKSLIYATPSLQSGVPSKFSGSGSGTEFTLTISSLQPEDFATYYCQQYNSYPLTFGGGTKVEIK

SEQ ID NO: 25151 - DNA, 321 bp, Artificial Sequence
  Description of Artificial Sequence: Synthetic polynucleotide
gacatccagttgacccagtctccatcctcactgtctgcatctgtcggagacagagtcaccatcacttgtcgggcgagtcagggcattaacaattatttagcctggtttcagcagaaaccagggaaagcccctaagtccctgatttatgctgcatccagtttgcaaagtggggtcccatcaaggttcagcggcagtggatttgggacagatttcactctcaccatcagcagcctgcagcctgaagattttgcaactttttactgccagcaatataatagttacccattcacttttggccctgggaccaaagtggataacaaa

SEQ ID NO: 25152 - protein, 107 aa, Artificial Sequence
  Description of Artificial Sequence: Synthetic polypeptide
DIQLTQSPSSLSASVGDRVTITCRASQGINNYLAWFQQKPGKAPKSLIYAASSLQSGVPSRFSGSGFGTDFTLTISSLQPEDFATFYCQQYNSYPFTFGPGTKVDNK

SEQ ID NO: 25153 - DNA, 321 bp, Artificial Sequence
  Description of Artificial Sequence: Synthetic polynucleotide
gacatccagatgacccagtctccatcctcactgtctgcatctgtaggggacagagtcaccatcacttgtcgggcgagtcagggcattgccaattatttagcctggtttcagcagagaccagggaaagcccctaagtccctgatctctgctgcatccagtttgcaaagtggggtcccatcaaagttcagcggcagtggatctgggacagagttcactctcaccatcagcagcctgcagcctgaagattttgcaacttattactgccaacagtatcatagttacccgctcactttcggcggagggtccaaggtggagatcaaa

SEQ ID NO: 25154 - protein, 107 aa, Artificial Sequence
  Description of Artificial Sequence: Synthetic polypeptide
DIQMTQSPSSLSASVGDRVTITCRASQGIANYLAWFQQRPGKAPKSLISAASSLQSGVPSKFSGSGSGTEFTLTISSLQPEDFATYYCQQYHSYPLTFGGGSKVEIK

SEQ ID NO: 25155 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctacatccagtttgcaaagtggggtcccatcaaggttcagcggcagtggatctgggacagaattcactctcacaatcagcagcctgcagcctgaggattttgcaacttattactgtctacagtattatagttacccgctcactttcggcggagggaccgaggtggagatcaaa

SEQ ID NO: 25156 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYATSSLQSGVPSRFSGSGSGTEFTLTISSLQPEDFATYYCLQYYSYPLTFGGGTEVEIK

SEQ ID NO: 25157 - DNA, 327 bp, Artificial Sequence
  Description of Artificial Sequence: Synthetic polynucleotide
gacatccagatgacccagtctccatcctccctgtctgcatctgtgggagacagagtcaccatcacttgccgggcaagtcagaacatttacagctatttaaattggtatcagcagaaacctgggaaagcccctaagctcctgatctatgctgcatccagtttgcaaagtggggttccatcaaggttcagtggcagtggatctgggacagaattcactctcaccatcagcattctgcaacctgaagattttgcaacttactactgtcaacagagttacaatacccctccggagtgcaattttggccaggggaccaagctggagatcaaa

SEQ ID NO: 25158 - protein, 109 aa, Artificial Sequence
  Description of Artificial Sequence: Synthetic polypeptide
DIQMTQSPSSLSASVGDRVTITCRASQNIYSYLNWYQQKPGKAPKLLIYAASSLQSGVPSRFSGSGSGTEFTLTISILQPEDFATYYCQQSYNTPPECNFGQGTKLEIK

SEQ ID NO: 25159 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattaggagtgatttaggctggtttcagcagaaaccagggaaagcccctaagcgcctgatctttgatgcatccagtgtgcaaagtggggtcccatcaaggttcagcggcagtggatctgggacagaattcactctcacaatcagcagcctgcagcctgaagattttgcaatttattactgtctacaacattatacttacccgctcactttcggcggagggaccaaggtggagatcaag

SEQ ID NO: 25160 - protein, 107 aa, Artificial Sequence
  Description of Artificial Sequence: Synthetic polypeptide
DIQMTQSPSSLSASVGDRVTITCRASQGIRSDLGWFQQKPGKAPKRLIFDASSVQSGVPSRFSGSGSGTEFTLTISSLQPEDFAIYYCLQHYTYPLTFGGGTKVEIK

SEQ ID NO: 25161 - DNA, 318 bp, Artificial Sequence; identical to SEQ ID NO: 24745
  Description of Artificial Sequence: Synthetic polynucleotide

SEQ ID NO: 25162 - protein, 106 aa, Artificial Sequence; identical to SEQ ID NO: 24746
  Description of Artificial Sequence: Synthetic polypeptide

SEQ ID NO: 25163 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtattttacacagctccaacaataacaactacttagcttggttccagcagaaaccaggacagcctcctaaactgctcctttactgggcatctacccgggaatccggggtccctgaccgattcagtggcagcgggtctgggacagatttcactctcaccatcagcagcctgcagcctgaagatgtggcagtttattactgtcagcaatattataatactccagtcactttcggccctgggaccaaagtgggtatcaaa

SEQ ID NO: 25164 - protein, 113 aa, Artificial Sequence
  Description of Artificial Sequence: Synthetic polypeptide
DIVMTQSPDSLAVSLGERATINCKSSQSILHSSNNNNYLAWFQQKPGQPPKLLLYWASTRESGVPDRFSGSGSGTDFTLTISSLQPEDVAVYYCQQYYNTPVTFGPGTKVGIK

SEQ ID NO: 25165 - DNA, 339 bp, Artificial Sequence; identical to SEQ ID NO: 25163
  Description of Artificial Sequence: Synthetic polynucleotide

SEQ ID NO: 25166 - protein, 113 aa, Artificial Sequence; identical to SEQ ID NO: 25164
  Description of Artificial Sequence: Synthetic polypeptide

SEQ ID NO: 25167 - DNA, 318 bp, Artificial Sequence; identical to SEQ ID NO: 24781
  Description of Artificial Sequence: Synthetic polynucleotide

SEQ ID NO: 25168 - protein, 106 aa, Artificial Sequence; identical to SEQ ID NO: 24782
  Description of Artificial Sequence: Synthetic polypeptide

SEQ ID NO: 25169 - DNA, 336 bp, Artificial Sequence
  Description of Artificial Sequence: Synthetic polynucleotide
gatgttgtgatgactcagtctccactctccctgcccgtcacccttggacagccggcctccatctcctgcaggtctagtcaaagcctcatatacagtgatggaaacaccttcttgaattggtttcagcagaggccaggccaatctccaaggcgcctaatttataaggtttctaattgggactctggggtcccagacagattcagcggcagtgggtcaggcactgatttcacactgaaaatcagcaggttggaggctgaggatgttgggatttattactgcatgcaaggtacacactggcctctcaccttcggccaagggacacgactggagattaaa

SEQ ID NO: 25170 - protein, 112 aa, Artificial Sequence
  Description of Artificial Sequence: Synthetic polypeptide
DVVMTQSPLSLPVTLGQPASISCRSSQSLIYSDGNTFLNWFQQRPGQSPRRLIYKVSNWDSGVPDRFSGSGSGTDFTLKISRLEAEDVGIYYCMQGTHWPLTFGQGTRLEIK

SEQ ID NO: 25171 - DNA, 339 bp, Artificial Sequence
  Description of Artificial Sequence: Synthetic polynucleotide
gacatcgtgatgacccagtctccagactccctggctgtgtctctgggcgagagggccaccatcaattgcaagtccagccagagtgttttacacagctccaacaattataactacttagcttggtaccagcagaaaccaggacagcctcctaacctgctcattttctgggcatctacccgggaatccggggtccctgaccgattcagtggcagcgggtttgggacagatttcactctcaacatcagcagcctgcaggctgaagatgtggcagtttattactgtcagcaatattatgatactccattcactttcggccctgggaccaaagtggatatcaaa

SEQ ID NO: 25172 - protein, 113 aa, Artificial Sequence
  Description of Artificial Sequence: Synthetic polypeptide
DIVMTQSPDSLAVSLGERATINCKSSQSVLHSSNNYNYLAWYQQKPGQPPNLLIFWASTRESGVPDRFSGSGFGTDFTLNISSLQAEDVAVYYCQQYYDTPFTFGPGTKVDIK

SEQ ID NO: 25173 - DNA, 339 bp, Artificial Sequence; identical to SEQ ID NO: 24515
  Description of Artificial Sequence: Synthetic polynucleotide

SEQ ID NO: 25174 - protein, 113 aa, Artificial Sequence; identical to SEQ ID NO: 24516
  Description of Artificial Sequence: Synthetic polypeptide

SEQ ID NO: 25175 - DNA, 321 bp, Artificial Sequence; identical to SEQ ID NO: 24907
  Description of Artificial Sequence: Synthetic polynucleotide

SEQ ID NO: 25176 - protein, 107 aa, Artificial Sequence; identical to SEQ ID NO: 24908
  Description of Artificial Sequence: Synthetic polypeptide

SEQ ID NO: 25177 - DNA, 321 bp, Artificial Sequence
  Description of Artificial Sequence: Synthetic polynucleotide
gacatccagatgacccagtctccatcttccgtgtctgcatctgtgggagacagagtcaccatcacttgtcgggcgagtcagggtattagcaaatggttagcctggtatcagcagaaaccagggaaagcccctaagatcctgatatatgctgcatatagtttacaaagtggggtcccagcaaggttcagcggcagtggatctgggacagatttcactctcaccatcaggagcctgcagcctgaagattttgcaacttactattgtcaacaggctaacagtttcccattcactttcggccctgggaccaaagtggatatcaaa

SEQ ID NO: 25178 - protein, 107 aa, Artificial Sequence
  Description of Artificial Sequence: Synthetic polypeptide
DIQMTQSPSSVSASVGDRVTITCRASQGISKWLAWYQQKPGKAPKILIYAAYSLQSGVPARFSGSGSGTDFTLTIRSLQPEDFATYYCQQANSFPFTFGPGTKVDIK

SEQ ID NO: 25179 - DNA, 321 bp, Artificial Sequence
  Description of Artificial Sequence: Synthetic polynucleotide
gacatccagatgacccagtctccatcttccgtgtctgcatctgtaagagacagagtcaccatcacttgtcgggcgagtcagggtattagcagctggttagcctggtatcagcagaaaccaggggaagcccctaagctcctgatctatgctgcatccaggttgcaaagtggggtcccatcaaggttcagcggcagtggatctgggacagatttcactctcaccatcagcagcctgcagcctgaagattttgcaacttactattgtcaacaggctaacagtttcccattcactttcggccctgggaccaaagtggatatcaaa

SEQ ID NO: 25180 - protein, 107 aa, Artificial Sequence
  Description of Artificial Sequence: Synthetic polypeptide
DIQMTQSPSSVSASVRDRVTITCRASQGISSWLAWYQQKPGEAPKLLIYAASRLQSGVPSRFSGSGSGTDFTLTISSLQPEDFATYYCQQANSFPFTFGPGTKVDIK

SEQ ID NO: 25181 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagactgttttattcagctccaacaataaccactacttagcatggtaccagcagaaaccaggacaacctcctaacctcctcatttactgggcatctacccgggcatccggggtccctgaccgattcagtggcagcgggtctgggacagatttcactctcaccatcagcagcctgcaggctgaagatgtggcagtttattactgtcagcaatattatagtagtccgtggacgttcggccaagggaccaaggtggaaatcaaa

SEQ ID NO: 25182 - protein, 113 aa, Artificial Sequence
  Description of Artificial Sequence: Synthetic polypeptide
DIVMTQSPDSLAVSLGERATINCKSSQTVLFSSNNNHYLAWYQQKPGQPPNLLIYWASTRASGVPDRFSGSGSGTDFTLTISSLQAEDVAVYYCQQYYSSPWTFGQGTKVEIK

SEQ ID NO: 25183 - DNA, 321 bp, Artificial Sequence
  Description of Artificial Sequence: Synthetic polynucleotide
gacatccagatgacccagtctccttcctccctgtctgcatctataggagacagagtcaccatcacttgccgggcaagtcagggcattagaaatgatttaggctggtatcagcagaaaccagggaaagcccctaagcgcctgatttatgctgcatccagtttgcaaagtggggtcccatcaaggttcagcggcagtggatctgggacagaattcactctcacaatcagcagcctgcagcctgaagattttgcaacttattactgtctacaacattatagttaccctcgcagttttggccaggggaccaagctggagatcaaa

SEQ ID NO: 25184 - protein, 107 aa, Artificial Sequence
  Description of Artificial Sequence: Synthetic polypeptide
DIQMTQSPSSLSASIGDRVTITCRASQGIRNDLGWYQQKPGKAPKRLIYAASSLQSGVPSRFSGSGSGTEFTLTISSLQPEDFATYYCLQHYSYPRSFGQGTKLEIK

SEQ ID NO: 25185 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggccattagaaatgatttaggctggtatcagcagagaccagggaaagcccctaagcgcctgatctatgctgcatccagtttgcaaagtggggtcccatcaaggttcagcggcagtggatctgggacagaatttattctcacaatcagcagcctgcagcctgaagattttgcaacttattactgtttacagcattataattaccctcgcagttttggccaggggaccaagctggagatcaaa

SEQ ID NO: 25186 - protein, 107 aa, Artificial Sequence
  Description of Artificial Sequence: Synthetic polypeptide
DIQMTQSPSSLSASVGDRVTITCRASQAIRNDLGWYQQRPGKAPKRLIYAASSLQSGVPSRFSGSGSGTEFILTISSLQPEDFATYYCLQHYNYPRSFGQGTKLEIK

SEQ ID NO: 25187 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacatttacagctatttaaattggtatcagcagaaaccagggagagcccctaaactcgtgatctattctacatccagtttgcaaagtggggtcccatcaaggttcagtggcagtggatctgggacagatttcagtctcaccatcagcaatctgcaacctgaagatttttcaacttactactgtcaacagagttacagtccccctctcactttcggcggagggaccaaggtggagatcaga

SEQ ID NO: 25188 - protein, 107 aa, Artificial Sequence
  Description of Artificial Sequence: Synthetic polypeptide
DIQMTQSPSSLSASVGDRVTITCRASQNIYSYLNWYQQKPGRAPKLVIYSTSSLQSGVPSRFSGSGSGTDFSLTISNLQPEDFSTYYCQQSYSPPLTFGGGTKVEIR

SEQ ID NO: 25189 - DNA, 321 bp, Artificial Sequence
  Description of Artificial Sequence: Synthetic polynucleotide
gacatccagatgacccagtctccatcctccctgtctacatctgtaggagacagagtcaccatcacttgccgggcaagtcagaacattatcagctatttaaattggtatcagcagaaaccagggaaagcccctaagctcctgatgtatgttgcatcccgtttgcaaagtggggtcccatcaaggttcagtggcagtggatctgggacagatttcactctcaccatcagcagtctgcaagctgaagattttgcaacttactactgtcaacagagttacagtaccccgtacactttcggcggagggaccaaggtggcgatcaaa

SEQ ID NO: 25190 - protein, 107 aa, Artificial Sequence
  Description of Artificial Sequence: Synthetic polypeptide
DIQMTQSPSSLSTSVGDRVTITCRASQNIISYLNWYQQKPGKAPKLLMYVASRLQSGVPSRFSGSGSGTDFTLTISSLQAEDFATYYCQQSYSTPYTFGGGTKVAIK

SEQ ID NO: 25191 - DNA, 339 bp, Artificial Sequence
  Description of Artificial Sequence: Synthetic polynucleotide
gacatcgtgatgacccagtctccagactccctggctgtgtctctgggcgagagggccaccatcaattgcaagtccagccagagtgttttacacaactccaacaattataactatttagcttggtaccagcagaaaccaggacagcctcctaacctgctcattttctgggcatctacccgggaatccggggtccctgaccgattcagtggcagcgggtttgggacagatttcactctcaacatcagcagcctgcaggctgaagatgtggcagtttattactgtcagcaatattatgatactccattcactttcggccatgggaccaaagtggatatcaaa

SEQ ID NO: 25192 - protein, 113 aa, Artificial Sequence
  Description of Artificial Sequence: Synthetic polypeptide
DIVMTQSPDSLAVSLGERATINCKSSQSVLHNSNNYNYLAWYQQKPGQPPNLLIFWASTRESGVPDRFSGSGFGTDFTLNISSLQAEDVAVYYCQQYYDTPFTFGHGTKVDIK

SEQ ID NO: 25193 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagaagaaaccagggaaagcccctaagcgcctgatcaatgctgcatccagtttgcaaagtggggtcccatcaaggttcagcggcagtggatctgggacagaattcactctcacaatcagcagcctgcagcctgaagattttgcaacttattactgtctacagcataatagttacccattcactttcggccctgggaccaaagtggatatcaaa

SEQ ID NO: 25194 - protein, 107 aa, Artificial Sequence
  Description of Artificial Sequence: Synthetic polypeptide
DIQMTQSPSSLSASVGDRVTITCRASQGIRNDLGWYQKKPGKAPKRLINAASSLQSGVPSRFSGSGSGTEFTLTISSLQPEDFATYYCLQHNSYPFTFGPGTKVDIK

SEQ ID NO: 25195 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcgactggttagcctggtatcagcagaaaccagggaaagcccctaggctcctgatctatgctgcatccagtttgcaaagtggggtcccatcaaggttcagcggcagtggatctgggacagatttcactctcaccatcagcaacctgcagcctgaagattttgcaacttactattgtcaacagactaacagtttcccgtggacgttcggccaagggaccaaggtggaaatcaaa

SEQ ID NO: 25196 - protein, 107 aa, Artificial Sequence
  Description of Artificial Sequence: Synthetic polypeptide
DIQMTQSPSSVSASVGDRVTITCRASQGISDWLAWYQQKPGKAPRLLIYAASSLQSGVPSRFSGSGSGTDFTLTISNLQPEDFATYYCQQTNSFPWTFGQGTKVEIK

SEQ ID NO: 25197 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctctcactttcggcggagggaccaaggtggggatcaca

SEQ ID NO: 25198 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVGIT

SEQ ID NO: 25199 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattaacaattatttagcctggtttcagcagaaaccagggaaagcccctaagtccctgatcaatgctgcatccagtttgcaaagtggggtcccatcaaggttcagcggcagtggatctgggacagatttcactctcgccatcagcagcctacagcctgaagattttgcaacttattactgccaacagtattatagttacccattcactttcggccctgggaccaaagtggatatcaaa

SEQ ID NO: 25200 - protein, 107 aa, Artificial Sequence
  Description of Artificial Sequence: Synthetic polypeptide
DIQMTQSPSSLSASVGDRVTITCRASQGINNYLAWFQQKPGKAPKSLINAASSLQSGVPSRFSGSGSGTDFTLAISSLQPEDFATYYCQQYYSYPFTFGPGTKVDIK

SEQ ID NO: 25201 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattatcaactggttagcctggtatcaacagaaaccagggaaagcccctaagctcctgatctatgctgcatccagtttgcaaagtggggtcccatcaaggttcagcggcagtggatctgggacagatttcactctcaccatcagcaacctgcagcctgaagattttgcaacttactattgtcaacagactaacagtttcccgtggacgttcggccaagggaccaaggtggaaatcaaa

SEQ ID NO: 25202 - protein, 107 aa, Artificial Sequence
  Description of Artificial Sequence: Synthetic polypeptide
DIQMTQSPSSVSASVGDRVTITCRASQGIINWLAWYQQKPGKAPKLLIYAASSLQSGVPSRFSGSGSGTDFTLTISNLQPEDFATYYCQQTNSFPWTFGQGTKVEIK

SEQ ID NO: 25203 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatggtgcatccaatttgcaaagtggggtcccatcaaggttcagcggcagtggatctgggacagaattcactctcacagtcagcagcctgcagcctgaagattttgcaacttatttctgtctacagcatactagtttcccattcactttcggccctgggaccaaagtggatatcaaa

SEQ ID NO: 25204 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYGASNLQSGVPSRFSGSGSGTEFTLTVSSLQPEDFATYFCLQHTSFPFTFGPGTKVDIK

SEQ ID NO: 25205 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttaatgacctccaacgataagaactacttaacttggtaccagcagagaccaggacagcctcctaagctgctcatttactgggcttctacccgggaatccggggtccctgaccgattcagtggcggcgggtctgggacagatttcactctcaccatcagcggcctgcaggctgaagatgtggcagtttattactgtcagcaatattatagtactcctccgacgttcggccaagggaccaaggtggaaatcaag

SEQ ID NO: 25206 - protein, 113 aa, Artificial Sequence
  Description of Artificial Sequence: Synthetic polypeptide
DIVMTQSPDSLAVSLGERATINCKSSQSVLMTSNDKNYLTWYQQRPGQPPKLLIYWASTRESGVPDRFSGGGSGTDFTLTISGLQAEDVAVYYCQQYYSTPPTFGQGTKVEIK

SEQ ID NO: 25207 - DNA, 321 bp, Artificial Sequence
  Description of Artificial Sequence: Synthetic polynucleotide
gacatccagatgaaccagtctccatcttccgtgtctgcatctgtaggagacagagtcaccatcacttgtcgggcgagtcagggtattagcaactggttagcctggtatcagcagaaaccagggagagcccctaagctcctgatctatgctgcatccagtttgcaaagtggggtcccttcaaggttcagcggcagtggatctgggacagatttcactctcaccatcagcaacctgcagcctgaagattttgcaacttactattgtcaacagactaacagtttcccgtggacgttcggccaagggaccaaggtggaaatcaaa

SEQ ID NO: 25208 - protein, 107 aa, Artificial Sequence
  Description of Artificial Sequence: Synthetic polypeptide
DIQMNQSPSSVSASVGDRVTITCRASQGISNWLAWYQQKPGRAPKLLIYAASSLQSGVPSRFSGSGSGTDFTLTISNLQPEDFATYYCQQTNSFPWTFGQGTKVEIK

SEQ ID NO: 25209 - DNA, 321 bp, Artificial Sequence
  Description of Artificial Sequence: Synthetic polynucleotide
gacatccaaatgacccagtctccatcctccctgtctgcatctgtaggagacagagtcaccatcacttgccgggcaagtcagggcattagaaatgatttaggctggcatcagcagaaaccagggaaagcccctaagcgcctgatctatgctgcatccagtttgcaaagtggggtcccatcaaggttcagcggcagtggatctgggacagaattcactctctcaatcagcagcctgcagcctgaagattttgcaacttattactgtctacagcataatagtttcccattcactttcggccctgggaccaaagtggatatcaaa

SEQ ID NO: 25210 - protein, 107 aa, Artificial Sequence
  Description of Artificial Sequence: Synthetic polypeptide
DIQMTQSPSSLSASVGDRVTITCRASQGIRNDLGWHQQKPGKAPKRLIYAASSLQSGVPSRFSGSGSGTEFTLSISSLQPEDFATYYCLQHNSFPFTFGPGTKVDIK

SEQ ID NO: 25211 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcaggatattagcagctggttagcctggtatcagaagaaaccagggaaagcccctaaactcctgatctatgatgcatccagtttgcaaagtggggtcccatcaaggttcagcggcagtggatctgggacagatttcattctcaccatcagcagcctgcagcctgaagattttgcaacttacttttgtcaacaggctaacagtctcccattcactttcggccctgggaccaaagtggatatcaaa

SEQ ID NO: 25212 - protein, 107 aa, Artificial Sequence
  Description of Artificial Sequence: Synthetic polypeptide
DIQMTQSPSSVSASVGDRVTITCRASQDISSWLAWYQKKPGKAPKLLIYDASSLQSGVPSRFSGSGSGTDFILTISSLQPEDFATYFCQQANSLPFTFGPGTKVDIK

SEQ ID NO: 25213 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcacagtgatggaaggacctatttgtattggtaccttcagaagccaggccagcctccgcagctcctgatctatgaagtttccaaccggttctctggagtgccagataggttcagtggcagcgggtcagggacagacttcacactgaaaatcagccgggtggaggctgaggatgttggggtttattactgtatgcaaagtatacagcttccgtggacgttcggccaagggaccaaggtggaaatcaaa

SEQ ID NO: 25214 - protein, 112 aa, Artificial Sequence
  Description of Artificial Sequence: Synthetic polypeptide
DIVMTQTPLSLSVTPGQPASISCKSSQSLLHSDGRTYLYWYLQKPGQPPQLLIYEVSNRFSGVPDRFSGSGSGTDFTLKISRVEAEDVGVYYCMQSIQLPWTFGQGTKVEIK

SEQ ID NO: 25215 - DNA, 321 bp, Artificial Sequence
  Description of Artificial Sequence: Synthetic polynucleotide
gacatccagatgacccagtctccttcctccctgtctgcatctgtaggagacagagtcaccatcacttgccgggcaagtcagggcattagaaatgatttaggctggtatcaacagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctactgcattataattaccctcggacgttcggccaagggaccaaagtggaaatcaag

SEQ ID NO: 25216 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLLHYNYPRTFGQGTKVEIK

SEQ ID NO: 25217 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcggtggatctgggacagaattcactctcacaatcagcagcctgcagcctgaagattttgcgacttattactgtctacagcatagtagttaccctctcactttcggcggagggaccaaggtggagatcaag

SEQ ID NO: 25218 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGGGSGTEFTLTISSLQPEDFATYYCLQHSSYPLTFGGGTKVEIK

SEQ ID NO: 25219 - DNA, 321 bp, Artificial Sequence
  Description of Artificial Sequence: Synthetic polynucleotide
gacatccagatgacccagtctccatcctccctgtctgcatctgtgggagacagagtcaccttcacttgccgggcaagtcagggcattagagatgatttaggctggtatcagcagaaaccagggaaagcccctaagcgcctgatctatgctgcatccagtttgcaaagtggggtcccatcaaggttcagcggcagtagatctgggagagaattcactctcacaatcagcagcctgcaacctgaagattttgcaacttattactgtctacagcattatagttaccctcggacgttcggccaagggaccaaggtggaaatcaaa

SEQ ID NO: 25220 - protein, 107 aa, Artificial Sequence
  Description of Artificial Sequence: Synthetic polypeptide
DIQMTQSPSSLSASVGDRVTFTCRASQGIRDDLGWYQQKPGKAPKRLIYAASSLQSGVPSRFSGSRSGREFTLTISSLQPEDFATYYCLQHYSYPRTFGQGTKVEIK

SEQ ID NO: 25221 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcgactggttagcctggtatcagcagaaaccagggaaagcccctaagctcctgatttatgctgcatccagtttacaaagtggagtcccatcaaggttcagcggcagtggatttgggacagatttcactctcaccatcagcagcctgcagcctgaagattttgcaacttactattgtcaacaggctaacagtttcccattcactttcggccctgggaccaaagtggatatcaaa

SEQ ID NO: 25222 - protein, 107 aa, Artificial Sequence
  Description of Artificial Sequence: Synthetic polypeptide
DIQMTQSPSSVSASVGDRVTITCRASQGISDWLAWYQQKPGKAPKLLIYAASSLQSGVPSRFSGSGFGTDFTLTISSLQPEDFATYYCQQANSFPFTFGPGTKVDIK

SEQ ID NO: 25223 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaaagatttaggctggtatcagcagaaaccagggaaagcccctaagcgcctgatctatgctgcatccactttggaaagtggggtcccatcaaggttcagcggcagtggatctgggacagaattcactctcacaatcagcagcctgcagcctgaagattttgcaacttattactgtctacagcattatagtttcccgtggacgttcggccaagggaccaaggtggaaatcaaa

SEQ ID NO: 25224 - protein, 107 aa, Artificial Sequence
  Description of Artificial Sequence: Synthetic polypeptide
DIQMTQSPSSLSASVGDRVTITCRASQDIRKDLGWYQQKPGKAPKRLIYAASTLESGVPSRFSGSGSGTEFTLTISSLQPEDFATYYCLQHYSFPWTFGQGTKVEIK

SEQ ID NO: 25225 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagtggaagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtttattactgtcagcagtatggtagttcaccgtggacgttcggccaagggaccaaggtggaaatcaaa

SEQ ID NO: 25226 - protein, 108 aa, Artificial Sequence
  Description of Artificial Sequence: Synthetic polypeptide
EIVLTQSPGTLSLSPGERATLSCRASQSVSGSYLAWYQQKPGQAPRLLIYGASSRATGIPDRFSGSGSGTDFTLTISRLEPEDFAVYYCQQYGSSPWTFGQGTKVEIK

SEQ ID NO: 25227 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccaatttgcaaagtggggtcccatcaaggttcagcggcagtagatctgggacagaattcactctcacaatcagcagcctgcagcctgaagattttgcaacttattactgtctacagcataatagttacccattcactttcggccctgggaccaaagtggatatcaaa

SEQ ID NO: 25228 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASNLQSGVPSRFSGSRSGTEFTLTISSLQPEDFATYYCLQHNSYPFTFGPGTKVDIK

SEQ ID NO: 25229 - DNA, 321 bp, Artificial Sequence
  Description of Artificial Sequence: Synthetic polynucleotide
gacgtccagatgacccagtctccatcctccctgtctgcatctgtaggagacagagtcaccatcacttgccgggcaagtcagggcattagaaatgatttaggctggtatcagcagaaaccagggaaagcccctaagcgcctcatctatgctgcatccagtttgcaaagtggggtcccatcaaggttcagcggcagtggatctgggacagaattcactctcacaatcagcagcctgcagcctgaagattttgcaacttattactgtctccaccattataattaccctcggacgttcggccaagggaccaaggtggaaatcaca

SEQ ID NO: 25230 - protein, 107 aa, Artificial Sequence
  Description of Artificial Sequence: Synthetic polypeptide
DVQMTQSPSSLSASVGDRVTITCRASQGIRNDLGWYQQKPGKAPKRLIYAASSLQSGVPSRFSGSGSGTEFTLTISSLQPEDFATYYCLHHYNYPRTFGQGTKVEIT

SEQ ID NO: 25231 - DNA, 336 bp, Artificial Sequence
  Description of Artificial Sequence: Synthetic polynucleotide
catattgtgatgacccagactccactctctctgtccgtcacccctggacagccggcctccatctcctgcaagtctagtcagagcctcctgcatagtgagggaaggacctatttgtattggtacctgcagaagccaggccagcctccacagctcctgatctatgaaatttcccaccggttctctggagtgccagatagattcagtggcagcgggtcagggacagatttcacactgaaaatcagccgggtggaggctgaggatgttggggtttattactgcatgcaaagtatccaccttccgttcactttcggcggagggaccaaggtggagatcaaa

SEQ ID NO: 25232 - protein, 112 aa, Artificial Sequence
  Description of Artificial Sequence: Synthetic polypeptide
HIVMTQTPLSLSVTPGQPASISCKSSQSLLHSEGRTYLYWYLQKPGQPPQLLIYEISHRFSGVPDRFSGSGSGTDFTLKISRVEAEDVGVYYCMQSIHLPFTFGGGTKVEIK

SEQ ID NO: 25233 - DNA, 321 bp, Artificial Sequence
  Description of Artificial Sequence: Synthetic polynucleotide
gacatccagatgacccagtctccatcctccctgtctgcatctgtaggagacagagtcaccttcacttgccgggcaagtcagggcattagagatgatttaggctggtatcagcagaaaccagggaaagcccctaagcgcctgatctatgctacatccagtttgcaaagtggggtcccatcaaggttcagcggcagtggatctgggacagaattcactctcacaatcagcagcctgcagcctgaagattttgcaacttattactgtctacagcattatagttaccctcggacgttcggccaagggaccaaggtggaaatcaaa

SEQ ID NO: 25234 - protein, 107 aa, Artificial Sequence
  Description of Artificial Sequence: Synthetic polypeptide
DIQMTQSPSSLSASVGDRVTFTCRASQGIRDDLGWYQQKPGKAPKRLIYATSSLQSGVPSRFSGSGSGTEFTLTISSLQPEDFATYYCLQHYSYPRTFGQGTKVEIK

SEQ ID NO: 25235 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcgactggttagcctggtatcaacagaaaccagggaaagcccctaggctcctgatctatgctgcatccagtttgcaaagtggggtcccatcaaaattcagcggcagtggatctgggacagatttcactctcaccatcagcaacctgcagcctgaagattttgcaacttactattgtcaacagactaacagtttcccgtggacgttcggccaagggaccaaggtggaaatcaaa

SEQ ID NO: 25236 - protein, 107 aa, Artificial Sequence
  Description of Artificial Sequence: Synthetic polypeptide
DIQMTQSPSSVSASVGDRVTITCRASQGISDWLAWYQQKPGKAPRLLIYAASSLQSGVPSKFSGSGSGTDFTLTISNLQPEDFATYYCQQTNSFPWTFGQGTKVEIK

SEQ ID NO: 25237 - DNA, 336 bp, Artificial Sequence
  Description of Artificial Sequence: Synthetic polynucleotide
gatattgtgatgactcagtctccactctccctgcccgtcacccctggagagccggcctccatctcctgcaggtctagtcagagcctcctgcatagtaatggatacagctatttggagtggtacctgcagaagccaggacagtctccacaactcctgatctatttgggttctaatcgggcctccggggtccctgacaggttcagtggcagtggatcaggcacagattttacactgaaaatcagcagagtagaggctgaggatgttggggtttattactgcatgcaaactctacaaactccattcactttcggccctgggaccaaagtggatatcaaa

SEQ ID NO: 25238 - protein, 112 aa, Artificial Sequence
  Description of Artificial Sequence: Synthetic polypeptide
DIVMTQSPLSLPVTPGEPASISCRSSQSLLHSNGYSYLEWYLQKPGQSPQLLIYLGSNRASGVPDRFSGSGSGTDFTLKISRVEAEDVGVYYCMQTLQTPFTFGPGTKVDIK

SEQ ID NO: 25239 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaactggttagcctggtatcagcagaaaccagggaaagcccctaagctcctgatctctgctgcattcagtttgcaaagtggggtcccatcaaggttcagcggcagtggatctgggacagatttcactctcagcatcagcagcctgcagcctgaagattttgcaacttactattgtcaacagtctaacagtttcccgtggacgttcggccaagggaccaaggtggaaatcaaa

SEQ ID NO: 25240 - protein, 107 aa, Artificial Sequence
  Description of Artificial Sequence: Synthetic polypeptide
DIQMTQSPSSVSASVGDRVTITCRASQGISNWLAWYQQKPGKAPKLLISAAFSLQSGVPSRFSGSGSGTDFTLSISSLQPEDFATYYCQQSNSFPWTFGQGTKVEIK

SEQ ID NO: 25241 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacaacataatagttacccgctcactttcggcggagggaccaaggtggagatcaaa

SEQ ID NO: 25242 - protein, 107 aa, Artificial Sequence
  Description of Artificial Sequence: Synthetic polypeptide
DIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGGGTKVEIK

SEQ ID NO: 25243 - DNA, 321 bp, Artificial Sequence; identical to SEQ ID NO: 25203
  Description of Artificial Sequence: Synthetic polynucleotide

SEQ ID NO: 25244 - protein, 107 aa, Artificial Sequence; identical to SEQ ID NO: 25204
  Description of Artificial Sequence: Synthetic polypeptide

SEQ ID NO: 25245 - DNA, 321 bp, Artificial Sequence
  Description of Artificial Sequence: Synthetic polynucleotide
gacatccagatgacccagtctccatcctccctgtctgcatctgtaggagacagagtcaccttcacttgccgggcaagtcagggcattagagatgatttaggctggtatcaacagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcattatagttaccctcggacgttcggccaagggaccaaggtggaaatcaaa

SEQ ID NO: 25246 - protein, 107 aa, Artificial Sequence
  Description of Artificial Sequence: Synthetic polypeptide
DIQMTQSPSSLSASVGDRVTFTCRASQGIRDDLGWYQQKPGKAPKRLIYAASSLQSGVPSRFSGSGSGTEFTLTISSLQPEDFATYYCLQHYSYPRTFGQGTKVEIK

SEQ ID NO: 25247 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcaggatattagcagctggttagcctggtatcagaagaaaccagggaaagcccctaagtacctgatctatgatgcatccagtttgcaaagtggggtcccatcaaggttcagcggcagtggatctgggacagatttcattctcaccatcagcagcctgcagcctgaagattttgcaatttacttttgtcaacaggctaacagtctccctttcactttcggccctgggaccaaagtggatatcaaa

SEQ ID NO: 25248 - protein, 107 aa, Artificial Sequence
  Description of Artificial Sequence: Synthetic polypeptide
DIQMTQSPSSVSASVGDRVTITCRASQDISSWLAWYQKKPGKAPKYLIYDASSLQSGVPSRFSGSGSGTDFILTISSLQPEDFAIYFCQQANSLPFTFGPGTKVDIK

SEQ ID NO: 25249 - DNA, 321 bp, Artificial Sequence
  Description of Artificial Sequence: Synthetic polynucleotide
gacatccagatgacccagtctccatcctccctgtctgcatctgtaggagacagagtcaccttcacttgccgggcaagtcaggacattagagatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcattataattaccctcggacgttcggccaagggaccaaggtggaaatcaaa

SEQ ID NO: 25250 - protein, 107 aa, Artificial Sequence
  Description of Artificial Sequence: Synthetic polypeptide
DIQMTQSPSSLSASVGDRVTFTCRASQDIRDDLGWYQQKPGKAPKRLIYAASSLQSGVPSRFSGSGSGTEFTLTISSLQPEDFATYYCLQHYNYPRTFGQGTKVEIK

SEQ ID NO: 25251 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcgactggttagcctggtatcagcagaaaccagggaaagcccctaggctcctgatctatggtgcatccagtttgcaaagtggggtcccatcaaggttcagcggcagtggatctgggacagatttcactctcaccatcagcaacctgcagcctgaagattttgcaacttactattgtcaacagactaacagtttcccgtggacgttcggccaagggaccaaggtggaaatcaaa

SEQ ID NO: 25252 - protein, 107 aa, Artificial Sequence
  Description of Artificial Sequence: Synthetic polypeptide
DIQMTQSPSSVSASVGDRVTITCRASQGISDWLAWYQQKPGKAPRLLIYGASSLQSGVPSRFSGSGSGTDFTLTISNLQPEDFATYYCQQTNSFPWTFGQGTKVEIK

SEQ ID NO: 25253 - DNA, 321 bp, Artificial Sequence
  Description of Artificial Sequence: Synthetic polynucleotide
gacatccagatgacccagtctccatcttccgtgtctgtttctgtaggagacagagtcaccatcacttgtcgggcgagtcaggatattagcgactggttagcttggtatcagcagagaccagggaaagcccctaagctcttgatctatgctgcatccagtttggaaagtggggtcccatcaaggttcagcggcagtggatctgggacagatttcactctcaccatcagcagcctgcagcctgaagattttgcaacttactattgtcaacaggctaacagtttcccattcactttcggccctgggaccaaagtggatatcaaa

SEQ ID NO: 25254 - protein, 107 aa, Artificial Sequence
  Description of Artificial Sequence: Synthetic polypeptide
DIQMTQSPSSVSVSVGDRVTITCRASQDISDWLAWYQQRPGKAPKLLIYAASSLESGVPSRFSGSGSGTDFTLTISSLQPEDFATYYCQQANSFPFTFGPGTKVDIK

SEQ ID NO: 25255 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattaacaattatttagcctggtttcagcagaaaccagggaaagcccctaagtccctgatcaatgctgcatccagtttgcaaagtggggtcccatcaaggttcagcggcagtggatctgggacagatttcactctcgccatcagcagcctacagcctgaagattttgcaacttattactgccaacactattatagttacccattcactttcggccgtgggaccaaagtggatatcaaa

SEQ ID NO: 25256 - protein, 107 aa, Artificial Sequence
  Description of Artificial Sequence: Synthetic polypeptide
DIQMTQSPSSLSASVGDRVTITCRASQGINNYLAWFQQKPGKAPKSLINAASSLQSGVPSRFSGSGSGTDFTLAISSLQPEDFATYYCQHYYSYPFTFGRGTKVDIK

SEQ ID NO: 25257 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaggtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 25258 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQGGVPSRFSGSGSGTEFTLTISSLQPEDFATYYCLQHNSYPLTFGGGTKVEIK

SEQ ID NO: 25259 - DNA, 336 bp, Artificial Sequence
  Description of Artificial Sequence: Synthetic polynucleotide
gatatcgtgatgacccagactccactctctctgaccgtcacccctggacagccggcctccatctcctgcaagtctagtcagagcctcctgcatggtgatggaaagacatatttgtattggtacctgcagaagccaggccagcctccacaggtcctgatctatgaagtttccaatcggttctctggagtgccagataggttcagtggcagcgggtcagggacagatttcacactgaaactcagccgggtggaggctgaggatgttggggtttattactgcatgcaaagtatacagcttccgtggacgttcggccaagggaccaaggtggaaatcaaa

SEQ ID NO: 25260 - protein, 112 aa, Artificial Sequence
  Description of Artificial Sequence: Synthetic polypeptide
DIVMTQTPLSLTVTPGQPASISCKSSQSLLHGDGKTYLYWYLQKPGQPPQVLIYEVSNRFSGVPDRFSGSGSGTDFTLKLSRVEAEDVGVYYCMQSIQLPWTFGQGTKVEIK

SEQ ID NO: 25261 - DNA, 321 bp, Artificial Sequence
  Description of Artificial Sequence: Synthetic polynucleotide
gacatccagatgacccagtctccatcctccctgtctgcatctgtaggagacagagtcaccttcacttgccgggcaagtcagggcattagagatgatttaggctggtatcagcagaaaccagggaaagcccctaagcgcctgatctatgctgcatccagtttgcaaagtggggtcccatcaaggttcagcggcagtagatctgggacagaattcactctcacaatcagcagcctgcaacctgaagattttgcaacttattactgtctacagcattatagttaccctcggacgttcggccaagggaccaaggtggaaatcaaa

SEQ ID NO: 25262 - protein, 107 aa, Artificial Sequence
  Description of Artificial Sequence: Synthetic polypeptide
DIQMTQSPSSLSASVGDRVTFTCRASQGIRDDLGWYQQKPGKAPKRLIYAASSLQSGVPSRFSGSRSGTEFTLTISSLQPEDFATYYCLQHYSYPRTFGQGTKVEIK

SEQ ID NO: 25263 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaaagatttaggctggtatcagcagaaaccagggaaagcccctaagcgcctgatctatgctgcatccagtttgcaaagtggggtcccatcaaggttcagcggcagtggatctgggacagaattcagtctcacaatcagcagcctgcagcctgaagattttgcaacttattactgtctacagcataatagttaccctctcactttcggcggagggaccaaggtggagatcaag

SEQ ID NO: 25264 - protein, 107 aa, Artificial Sequence
  Description of Artificial Sequence: Synthetic polypeptide
DIQMTQSPSSLSASVGDRVTITCRASQGIRKDLGWYQQKPGKAPKRLIYAASSLQSGVPSRFSGSGSGTEFSLTISSLQPEDFATYYCLQHNSYPLTFGGGTKVEIK

SEQ ID NO: 25265 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcaggacattagaaaagatttaggctggtatcagcagaaagtagggaaagcccctaagcgcctgatctatgctgcatccagtttggaaagtggggtcccatcaaggttcagcggcagtggatctgggacagaattcactctcacaatcagcagcctgcagcctgaagattttgcaacttattactgtctacagcattatagtttcccgtggacgttcggccaagggaccaaggtggaaatcaaa

SEQ ID NO: 25266 - protein, 107 aa, Artificial Sequence
  Description of Artificial Sequence: Synthetic polypeptide
DIQMTQSPSSLSASVGDRVTITCRTSQDIRKDLGWYQQKVGKAPKRLIYAASSLESGVPSRFSGSGSGTEFTLTISSLQPEDFATYYCLQHYSFPWTFGQGTKVEIK

SEQ ID NO: 25267 - DNA, 321 bp, Artificial Sequence
  Description of Artificial Sequence: Synthetic polynucleotide
gacatccagatgaaccagtctccatcttccgtgtctgcatctgtaggagacagagtcaacatcacttgtcgggcgagtcagggtattagcaactggttagcctggtatcagcagaaaccagggaaagtccctaagctcctgatctatgctgcatccagtttgcaaagtggggtcccatcaaggttcagcggcagtggatctgggacagatttcactctcaccatcagcaacctgcagcctgaagattttgcaacttactattgtcaacagactaacagtttcccgtggacgttcggccaagggaccaaggtggaaatcaaa

SEQ ID NO: 25268 - protein, 107 aa, Artificial Sequence
  Description of Artificial Sequence: Synthetic polypeptide
DIQMNQSPSSVSASVGDRVNITCRASQGISNWLAWYQQKPGKVPKLLIYAASSLQSGVPSRFSGSGSGTDFTLTISNLQPEDFATYYCQQTNSFPWTFGQGTKVEIK

SEQ ID NO: 25269 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctctcactttcggcggagggaccaaggtggagatcaca

SEQ ID NO: 25270 - protein, 107 aa, Artificial Sequence; identical to SEQ ID NO: 24510
  Description of Artificial Sequence: Synthetic polypeptide

SEQ ID NO: 25271 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaaagatttaggctggtatcagcagaaaccagggaaagcccctaagcgcctgatctatgctgcatccagtttgcaaagtggggtcccatcaaggttcagtggcagtggatctgggacagaattcagtctcacaatcagcagcctgcagcctgaagattttgcaacttattactgtctacagcataatagttaccctctcactttcggcggagggaccaaggtggagatcaag

SEQ ID NO: 25272 - protein, 107 aa, Artificial Sequence; identical to SEQ ID NO: 25264
  Description of Artificial Sequence: Synthetic polypeptide

SEQ ID NO: 25273 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatagtgagggaaagacctatttgtattggtacctgcagaagccaggccagcctccacagctcctgatctatgaagtttcttaccggttctctggagtgccagataggttcagtggcagcgggtcagggacagatttcacactgaaaatcagccggatggaggctgaggatgttggggtttattactgcatgcacagtatacagtatccgctcacgtttggcggagggaccaaggtggagatccaa

SEQ ID NO: 25274 - protein, 112 aa, Artificial Sequence
  Description of Artificial Sequence: Synthetic polypeptide
DIVMTQTPLSLSVTPGQPASISCKSSQSLLHSEGKTYLYWYLQKPGQPPQLLIYEVSYRFSGVPDRFSGSGSGTDFTLKISRMEAEDVGVYYCMHSIQYPLTFGGGTKVEIQ

SEQ ID NO: 25275 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacagtcagcagcctgcagcctgaagattttgcaacttatttctgtcttcagcatactagtttcccattcactttcggccctgggaccaaagtggatatcaaa

SEQ ID NO: 25276 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTVSSLQPEDFATYFCLQHTSFPFTFGPGTKVDIK

SEQ ID NO: 25277 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatttaggctggtatcagcagaaaccagggaaagcccctaagcgcctgatctatgctgcattcagtttgcaaagtggggtcccatcaaggttcagcggcagtagatctgggacagaattcactctcacaatcagcagcctgcagcctgaagattttgcaacttattactgtctgcaacataatagttacccgctcactttcggcggagggaccaaggtggagatcaaa

SEQ ID NO: 25278 - protein, 107 aa, Artificial Sequence
  Description of Artificial Sequence: Synthetic polypeptide
DIQMTQSPSSLSASVGDRVTITCRASQDIRNDLGWYQQKPGKAPKRLIYAAFSLQSGVPSRFSGSRSGTEFTLTISSLQPEDFATYYCLQHNSYPLTFGGGTKVEIK

SEQ ID NO: 25279 - DNA, 336 bp, Artificial Sequence
  Description of Artificial Sequence: Synthetic polynucleotide
gatattgtgatgacccagactccactctctctgtccgtcacccctggacagccggcctccatctcctgcacgtctagtcagagcctcctgcatagtgaaggaaagacctatttgtattggtacctccagaagccaggccagcctccacagctcctgatctatgaagtttccaaccggttctctggagtgccagataggttcagtggcagcgggtcagggacagatttcacactaaaaatcagccgggtggaggctgaggatgttggggttttttactgtatgcaaagtatacagcttccgtggacgttcggccaagggaccaaggtggaaatcaaa

SEQ ID NO: 25280 - protein, 112 aa, Artificial Sequence
  Description of Artificial Sequence: Synthetic polypeptide
DIVMTQTPLSLSVTPGQPASISCTSSQSLLHSEGKTYLYWYLQKPGQPPQLLIYEVSNRFSGVPDRFSGSGSGTDFTLKISRVEAEDVGVFYCMQSIQLPWTFGQGTKVEIK

SEQ ID NO: 25281 - DNA, 321 bp, Artificial Sequence; identical to SEQ ID NO: 24247
  Description of Artificial Sequence: Synthetic polynucleotide

SEQ ID NO: 25282 - protein, 107 aa, Artificial Sequence; identical to SEQ ID NO: 24146
  Description of Artificial Sequence: Synthetic polypeptide

SEQ ID NO: 25283 - DNA, 336 bp, Artificial Sequence
  Description of Artificial Sequence: Synthetic polynucleotide
gatattgtgatgactcagtctccactctccccgcccgtcacccctggagagccggcctccatctcctgcaggtctagtcagagcctcctgcatagtaatggatacaactatttggaatggtacctgcagaagtcagggcagtctccacagttcctgatctatttgggttttaatcgggcctccggggtccctgacaggttcactggcagtggatcaggcacagattttacactgaaaatcagcagagtggaggctgaggatgttggggtttattactgcatgcaagttctacaaactccattcactttcggccctgggaccaaagtggatatcaaa

SEQ ID NO: 25284 - protein, 112 aa, Artificial Sequence
  Description of Artificial Sequence: Synthetic polypeptide
DIVMTQSPLSPPVTPGEPASISCRSSQSLLHSNGYNYLEWYLQKSGQSPQFLIYLGFNRASGVPDRFTGSGSGTDFTLKISRVEAEDVGVYYCMQVLQTPFTFGPGTKVDIK

SEQ ID NO: 25285 - DNA, 336 bp, Artificial Sequence
  Description of Artificial Sequence: Synthetic polynucleotide
gatattgtgatgacccaaactccactctctctgtccgtcacccctggacagccggcctccatctcctgcaagtctagtcagagcctcctgcatagtgatggaaggacctatttgtattggtacctgcagaagccaggccagcctccacagctcctgatctatgaagtttccagccggttctctggagtgccagataggttcagtggcagcgggtcagggacagatttcgcactgaaaatcagccgggtggaggctgaggatgttggggtttattactgcatgcaaagtacacaacttccgtggacgttcggccaagggaccaaggcggaaatcaaa

SEQ ID NO: 25286 - protein, 112 aa, Artificial Sequence
  Description of Artificial Sequence: Synthetic polypeptide
DIVMTQTPLSLSVTPGQPASISCKSSQSLLHSDGRTYLYWYLQKPGQPPQLLIYEVSSRFSGVPDRFSGSGSGTDFALKISRVEAEDVGVYYCMQSTQLPWTFGQGTKAEIK

SEQ ID NO: 25287 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaactggttagcctggtatcagcagaaaccagggaaagcccctaagctcctgatctttgctgcctccaatttgcaaagtggggtcccatcaaggttcagcggcagtggatctgggacagatttcactctcaccatcagcagtctgcagcctgcagattttgcaacttactgttgtcaacaggttaacagtttcccgtggacgttcggccaagggaccaaggtggaaatcaaa

SEQ ID NO: 25288 - protein, 107 aa, Artificial Sequence
  Description of Artificial Sequence: Synthetic polypeptide
DIQMTQSPSSVSASVGDRVTITCRASQGISNWLAWYQQKPGKAPKLLIFAASNLQSGVPSRFSGSGSGTDFTLTISSLQPADFATYCCQQVNSFPWTFGQGTKVEIK

SEQ ID NO: 25289 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcagggcattagaaatgatttaggctggtatcagaagaaaccagggaaagcccctaagcgcctgatctatgctgcatccagtttgcaaagtggggtcccatcaaggttcagcggcagtggatctgggacagaattcactctcacagtcagcagcctgcagcctgaagattttgcaacttatttctgtctacaacatactagtttcccattcactttcggccctgggaccaaagtggatatcaaa

SEQ ID NO: 25290 - protein, 107 aa, Artificial Sequence
  Description of Artificial Sequence: Synthetic polypeptide
DIQMTQSPSSLSASVGDRVTITCRTSQGIRNDLGWYQKKPGKAPKRLIYAASSLQSGVPSRFSGSGSGTEFTLTVSSLQPEDFATYFCLQHTSFPFTFGPGTKVDIK

SEQ ID NO: 25291 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcagggcattagaaatgatttaggctggtatcagcagaaaccagggaaagcccctaagcgcctgatctatagagcatccagtttgcaaagtggggtcccagcaaggttcagcggcagtggatctgggacagaattcactcttacaatcagcagcctgcagcctgaagattttgcaatttattactgtctacagcataatttttacccgtggacgttcggccaagggaccaaggtggaaatcaaa

SEQ ID NO: 25292 - protein, 107 aa, Artificial Sequence
  Description of Artificial Sequence: Synthetic polypeptide
DIQMTQSPSSLSASVGDRVTITCRTSQGIRNDLGWYQQKPGKAPKRLIYRASSLQSGVPARFSGSGSGTEFTLTISSLQPEDFAIYYCLQHNFYPWTFGQGTKVEIK

SEQ ID NO: 25293 - DNA, 321 bp, Artificial Sequence
  Description of Artificial Sequence: Synthetic polynucleotide
gacatccagatgacccagtctccatcctccctgtctgcgtctgtaggagacagagtcaacatcacttgccgggcaagtcagagcattagcagctatttaatttggtatcagcagaaaccagggaaagcccctaagctcctgatctatgctgcatccagtttgcaaagtggggtcccatcaaggttcagtgccagtggatctgggacagatttcactctcaccatcagcagtctgcaacctgaagattttgcaagttactactgtcaacagagtaacagtattccattcactttcggccctgggaccaaagtggatatcaaa

SEQ ID NO: 25294 - protein, 107 aa, Artificial Sequence
  Description of Artificial Sequence: Synthetic polypeptide
DIQMTQSPSSLSASVGDRVNITCRASQSISSYLIWYQQKPGKAPKLLIYAASSLQSGVPSRFSASGSGTDFTLTISSLQPEDFASYYCQQSNSIPFTFGPGTKVDIK

SEQ ID NO: 25295 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcggggcattagagatgatttaggctggtatcaacagaaaccagggaaaccccctaagcgcctgatctatgctgcatccagtttgcaaagtggggtcccatcaaggttcaacggcagtggatctgggacagaattcactctcacaatcagcagcctgcagtctgaagatcttgcaacttattactgtctacagcaatatagttatcctcggacgttcggccaagggaccaaggtggaaatcaaa

SEQ ID NO: 25296 - protein, 107 aa, Artificial Sequence
  Description of Artificial Sequence: Synthetic polypeptide
DIQMTQSPSSLSASVGDRVTITCRASRGIRDDLGWYQQKPGKPPKRLIYAASSLQSGVPSRFNGSGSGTEFTLTISSLQSEDLATYYCLQQYSYPRTFGQGTKVEIK

SEQ ID NO: 25297 - DNA, 321 bp, Artificial Sequence
  Description of Artificial Sequence: Synthetic polynucleotide
gacatccagatgacccagtctccatcctccctgtctgcgtctgtaggagacagagtcaacatcacttgccgggcaagtcagagcattatcagctatttaatttggtatcagcagaaaccagggaaagcccctaggctcctgatctatgctgcatccagtttgcaaagtggggtcccatcaaggttcagtgccagtggatctgggacagatttcactctcaccatcagcagtctgcaacctgaagattttgcaagttactactgtcaacagactaacagtattccattcactttcggccctgggaccaaagtggatatcaaa

SEQ ID NO: 25298 - protein, 107 aa, Artificial Sequence
  Description of Artificial Sequence: Synthetic polypeptide
DIQMTQSPSSLSASVGDRVNITCRASQSIISYLIWYQQKPGKAPRLLIYAASSLQSGVPSRFSASGSGTDFTLTISSLQPEDFASYYCQQTNSIPFTFGPGTKVDIK

SEQ ID NO: 25299 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcaaaatattaccagctggttagcctggtatcagcagaaaccagggaaagcccctaagctcctgatctatagtgcatccagtttgcaaaatggggtcccatcaaggttcagcggcagtggatctgggacagatttcactctcaccatcagcagcctgcagcctgaagattttgtaacttactgttgtcaacaggctaacagtttcccgtggacgttcggccaagggaccaaggtggaaatcaaa

SEQ ID NO: 25300 - protein, 107 aa, Artificial Sequence
  Description of Artificial Sequence: Synthetic polypeptide
DIQMTQSPSSVSASVGDRVTITCRASQNITSWLAWYQQKPGKAPKLLIYSASSLQNGVPSRFSGSGSGTDFTLTISSLQPEDFVTYCCQQANSFPWTFGQGTKVEIK

SEQ ID NO: 25301 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatattgcatccagtttgcaaagtggggtcccatcaaggttcagcggcagtggatctgggacagaattcactctcactatcagcggcttgcagcctgaagattttgcaatttattactgtctacagcataatcgttacccgtggacgttcggccaagggaccaaggtggaaatcaaa

SEQ ID NO: 25302 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYIASSLQSGVPSRFSGSGSGTEFTLTISGLQPEDFAIYYCLQHNRYPWTFGQGTKVEIK

SEQ ID NO: 25303 - DNA, 321 bp, Artificial Sequence
  Description of Artificial Sequence: Synthetic polynucleotide
gacatccagatgacccagtctccatcctccctgtctgcgtctgtaggagacagagtcaccatcacttgccgggcaagtcagagcattaggaagtatttaaattggtatcagaagacaccagggaaagcccctaaactcttgatctatgctgcttccagtttgcaaagtggggtcccatcaaggttcagtggcagtggatctgggacagatttcactctcaccatcagcagtgtgcaacctgaagattttgcaacttactactgtcaacagacttacagtaacccactcactttcggcggagggaccaaggtggagttcaca

SEQ ID NO: 25304 - protein, 107 aa, Artificial Sequence
  Description of Artificial Sequence: Synthetic polypeptide
DIQMTQSPSSLSASVGDRVTITCRASQSIRKYLNWYQKTPGKAPKLLIYAASSLQSGVPSRFSGSGSGTDFTLTISSVQPEDFATYYCQQTYSNPLTFGGGTKVEFT

SEQ ID NO: 25305 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccactttgcaaagtggggtcccatcaaggatcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 25306 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASTLQSGVPSRISGSGSGTEFTLTISSLQPEDFATYYCLQHNSYPLTFGGGTKVEIK

SEQ ID NO: 25307 - DNA, 321 bp, Artificial Sequence
  Description of Artificial Sequence: Synthetic polynucleotide
gacatccagatgacccagtctccatcctccctgtctgcgtctgtaggagacagagtcaccatcacttgccgggcaagtcagagcattaggaagtatttaaattggtatcagaagacaccagggaaagcccctaaactcttgatctatgctgcttccagtttgcaaagtggggtcccatcaaggttcagtggcagtggatctgggacagatttcactctcaccatcagcagtctgcaacctgaagattttgcaaattattactgtcaacagacttacagtaacccgctcactttcggcggagggaccgaggtggagatcaca

SEQ ID NO: 25308 - protein, 107 aa, Artificial Sequence
  Description of Artificial Sequence: Synthetic polypeptide
DIQMTQSPSSLSASVGDRVTITCRASQSIRKYLNWYQKTPGKAPKLLIYAASSLQSGVPSRFSGSGSGTDFTLTISSLQPEDFANYYCQQTYSNPLTFGGGTEVEIT

SEQ ID NO: 25309 - DNA, 321 bp, Artificial Sequence
  Description of Artificial Sequence: Synthetic polynucleotide
gacatccagatgacccagtctccatcctccctgtctgcgtctgtaggagacagagtcaccatcacttgccgggcaagtcagagcattaggaagtatttaaattggtatcagaagacaccagggaaagcccctaaactcttgatatatgctgcttccagtttgcaaagtggggtcccatcaaggttcagtggcagtggatctgggacagatttcactctcaccatcagcagtgtgcaacctgaagattttgcaaattattactgtcaacagacttacagtaacccgctcactttcggcggagggaccgaggtggagatcaca

SEQ ID NO: 25310 - protein, 107 aa, Artificial Sequence
  Description of Artificial Sequence: Synthetic polypeptide
DIQMTQSPSSLSASVGDRVTITCRASQSIRKYLNWYQKTPGKAPKLLIYAASSLQSGVPSRFSGSGSGTDFTLTISSVQPEDFANYYCQQTYSNPLTFGGGTEVEIT

SEQ ID NO: 25311 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttagactggtatcagcagaaaccagggaaagcccctaagcgcctgatctatgctgcatccagtttgcaaagtggggtcccatcaaggttcagcggcagtggatctgggacagaattcactctcacaatcagtagcctgcagcctgaagattttgcaacttattactgtctacagcataatagttacccgctcactttcggcggagggaccaaggtggagatcaaa

SEQ ID NO: 25312 - protein, 107 aa, Artificial Sequence; identical to SEQ ID NO: 24408
  Description of Artificial Sequence: Synthetic polypeptide

SEQ ID NO: 25313 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatagggaaggaaagacctatttgtactggtacctgcagaagccaggccaggctccacagttcctgatctttgaagtttcccaccggttctctggcgtgccagataggttcagtggcagcgggtcagggacagatttcacactgaaaatcagccgggtggaggctgaggatgttggggtttattactgcatgcaaagtatacagattccgatcaccctcggccaagggacacgactggagattaaa

SEQ ID NO: 25314 - protein, 112 aa, Artificial Sequence
  Description of Artificial Sequence: Synthetic polypeptide
DIVMTQTPLSLSVTPGQPASISCKSSQSLLHREGKTYLYWYLQKPGQAPQFLIFEVSHRFSGVPDRFSGSGSGTDFTLKISRVEAEDVGVYYCMQSIQIPITLGQGTRLEIK

SEQ ID NO: 25315 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcgggatattaacggctggttagcctggtatcagcagaaaccagggaaagcccctaagctcctgatctatactgtctccagtttgcaaagtggggtcccatcaaggttcagcggcagtggatctgggacagatttcactctcaccatcagcagcctgcagcctgaagattttgcaacttactattgtcaacagtctaacagtttcccattcactttcggccctgggaccaaagtggatatcaaa

SEQ ID NO: 25316 - protein, 107 aa, Artificial Sequence
  Description of Artificial Sequence: Synthetic polypeptide
DIQMTQSPSSVSASVGDRVTITCRASRDINGWLAWYQQKPGKAPKLLIYTVSSLQSGVPSRFSGSGSGTDFTLTISSLQPEDFATYYCQQSNSFPFTFGPGTKVDIK

SEQ ID NO: 25317 - DNA, 336 bp, Artificial Sequence
  Description of Artificial Sequence: Synthetic polynucleotide
gatattgtgatgacccagactccactctctctgtccgtcacccctggacagccggcctccatgtcctgcaagtctagtcagagcctcctgcatagtgaaggaaagacctatttgtattggtacctgcagaagacaggccagcctccacacctcctgatctatgaagtttccaaccggctctctggcgtgccagataggttcagtggcagcgggtcagggacagatttcacactgaaaatcagccggatggaggctgaggatgttggggtttatttctgcatgcaaagtatgcagcttccgatcaccttcggccaggggacacgactggagattaaa

SEQ ID NO: 25318 - protein, 112 aa, Artificial Sequence
  Description of Artificial Sequence: Synthetic polypeptide
DIVMTQTPLSLSVTPGQPASMSCKSSQSLLHSEGKTYLYWYLQKTGQPPHLLIYEVSNRLSGVPDRFSGSGSGTDFTLKISRMEAEDVGVYFCMQSMQLPITFGQGTRLEIK

SEQ ID NO: 25319 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggttttagcacctggttagcctggtttcagcagaaaccagggaaagcccctaagctcctgatctatgctgcatccagtttgcaagatggggtcccatcaaggttcagcggcagtggatctgggacagatttcactctcaccatcagcagcctgcagcctgaagattttgcaacttactattgtcaacagactaacagtttcccgttcactttcggccctgggaccaaagtggatatcaaa

SEQ ID NO: 25320 - protein, 107 aa, Artificial Sequence
  Description of Artificial Sequence: Synthetic polypeptide
DIQMTQSPSSVSASVGDRVTITCRASQGFSTWLAWFQQKPGKAPKLLIYAASSLQDGVPSRFSGSGSGTDFTLTISSLQPEDFATYYCQQTNSFPFTFGPGTKVDIK

SEQ ID NO: 25321 - DNA, 321 bp, Artificial Sequence
  Description of Artificial Sequence: Synthetic polynucleotide
gacatccagatgacccagtctccatcctccctgtctgcatctgtcggagacagagtcaccatcacttgccgggcaagtcagggcattagaaatgatttaggctggtatcagcagaaaccagggaaagcccctaagcgcctgatctatgctgcatccagtttgcaaagtggtttcccatcaaggttcagcggcagtggatctgggacagaattcactctcacaatcagcagcctgcagcctgaagattttgcaacttattactgtctacagcataatagttaccctctcactttcggcggagggaccaaggtggagatcaaa

SEQ ID NO: 25322 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGFPSRFSGSGSGTEFTLTISSLQPEDFATYYCLQHNSYPLTFGGGTKVEIK

SEQ ID NO: 25323 - DNA, 336 bp, Artificial Sequence
  Description of Artificial Sequence: Synthetic polynucleotide
gatattgtgatgacccagactccactctctctgtctgtcacccctggacagccggccttcatgtcctgcaagtctagtcagatcttcttgcatagtgaaggaaagacctatttgtattggtacctgcagaagacaggccagcctccacacctcctgatctatgaagtttccaagcggctctctggcgtgccagataggttcagtggcagcgggtcagggacagatttcacactgaaaatcagccggatggaggctgaggatgtcggggtttattactgcatgcaaagtatgcagcttccgattatcttcggccaggggacacgactggagattaaa

SEQ ID NO: 25324 - protein, 112 aa, Artificial Sequence
  Description of Artificial Sequence: Synthetic polypeptide
DIVMTQTPLSLSVTPGQPAFMSCKSSQIFLHSEGKTYLYWYLQKTGQPPHLLIYEVSKRLSGVPDRFSGSGSGTDFTLKISRMEAEDVGVYYCMQSMQLPIIFGQGTRLEIK

SEQ ID NO: 25325 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctaatcagagcctcgtgcataatgaaggaaagacctatttgtattggtatttgcagaagccaggccagcctccacagctcctgatctttgaagtttccaaccggttctctggagtgccagataggttcagtggcagcgggtcagggacagatttcacactgaaaatcagtcgggtggaggctgaggatgttggggtttattactgcatgcaaagtatacagtatccgatcaccttcggccaagggacacgactggagattaaa

SEQ ID NO: 25326 - protein, 112 aa, Artificial Sequence
  Description of Artificial Sequence: Synthetic polypeptide
DIVMTQTPLSLSVTPGQPASISCKSNQSLVHNEGKTYLYWYLQKPGQPPQLLIFEVSNRFSGVPDRFSGSGSGTDFTLKISRVEAEDVGVYYCMQSIQYPITFGQGTRLEIK

SEQ ID NO: 25327 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaggtggttagcctggtatcagcagaaaccagggaaagcccctaaggtcctgatctatgctgcatccactttgcaaagtggggtcccatcaaggttcagcggcagtggatctgggacagatttcactctcaccatcagcagcctgcaacctgaagattttgcaacttactattgtcaacaggctaacagtttcccattcactttcggccctgggaccaaagtggatatcaaa

SEQ ID NO: 25328 - protein, 107 aa, Artificial Sequence
  Description of Artificial Sequence: Synthetic polypeptide
DIQMTQSPSSVSASVGDRVTITCRASQGISRWLAWYQQKPGKAPKVLIYAASTLQSGVPSRFSGSGSGTDFTLTISSLQPEDFATYYCQQANSFPFTFGPGTKVDIK

SEQ ID NO: 25329 - DNA, 321 bp, Artificial Sequence
  Description of Artificial Sequence: Synthetic polynucleotide
gacatccagatgacccagtctccatcctccctgtctgcgtctgtaggagacagagtcaccatcacttgccggtcaagtcagagcattagtacctatttaatgtggtatcagcagaaaccagggaaagcccctaagctcttgatctatgctgcatccagtttgcaaattggggtcccatcagagttcagtgccagtggatctgggacagatttcactctcaccatcagcagtctgcaacctgaagattttgcaacttactactgtcaacagagttacagtatcccattcactttcggccctgggaccaaagtggatatcaaa

SEQ ID NO: 25330 - protein, 107 aa, Artificial Sequence
  Description of Artificial Sequence: Synthetic polypeptide
DIQMTQSPSSLSASVGDRVTITCRSSQSISTYLMWYQQKPGKAPKLLIYAASSLQIGVPSEFSASGSGTDFTLTISSLQPEDFATYYCQQSYSIPFTFGPGTKVDIK

SEQ ID NO: 25331 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacagtcagcagcctgcagcctgaagattttgcaacttatttctgtctacagcatactagtttcccattcactttcggccctgggaccaaagtggatatcaaa

SEQ ID NO: 25332 - protein, 107 aa, Artificial Sequence; identical to SEQ ID NO: 25276
  Description of Artificial Sequence: Synthetic polypeptide

SEQ ID NO: 25333 - DNA, 321 bp, Artificial Sequence
  Description of Artificial Sequence: Synthetic polynucleotide
gacatccagatgacccagtctccatcctccctgtctgcgtctgtaggagacagagtcaacatcacttgccgggcaagtcagagcattagcagctatttaatttggtatcagcagaaaccagggaaagcccctaagctcctgatctatgctgcatccagtctgcaaagtggggtcccatcaaggttcagtgccagtggatctgggacagatttcactctcaccatcagcagtctgcaacctgaagattttgcaagttactactgtcaacagagtaacagtcttccattcactttcggccctgggaccaaagtggatatcaaa

SEQ ID NO: 25334 - protein, 107 aa, Artificial Sequence
  Description of Artificial Sequence: Synthetic polypeptide
DIQMTQSPSSLSASVGDRVNITCRASQSISSYLIWYQQKPGKAPKLLIYAASSLQSGVPSRFSASGSGTDFTLTISSLQPEDFASYYCQQSNSLPFTFGPGTKVDIK

SEQ ID NO: 25335 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaataatttaggctggtatcagcagaaaccagggaaagtccctaagcgcctgatctatgctgcatccagtttgcaaagtggggtcccatcaaggttcagcggcagtggatctgggacagaattcactctcacaatcagcagcctgcagcctgaagattttgcaacttattactgtctacagtataatagttacccgttcactttcggcggagggaccaaggtggagagcaaa

SEQ ID NO: 25336 - protein, 107 aa, Artificial Sequence
  Description of Artificial Sequence: Synthetic polypeptide
DIQMTQSPSSLSASVGDRVTITCRASQGIRNNLGWYQQKPGKVPKRLIYAASSLQSGVPSRFSGSGSGTEFTLTISSLQPEDFATYYCLQYNSYPFTFGGGTKVESK

SEQ ID NO: 25337 - DNA, 321 bp, Artificial Sequence
  Description of Artificial Sequence: Synthetic polynucleotide
gacatccagatgacccagtctccatcctccctgtctgcgtctgtaggagacagagtcaacatcacttgccgggcaagtcagagcatttacagctatttaatttggtatcagcagaaaccagggaaagcccctaagctcctgatctatgctgcatccagtttgcaaagtggggtcccatcaaggttcagtgccagtggatctgggacagatttcactctcaccatcagcagtctgcaacctgaagattttgcaagttactactgtcaacagagtaacagtattccattcactttcggccctgggaccaaagtggatatcaaa

SEQ ID NO: 25338 - protein, 107 aa, Artificial Sequence
  Description of Artificial Sequence: Synthetic polypeptide
DIQMTQSPSSLSASVGDRVNITCRASQSIYSYLIWYQQKPGKAPKLLIYAASSLQSGVPSRFSASGSGTDFTLTISSLQPEDFASYYCQQSNSIPFTFGPGTKVDIK

SEQ ID NO: 25339 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatactgcatccaatttacaaagtggggtcccatcaaggttcagcggcagtggatctgggacagaattcactctcacaatcagcagcctgcagcctgaagattttgcaacttattactgtctacagcataatagttacccgtggacgttcggccaagggaccaaggtggaaatcaaa

SEQ ID NO: 25340 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASNLQSGVPSRFSGSGSGTEFTLTISSLQPEDFATYYCLQHNSYPWTFGQGTKVEIK

SEQ ID NO: 25341 - DNA, 321 bp, Artificial Sequence
  Description of Artificial Sequence: Synthetic polynucleotide
gacatccagatgacccagtctccatcctccctgtctgcatctgtgggagacagagtcaccatcacttgtcgggcaagtcagagcattagtagttatttaaattggtatcagcataaaccagggaaagcccctaggctcctgatctatgctgcatccagtttgcaaagtggggtcccatcaaggttcagtggcagtgaatctgggacagatttcattctcactatcagcagtctgcaacctgaagattttacaacttattactgtcaacagagttacattgccccattcactttcggccctgggaccaaagtggatatcaaa

SEQ ID NO: 25342 - protein, 107 aa, Artificial Sequence
  Description of Artificial Sequence: Synthetic polypeptide
DIQMTQSPSSLSASVGDRVTITCRASQSISSYLNWYQHKPGKAPRLLIYAASSLQSGVPSRFSGSESGTDFILTISSLQPEDFTTYYCQQSYIAPFTFGPGTKVDIK

SEQ ID NO: 25343 - DNA, 336 bp, Artificial Sequence
  Description of Artificial Sequence: Synthetic polynucleotide
gatattgtgatgacccagactccactctctctgtccgtcacccctggacagccggcctccatgtcctgcaagtctagtcagagcctcctgcatagtgagggaaagacctatttgtattggtacctgcggaagccaggccagcctccacagttcctgatctttgaagtttccaaccggttctctggagtgccagataggttcagtggcagcgggtcagggacagaattcacactgaaaatcagccgggtggaggctgaggatgttggggtttattactgcatgcaaagtatacagcttccattcactttcggccctgggaccaaagtggatatcaaa

SEQ ID NO: 25344 - protein, 112 aa, Artificial Sequence
  Description of Artificial Sequence: Synthetic polypeptide
DIVMTQTPLSLSVTPGQPASMSCKSSQSLLHSEGKTYLYWYLRKPGQPPQFLIFEVSNRFSGVPDRFSGSGSGTEFTLKISRVEAEDVGVYYCMQSIQLPFTFGPGTKVDIK

SEQ ID NO: 25345 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcgggacattaccttctatttaaattggtatcagcagaaaccagggaaagcccctaagctcctgatctacgatgcatccaatttggaaacaggggtcccatcaaggttcagtggcagtggatctgggacagattttactttcaccatcagctgcgtgcatcctgaagatattgcaacatatttatgtcaacagtatgataatcttccattcactttcggcccagggaccacagtggatatcaaa

SEQ ID NO: 25346 - protein, 107 aa, Artificial Sequence
  Description of Artificial Sequence: Synthetic polypeptide
DIQMTQSPSSLSASVGDRVTITCQASRDITFYLNWYQQKPGKAPKLLIYDASNLETGVPSRFSGSGSGTDFTFTISCVHPEDIATYLCQQYDNLPFTFGPGTTVDIK

SEQ ID NO: 25347 - DNA, 321 bp, Artificial Sequence
  Description of Artificial Sequence: Synthetic polynucleotide
gacatccagatgacccagtctccatcctccctgtctgcatctgtgggagacagagtcaccatcacttgccgggcaagtcagggcattagaaatgatttaggctggtatcagcagaaaccagggaaagcccctcagcgcctgatctatgctgcatccagtttgcaaagtggggtcccatcaaggttcagcggcagtggatctgggacagaattcactctcacaatcagcagcctgcagcctgaggattttgcagcttattattgtctacagcataatagttacccattcactttcggccctgggaccaaagtggatatcaaa

SEQ ID NO: 25348 - protein, 107 aa, Artificial Sequence
  Description of Artificial Sequence: Synthetic polypeptide
DIQMTQSPSSLSASVGDRVTITCRASQGIRNDLGWYQQKPGKAPQRLIYAASSLQSGVPSRFSGSGSGTEFTLTISSLQPEDFAAYYCLQHNSYPFTFGPGTKVDIK

SEQ ID NO: 25349 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccaggggaagcccctaagtcccttatctatgctgcatccagtttgcgaagtggggtcccatcacagttcagcggcagtggatctggaacagatttcattctcaccatcagcagcctgcagcctgaagattttgcaacttattactgccaacagtattatagttacccattcactttcggccctgggaccaaagtggatatcaaa

SEQ ID NO: 25350 - protein, 107 aa, Artificial Sequence
  Description of Artificial Sequence: Synthetic polypeptide
DIQMTQSPSSLSASVGDRVTITCRASQGISNYLAWFQQKPGEAPKSLIYAASSLRSGVPSQFSGSGSGTDFILTISSLQPEDFATYYCQQYYSYPFTFGPGTKVDIK

SEQ ID NO: 25351 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcaggatgttaacaactacttagcctggtttcagcagaaaccagggaaagcccctaagctcctgatctatgctgcatccagtttgcaaaatggggtcccatcaaggttcagcggcagtggatctgggacagatttcactctcaccatcagcagcctgctgcctgaagattttgcaacttactattgtcaacaaactaacagtttcccattcactttcggccctgggaccaaagtggatatcaaa

SEQ ID NO: 25352 - protein, 107 aa, Artificial Sequence
  Description of Artificial Sequence: Synthetic polypeptide
DIQMTQSPSSVSASVGDRVTITCRASQDVNNYLAWFQQKPGKAPKLLIYAASSLQNGVPSRFSGSGSGTDFTLTISSLLPEDFATYYCQQTNSFPFTFGPGTKVDIK

SEQ ID NO: 25353 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcaggatattagcagttggttagcctggtatcagcagaaaccagggaaagcccctaaggtcctgatctatgctccatccaatttgcaaagtgcggtcccatcaaggttcagcggcagtggatctgggacagatttcactctcaccatcagcagcctgcagcctgaagattttgcaacttactattgtcaacaggctcacagtttcccgtggacgttcggccaagggaccaaggtggaaatcaaa

SEQ ID NO: 25354 - protein, 107 aa, Artificial Sequence
  Description of Artificial Sequence: Synthetic polypeptide
DIQMTQSPSSVSASVGDRVTITCRASQDISSWLAWYQQKPGKAPKVLIYAPSNLQSAVPSRFSGSGSGTDFTLTISSLQPEDFATYYCQQAHSFPWTFGQGTKVEIK

SEQ ID NO: 25355 - DNA, 321 bp, Artificial Sequence
  Description of Artificial Sequence: Synthetic polynucleotide
gacatccagatgacccagtctccatcttccgtgtctgcatctgtgggagacagactcaccatcacttgtcgggcgagtcagggtattagcaggtggttagcctggtatcagcagaaaccagggaaagcccctaaggtcctgatctatgctgcatccactttgcaaagtggggtcccatcaaggttcagcggcagtggatctgggacagatttcactctcaccatcagcagcctgcagcctgaagattttgcaacttactattgtcaacaggctaacagtttcccattcactttcggccctgggaccaaagtggatatcaga

SEQ ID NO: 25356 - protein, 107 aa, Artificial Sequence
  Description of Artificial Sequence: Synthetic polypeptide
DIQMTQSPSSVSASVGDRLTITCRASQGISRWLAWYQQKPGKAPKVLIYAASTLQSGVPSRFSGSGSGTDFTLTISSLQPEDFATYYCQQANSFPFTFGPGTKVDIR

SEQ ID NO: 25357 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttgggctggtatcagcagaaaccagggaaagcccctaagcgcctgatctatgctgcttccagtttgcaaagtggggtcccatcaaggttcagcggcggtggatctgggacacacttcactctcacaatcagcagcctgcagcctgaagattttgcaacttattactgtctacagcataatagttacccgtggacgttcggccaagggaccaaggtggaaatcaaa

SEQ ID NO: 25358 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGGGSGTHFTLTISSLQPEDFATYYCLQHNSYPWTFGQGTKVEIK

SEQ ID NO: 25359 - DNA, 321 bp, Artificial Sequence
  Description of Artificial Sequence: Synthetic polynucleotide
gacatccagatgacccagtctccatcttccgtgtctgcctctgtaggagacagagtcaccatcacttgtcgggcgagtcagggtattagcagttggttagcctggtatcagcagaaaccagggaaagcccctaagctcctgatctatgttgcatccagtttgcaaagtggggtcccatcaaggttcagcggcagtggatctgggacagatttcactctcaccatcaggagcctgcagcctgaagattttgcaacttactattgtcaacaggctaaaagtttcccattcactttcggccctgggaccaaagtggatatcaaa

SEQ ID NO: 25360 - protein, 107 aa, Artificial Sequence
  Description of Artificial Sequence: Synthetic polypeptide
DIQMTQSPSSVSASVGDRVTITCRASQGISSWLAWYQQKPGKAPKLLIYVASSLQSGVPSRFSGSGSGTDFTLTIRSLQPEDFATYYCQQAKSFPFTFGPGTKVDIK

SEQ ID NO: 25361 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattaggactgatttaggctggtatcagcagaaaccaaggaaagcccctcagcgcctgatctatgctgcatccagtttgcaacgtggagtcccatcaagattcagcggcagtggatctgggacagacttcactctcacaatcagcagcctgcagcctgaagattttgcatcttattactgtctacagcataatagttacccattcactttcggccctgggaccaaagtggatatcaaa

SEQ ID NO: 25362 - protein, 107 aa, Artificial Sequence
  Description of Artificial Sequence: Synthetic polypeptide
DIQMTQSPSSLSASVGDRVTITCRASQGIRTDLGWYQQKPRKAPQRLIYAASSLQRGVPSRFSGSGSGTDFTLTISSLQPEDFASYYCLQHNSYPFTFGPGTKVDIK

SEQ ID NO: 25363 - DNA, 321 bp, Artificial Sequence
  Description of Artificial Sequence: Synthetic polynucleotide
gacatccagatgacccagtctccatcctccctgtctgcgtctgtaggagacagagtcaccatcacttgccgggcaagtcagagcattagtacctatttaatgtggtatcagcagaaaccagggaaagcccctaagctcttgatatatgctgcatccagtttgcaaagtggggtcccatcagagttcagtgccagtggatctgggacagatttcactctcaccatcagcagtctgcaacctgaagattttgcaacttactactgtcaacagagttacagtatcccattcactttcggccctgggaccaaagtggatatcaaa

SEQ ID NO: 25364 - protein, 107 aa, Artificial Sequence
  Description of Artificial Sequence: Synthetic polypeptide
DIQMTQSPSSLSASVGDRVTITCRASQSISTYLMWYQQKPGKAPKLLIYAASSLQSGVPSEFSASGSGTDFTLTISSLQPEDFATYYCQQSYSIPFTFGPGTKVDIK

SEQ ID NO: 25365 - DNA, 321 bp, Artificial Sequence
  Description of Artificial Sequence: Synthetic polynucleotide
gccatccagatgacccagtctccatcctccctgtctgcatctgtaggagacagagtcaccatcacttgccggacaagtcagggcattagaaatgatttaggctggtatcagcagaaaccaaggaaagcccctaaacgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccattcactttcggccctgggaccaaagtggatatcaaa

SEQ ID NO: 25366 - protein, 107 aa, Artificial Sequence
  Description of Artificial Sequence: Synthetic polypeptide
AIQMTQSPSSLSASVGDRVTITCRTSQGIRNDLGWYQQKPRKAPKRLIYAASSLQSGVPSRFSGSGSGTEFTLTISSLQPEDFATYYCLQHNSYPFTFGPGTKVDIK

SEQ ID NO: 25367 - DNA, 321 bp, Artificial Sequence
  Description of Artificial Sequence: Synthetic polynucleotide
gacatccagatgacccagtctccatccgccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgttcactttcggcggagggaccaaggtggagatcaaa

SEQ ID NO: 25368 - protein, 107 aa, Artificial Sequence
  Description of Artificial Sequence: Synthetic polypeptide
DIQMTQSPSALSASVGDRVTITCRASQGIRNDLGWYQQKPGKAPKRLIYAASSLQSGVPSRFSGSGSGTEFTLTISSLQPEDFATYYCLQHNSYPFTFGGGTKVEIK

SEQ ID NO: 25369 - DNA, 321 bp, Artificial Sequence
  Description of Artificial Sequence: Synthetic polynucleotide
gacatccagatgacccagtctccatcttccgtgtctacatttgtaggagacagaatcaccatcacttgtcgggcgagtcaggatattcgcacctggttagcctggtatcagcagaaacctgggaaagcccctaagctcctgatctatgctgcatccagtttgcaaaatggggtcccatcaaggttcagcggcagtggatctgggacagatttcactctcaccatcagtagcctgcagcctgaagattttgcaacttacttttgtcaacaggctaaaagtttcccattcactttcggccctgggaccaaagtggatatcaaa

SEQ ID NO: 25370 - protein, 107 aa, Artificial Sequence
  Description of Artificial Sequence: Synthetic polypeptide
DIQMTQSPSSVSTFVGDRITITCRASQDIRTWLAWYQQKPGKAPKLLIYAASSLQNGVPSRFSGSGSGTDFTLTISSLQPEDFATYFCQQAKSFPFTFGPGTKVDIK

SEQ ID NO: 25371 - DNA, 321 bp, Artificial Sequence
  Description of Artificial Sequence: Synthetic polynucleotide
gacatccagatgacccagtctccatcgtcactgtctgcatctgtaggagacagagtcaccatcacttgccgggcaagtcagggcattagaaatgatttaggctggtatcagcagaaaccagggaaagcccctaggcgcctgatctatgctgcatcctttttgcaaagtggggtcccatcgacattcagcggcagtggatctgggacagaattcactctcacaatcagcagcctgcagcctgaagattttgcaacttattactgtctgcagcataatagctaccctctcactttcggcggagggaccaaggtggagatcaaa

SEQ ID NO: 25372 - protein, 107 aa, Artificial Sequence
  Description of Artificial Sequence: Synthetic polypeptide
DIQMTQSPSSLSASVGDRVTITCRASQGIRNDLGWYQQKPGKAPRRLIYAASFLQSGVPSTFSGSGSGTEFTLTISSLQPEDFATYYCLQHNSYPLTFGGGTKVEIK

SEQ ID NO: 25373 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagaatattaccaactggttagcctggtttcagcagaaaccagggagagcccctaagctcctgatctatactacatccagtttgcaaagtggggtcccatcaaggttcagcggcagtggatctgggacagatttcactctcaccatcagcagcctgcagcctgaagattttgcaacttactgttgtcaacagactaacagtttcccgtggacgttcggccatgggaccaaggtagaagtcaaa

SEQ ID NO: 25374 - protein, 107 aa, Artificial Sequence
  Description of Artificial Sequence: Synthetic polypeptide
DIQMTQSPSSVSASVGDRVTITCRASQNITNWLAWFQQKPGRAPKLLIYTTSSLQSGVPSRFSGSGSGTDFTLTISSLQPEDFATYCCQQTNSFPWTFGHGTKVEVK

SEQ ID NO: 25375 - DNA, 321 bp, Artificial Sequence
  Description of Artificial Sequence: Synthetic polynucleotide
gacatccagatgacccaatctccatcctcactgtctgcatctgtaggagacagagtcaccatcacttgtcgggcgagtcagggcattagcaattatttagcctggtttcagcagaaaccagggaaagcccctaagtccctgatcaatgctgcatccagtttacaaagtggggtcccatcaaagttcagcggcagtggatctgggacagatttcactctcactatcagcagcctgcagcctgaagattttgcaacttattactgccaacagtataatagtttccctttcactttcggccctgggaccaaagtggatatcaaa

SEQ ID NO: 25376 - protein, 107 aa, Artificial Sequence
  Description of Artificial Sequence: Synthetic polypeptide
DIQMTQSPSSLSASVGDRVTITCRASQGISNYLAWFQQKPGKAPKSLINAASSLQSGVPSKFSGSGSGTDFTLTISSLQPEDFATYYCQQYNSFPFTFGPGTKVDIK

SEQ ID NO: 25377 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattagtaactatttacattggtatcagcagaaaccagggaaagcccctaaactcctgatctacgatgcatccactttgggaacaggggtcccattaaggttcagtggaagtggatctgggacagaatttactttcaccattaacagcctgcagcctgaagatattgcaacatattcctgtcaacagtgtgataatctcccgctcactttcggcggggggaccaaggtggagatcaaa

SEQ ID NO: 25378 - protein, 107 aa, Artificial Sequence
  Description of Artificial Sequence: Synthetic polypeptide
DIQMTQSPSSLSASVGDRVTITCQASQDISNYLHWYQQKPGKAPKLLIYDASTLGTGVPLRFSGSGSGTEFTFTINSLQPEDIATYSCQQCDNLPLTFGGGTKVEIK

SEQ ID NO: 25379 - DNA, 321 bp, Artificial Sequence
  Description of Artificial Sequence: Synthetic polynucleotide
gccatccagatgacccagtctccatcctccctgtctgcatctgtaggagacagagtcaccatcacttgccgggcaagtcagggcattagaaatgatttaggctggtatcagcagaaaccaaggaaagcccctaagcgcctgatctatgctgcatccagtttgcaaagtggggtcccattaaggttcagcggcagtggatctgggacagaattcactctcacaatcagaagcctgcagcctgaagattttgcaacttattactgtctacagcataatagttacccattcactttcggccctgggaccaaagtggatatcaaa

SEQ ID NO: 25380 - protein, 107 aa, Artificial Sequence
  Description of Artificial Sequence: Synthetic polypeptide
AIQMTQSPSSLSASVGDRVTITCRASQGIRNDLGWYQQKPRKAPKRLIYAASSLQSGVPLRFSGSGSGTEFTLTIRSLQPEDFATYYCLQHNSYPFTFGPGTKVDIK

SEQ ID NO: 25381 - DNA, 336 bp, Artificial Sequence
  Description of Artificial Sequence: Synthetic polynucleotide
gatgttatgatgacccagattccactctctctgtccgtcacccctggacagccggcctccatctcctgcaagtctagtcagagcctcctgcatagtgaaggaaagacctatttgtattggtacttgcagaagccaggccagcctccacagctcctgatctttgaagtttccaaccgggtctctggagtgccagataggttcagtggcagagggtcagggacagatttcacactgaaaatcagccgggtggaggctgaggatgttggggtttattactgcatgcaaagtatacagtatccgatcaccttcggccaagggacacgactggagattaaa

SEQ ID NO: 25382 - protein, 112 aa, Artificial Sequence
  Description of Artificial Sequence: Synthetic polypeptide
DVMMTQIPLSLSVTPGQPASISCKSSQSLLHSEGKTYLYWYLQKPGQPPQLLIFEVSNRVSGVPDRFSGRGSGTDFTLKISRVEAEDVGVYYCMQSIQYPITFGQGTRLEIK

SEQ ID NO: 25383 - DNA, 321 bp, Artificial Sequence
  Description of Artificial Sequence: Synthetic polynucleotide
gacatccagatgacccagtctccatcctcactgtctgtatctgtaggagacagagtcaccatcacttgtcgggcgagtcagggtattagtaattatttaggctggtttcagcagaaaccagggaaagccccgaagtccctgatttatgctgcatctagtttgcaaagtggggtcccatcaaggttcagcggcagtggatctgggacagatttcactctcaccatcagcagcctacagcctgaagattttgcaacttattactgccaacagtataatagttatcctccgacgttcggccaagggaccaaggtggaaatcaaa

SEQ ID NO: 25384 - protein, 107 aa, Artificial Sequence
  Description of Artificial Sequence: Synthetic polypeptide
DIQMTQSPSSLSVSVGDRVTITCRASQGISNYLGWFQQKPGKAPKSLIYAASSLQSGVPSRFSGSGSGTDFTLTISSLQPEDFATYYCQQYNSYPPTFGQGTKVEIK

SEQ ID NO: 25385 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcaggatattaacagttggttagcctggtatcagcagaaaccagggaaagcccctaaactcctgatctatgttgcatccagtttgcaaagtggggccccatcaaggttcagcggcagtggatctgggacagatttcactctcaccatcaggagcctgcagcctgaagattttgctacttactattgtcaacaggctaaaagtttcccattcactttcggccctgggaccaaagtggatatcaaa

SEQ ID NO: 25386 - protein, 107 aa, Artificial Sequence
  Description of Artificial Sequence: Synthetic polypeptide
DIQMTQSPSSVSASVGDRVTITCRASQDINSWLAWYQQKPGKAPKLLIYVASSLQSGAPSRFSGSGSGTDFTLTIRSLQPEDFATYYCQQAKSFPFTFGPGTKVDIK

SEQ ID NO: 25387 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcataagaaataatttaggctggtatcagcagaaaccagggaaagcccctaagcgcctgatctatggtgcatccagtttgcaaagtggggtcccatcaaggttcagcggcagtggatctgggacagaattcactctcacaatcagcagcctgcagcctgaagattttgcaacttattactgtctacagtataatagttatccattcactttcggccctgggaccaaagtggatatcaaa

SEQ ID NO: 25388 - protein, 107 aa, Artificial Sequence
  Description of Artificial Sequence: Synthetic polypeptide
DIQMTQSPSSLSASVGDRVTITCRASQGIRNNLGWYQQKPGKAPKRLIYGASSLQSGVPSRFSGSGSGTEFTLTISSLQPEDFATYYCLQYNSYPFTFGPGTKVDIK

SEQ ID NO: 25389 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatcctgcatccagtttacaaagtggggtcccatcaaggttcagcggcagcggatctgggacagaattcagtctcacaatcagcagcctgcagcctgaagattttgcaacttattactgtctacaggataatagttacccattcactttcggccctgggaccaaagtggatatcaaa

SEQ ID NO: 25390 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYPASSLQSGVPSRFSGSGSGTEFSLTISSLQPEDFATYYCLQDNSYPFTFGPGTKVDIK

SEQ ID NO: 25391 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacaacataatagatacccgctcactttcggcggagggaccaaggtggagatcaaa

SEQ ID NO: 25392 - protein, 107 aa, Artificial Sequence; identical to SEQ ID NO: 24628
  Description of Artificial Sequence: Synthetic polypeptide

SEQ ID NO: 25393 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagttttagccactatttaaattggtatcagcagaaaccagggaaagcccctaacctcctgatctttgctgtatccagtttgcaaagtggggtcccatcacggttcagtggcagtggatctgggtcagatttcactctccccatcagtagtttgcaacctgaagattttgcaatttacttctgtcaacagagtttcagtaccccattcactttcggccctgggaccaaagtggatatcaaa

SEQ ID NO: 25394 - protein, 107 aa, Artificial Sequence
  Description of Artificial Sequence: Synthetic polypeptide
DIQMTQSPSSLSASVGDRVTITCRASQSFSHYLNWYQQKPGKAPNLLIFAVSSLQSGVPSRFSGSGSGSDFTLPISSLQPEDFAIYFCQQSFSTPFTFGPGTKVDIK

SEQ ID NO: 25395 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattagcaactatttacattggtatcagcagaaaccagggaaagcccctcagctcctgatctacgatgcatccaatttggaaacaggggtcccatcaaggttcactggaagtggatctgggacagattttactttcaccatcagcagcctgcagcctgaagatattgcaacatattactgtcatcagtatgataatctcccgctcactttcggcggagggaccaaggtggagatcaaa

SEQ ID NO: 25396 - protein, 107 aa, Artificial Sequence
  Description of Artificial Sequence: Synthetic polypeptide
DIQMTQSPSSLSASVGDRVTITCQASQDISNYLHWYQQKPGKAPQLLIYDASNLETGVPSRFTGSGSGTDFTFTISSLQPEDIATYYCHQYDNLPLTFGGGTKVEIK

SEQ ID NO: 25397 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggtcattagcaattatttagcctggtttcagcagaaaccagggaaagcccctaagtccctgatctctgctgcatccagtttgcaaagtggggtcccatcaaagttcagcggcagtggatctgggacagatttcactctcaccatcagcagcctgcagcctgaagattttgcaacttactactgccaacagtatcatagttacccactcactttcggccgtgggaccaaagtggatatcaaa

SEQ ID NO: 25398 - protein, 107 aa, Artificial Sequence
  Description of Artificial Sequence: Synthetic polypeptide
DIQMTQSPSSLSASVGDRVTITCRASQVISNYLAWFQQKPGKAPKSLISAASSLQSGVPSKFSGSGSGTDFTLTISSLQPEDFATYYCQQYHSYPLTFGRGTKVDIK

SEQ ID NO: 25399 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagtacagtagcgactatttaaattggtatcagcagaaaccagggaaagcccctaaggtcctgatctttgctgcatccagtttgaaaagtggggtcccatcaaggttcagtggcagtggatctgggacagatttcactctcaccatcagcagtctggaacctgaggattttgcgacttacttctgtcaacagagttacagtaccccgttcaccttcggccaagggacacgactggagattaaa

SEQ ID NO: 25400 - protein, 107 aa, Artificial Sequence
  Description of Artificial Sequence: Synthetic polypeptide
DIQMTQSPSSLSASVGDRVTITCRASQYSSDYLNWYQQKPGKAPKVLIFAASSLKSGVPSRFSGSGSGTDFTLTISSLEPEDFATYFCQQSYSTPFTFGQGTRLEIK

SEQ ID NO: 25401 - DNA, 321 bp, Artificial Sequence
  Description of Artificial Sequence: Synthetic polynucleotide
gacatccagatgacccagtctccatcctccctgtctgcctctgtaggcgccagagtcaccatcacttgccgggcaagtcagggcattagaaatgatttaggctggtatcagcagaatccggggaaagcccctaagcgcctgatctatgctgcatccaatttgcaaagtggggtcccatcaaggttcagcggcagtggatctgggacagaattcactctcactatcagcagcctgcagcctgaagattttgcaacttatttctgtctacaacataatcgttacccgctcactttcggcggagggaccaaggtggagatcaaa

SEQ ID NO: 25402 - protein, 107 aa, Artificial Sequence
  Description of Artificial Sequence: Synthetic polypeptide
DIQMTQSPSSLSASVGARVTITCRASQGIRNDLGWYQQNPGKAPKRLIYAASNLQSGVPSRFSGSGSGTEFTLTISSLQPEDFATYFCLQHNRYPLTFGGGTKVEIK

SEQ ID NO: 25403 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaagacattaccaactatttagattggtatcagcagaaaccggggaaagcccctaaactcctgatctacgatgcatccaatttgggaacaggggtcccatcaaggttcagtggaagtggatctgggacagattttactttcaccatcagcagcctgcagcctgaagatattgcaacatattactgtcaacagtgtgataatctcccgctcactttcggcggagggaccaaggtggagatcaaa

SEQ ID NO: 25404 - protein, 107 aa, Artificial Sequence
  Description of Artificial Sequence: Synthetic polypeptide
DIQMTQSPSSLSASVGDRVTITCQASQDITNYLDWYQQKPGKAPKLLIYDASNLGTGVPSRFSGSGSGTDFTFTISSLQPEDIATYYCQQCDNLPLTFGGGTKVEIK

SEQ ID NO: 25405 - DNA, 321 bp, Artificial Sequence
  Description of Artificial Sequence: Synthetic polynucleotide
gacatccagatgtcccagtctccatcttccgtgtctgcatctgtaggagacagagtcaccatcacttgtcgggcgagtcagggtattagcaggtggttagcctggtatcagcagaaaccagggaaagcccctaacctcctgatctatgctgcatccagtttgcaaagtggggtcccatcaaggttcagcggcagtggctctgggacagatttcactctcaccatcagcagcctgcagcctgaagattttgcaatttactattgtcagcaggctaacagtttcccattcactttcggccctgggaccaaagtggatatcaaa

SEQ ID NO: 25406 - protein, 107 aa, Artificial Sequence
  Description of Artificial Sequence: Synthetic polypeptide
DIQMSQSPSSVSASVGDRVTITCRASQGISRWLAWYQQKPGKAPNLLIYAASSLQSGVPSRFSGSGSGTDFTLTISSLQPEDFAIYYCQQANSFPFTFGPGTKVDIK

SEQ ID NO: 25407 - DNA, 327 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattacaagcagctacttagcctggtaccagcagaaacctggccaggctcccaggctcctcatctatggtgcgtccggcagggccactggcatcccagacaggttcagtggcagtgggtctgggacagacttcaccctcaccatcagcagactggagcctgaagattttgcagtgtattactgtcagcagtttgaaagctcacccatgtgcagttttggccaggggaccaacctggagatcaaa

SEQ ID NO: 25408 - protein, 109 aa, Artificial Sequence
  Description of Artificial Sequence: Synthetic polypeptide
EIVLTQSPGTLSLSPGERATLSCRASQSITSSYLAWYQQKPGQAPRLLIYGASGRATGIPDRFSGSGSGTDFTLTISRLEPEDFAVYYCQQFESSPMCSFGQGTNLEIK

SEQ ID NO: 25409 - DNA, 321 bp, Artificial Sequence
  Description of Artificial Sequence: Synthetic polynucleotide
gacatccagatgacccagtctccatcctccctgtctgcatctgtaggagacagagtcaccatcacttgtcgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccattcactttcggccctgggaccaaagtggatatcaaa

SEQ ID NO: 25410 - protein, 107 aa, Artificial Sequence; identical to SEQ ID NO: 24296
  Description of Artificial Sequence: Synthetic polypeptide

SEQ ID NO: 25411 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaagattcagcggcagtggatctgggacagaattcactctcacaatcagcagcctgcagcctgaagattttgcaacttattactgtctacaacataatagttacccattcactttcggccctgggaccaaagtggatatcaaa

SEQ ID NO: 25412 - protein, 107 aa, Artificial Sequence; identical to SEQ ID NO: 24296
  Description of Artificial Sequence: Synthetic polypeptide

SEQ ID NO: 25413 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagctggttagcctggtatcagcagaaaccagggaaagcccctaaactcctgatctatgatgcatccagtttgcaaagtggggtcccatcaaggttcagcggcagtggatctgagacagatttcactctcaccatcagcagcctgcagcctgaagattttgcaacttactattgtcaacaggctaacagtttcccgtggacgttcggccaagggaccaaggtggaaatcaaa

SEQ ID NO: 25414 - protein, 107 aa, Artificial Sequence
  Description of Artificial Sequence: Synthetic polypeptide
DIQMTQSPSSVSASVGDRVTITCRASQGISSWLAWYQQKPGKAPKLLIYDASSLQSGVPSRFSGSGSETDFTLTISSLQPEDFATYYCQQANSFPWTFGQGTKVEIK

SEQ ID NO: 25415 - DNA, 321 bp, Artificial Sequence
  Description of Artificial Sequence: Synthetic polynucleotide
gacatccagatgacccaatctccatcctccctgtctgcatctgttggagacagagtcaccatcacttgccgggcaagtcaggacattagaaatattttaggctggtatcagcagaaaccagggaaagcccctaagcgcctgatctatgctgcatccaatttgcaaagtggagtcccatcaaggttcagcggcagtggatctgggacagaattcactctcacaatcagcagcctgcagcctgaggatttcgcaacttattactgtctacagtataatagttacccgtggacgttcggccaagggaccaaggtggaaatcaaa

SEQ ID NO: 25416 - protein, 107 aa, Artificial Sequence
  Description of Artificial Sequence: Synthetic polypeptide
DIQMTQSPSSLSASVGDRVTITCRASQDIRNILGWYQQKPGKAPKRLIYAASNLQSGVPSRFSGSGSGTEFTLTISSLQPEDFATYYCLQYNSYPWTFGQGTKVEIK

SEQ ID NO: 25417 - DNA, 336 bp, Artificial Sequence
  Description of Artificial Sequence: Synthetic polynucleotide
gatattgtgatgacccagactccactctctctgtccgtcacccctggacagccggcctccatgtcctgcaagtctagtcagagcctcctgcatagtgagggaaagacctatttgtattggtacctgcggaagccaggccagcctccacagttcctgatctttgaagtttccaaccggttctctggagtgccagataggttcagtggcagcgggtcagggacagaattcacactgaaaatcagccgggtggaggctgaggatgttgggatttattactgcatgcaaagtatacagtttccattcactttcggccctgggaccaaagtggatatcaaa

SEQ ID NO: 25418 - protein, 112 aa, Artificial Sequence
  Description of Artificial Sequence: Synthetic polypeptide
DIVMTQTPLSLSVTPGQPASMSCKSSQSLLHSEGKTYLYWYLRKPGQPPQFLIFEVSNRFSGVPDRFSGSGSGTEFTLKISRVEAEDVGIYYCMQSIQFPFTFGPGTKVDIK

SEQ ID NO: 25419 - DNA, 321 bp, Artificial Sequence
  Description of Artificial Sequence: Synthetic polynucleotide
gacatccagatgacccagtctccatcctccctgtctgcctctgtaggcgccagagtcaccatcacttgccgggcaagtcagggcattagaaatgatttaggctggtatcagcagaatccggggaaagcccctaagcgcctgatctatgctgcatccaatttgcaaagtggggtcccatcaaggttcagcggcagtggatctgggacagaattcactctcactatcagcagcctgcagcctgaagattttgcaacttatttctgtctacagcataatcgttacccgctcactttcggcggagggaccaaggtggagatcaaa

SEQ ID NO: 25420 - protein, 107 aa, Artificial Sequence; identical to SEQ ID NO: 25402
  Description of Artificial Sequence: Synthetic polypeptide

SEQ ID NO: 25421 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatctaggttcagcggcagtggatctgggacagaattcactctcacaatcagcagcctgcagcctgaagattttgcaacttattactgtctacatcataatacttacccattcactttcggccctgggaccaaagtggatatcaaa

SEQ ID NO: 25422 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLHHNTYPFTFGPGTKVDIK

SEQ ID NO: 25423 - DNA, 321 bp, Artificial Sequence
  Description of Artificial Sequence: Synthetic polynucleotide
gacatccagatgacccagtctccatcttccgtgtctgcatctgtaggggacagagtcaccatcacttgtcgggcgagtcaggttattagccgctggttagcctggtatcagcagaaaccagggaaagcccctaacctcctgatctatgctgcatccagtttgcaaagtggggtcccatcaaggttcagcggcagtggatctgggacagatttcactctgaccatcagcagcctgcagcctgaagattttgcaacttactattgtcaacaggctaacagtttcccattcactttcggccctgggaccaaagtggatctcaaa

SEQ ID NO: 25424 - protein, 107 aa, Artificial Sequence
  Description of Artificial Sequence: Synthetic polypeptide
DIQMTQSPSSVSASVGDRVTITCRASQVISRWLAWYQQKPGKAPNLLIYAASSLQSGVPSRFSGSGSGTDFTLTISSLQPEDFATYYCQQANSFPFTFGPGTKVDLK

SEQ ID NO: 25425 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcgacttagcctggtaccagctgaaacctggccaggctcccaggctcctcatctatgatgcatccgccagggccactggtatcccagccaggttcagtggcagtgggtctgggacagagttcactctcaccatcagcagcctgcagtctgaagattttgcattttattactgtcagcagtattataactggcctctcactttcggcggagggaccaaggtggagatcaaa

SEQ ID NO: 25426 - protein, 107 aa, Artificial Sequence
  Description of Artificial Sequence: Synthetic polypeptide
EIVMTQSPATLSVSPGERATLSCRASQSVSSDLAWYQLKPGQAPRLLIYDASARATGIPARFSGSGSGTEFTLTISSLQSEDFAFYYCQQYYNWPLTFGGGTKVEIK

SEQ ID NO: 25427 - DNA, 336 bp, Artificial Sequence
  Description of Artificial Sequence: Synthetic polynucleotide
gatattgtgatgacccagactccactctctctgtccgtcacccctggacagccggcctccatctcctgcaaatctagtcagagcctcctgcatagtgaaggaaagacctatttgtattggtacctgcagaagccaggccagcctccacagttcctgatctttgaagtttcccaccggttctctggagtgccagataggttcagtggcagcgggtcagggacagatttcactctgaaaatcagccgggtggaggctgaggatgttggggtttattactgcatgcaaagtatacagcttccattcactttcggccctgggaccaaagtggatatcaaa

SEQ ID NO: 25428 - protein, 112 aa, Artificial Sequence
  Description of Artificial Sequence: Synthetic polypeptide
DIVMTQTPLSLSVTPGQPASISCKSSQSLLHSEGKTYLYWYLQKPGQPPQFLIFEVSHRFSGVPDRFSGSGSGTDFTLKISRVEAEDVGVYYCMQSIQLPFTFGPGTKVDIK

SEQ ID NO: 25429 - DNA, 336 bp, Artificial Sequence
  Description of Artificial Sequence: Synthetic polynucleotide
gatgttatgatgacccagattccactctctctgtccgtcacccctggacagccggcctccatctcctgcaagtctagtcagagcctcgtgcatagtgaaggaaagacctatttgtattggtatttgcagaagccaggccagcctccacagctcctgatctttgaagtttccaaccgggtctctggagtgccagataggttcagtggcagagggtcagggacagatttcacactgaaaatcagccgggtggaggctgaggatgttggggtttattactgcatgcaaagtatactgtatccgatcaccttcggccaagggacacgactggagattaaa

SEQ ID NO: 25430 - protein, 112 aa, Artificial Sequence
  Description of Artificial Sequence: Synthetic polypeptide
DVMMTQIPLSLSVTPGQPASISCKSSQSLVHSEGKTYLYWYLQKPGQPPQLLIFEVSNRVSGVPDRFSGRGSGTDFTLKISRVEAEDVGVYYCMQSILYPITFGQGTRLEIK

SEQ ID NO: 25431 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtagatctgggacagaattcactctcacaatcagcagcctgcagcctgaagattttgcatcttattactgtctacaacataatagttacccattcactttcggccctgggaccaaagtggatatcaaa

SEQ ID NO: 25432 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSRSGTEFTLTISSLQPEDFASYYCLQHNSYPFTFGPGTKVDIK

SEQ ID NO: 25433 - DNA, 321 bp, Artificial Sequence
  Description of Artificial Sequence: Synthetic polynucleotide
gacatccagatgacccagtctccatcctctctgtttgcatctgtaggagacagagtcaccatcacttgtcgggcgagtcaggacattagcaattatttaatctggtttcagcagaaaccagggaaagcccctaagtccctgatttatactgcatccagtttgcaaagtggggtcccctcaaagttcagcggcagtggatttgggacagatttcactctcaccatcagcaacctgcagcctgaagattttgcgacttattactgccaacagtatcatagtttccctctcactttcggcggagggaccagggtggagatcaga

SEQ ID NO: 25434 - protein, 107 aa, Artificial Sequence
  Description of Artificial Sequence: Synthetic polypeptide
DIQMTQSPSSLFASVGDRVTITCRASQDISNYLIWFQQKPGKAPKSLIYTASSLQSGVPSKFSGSGFGTDFTLTISNLQPEDFATYYCQQYHSFPLTFGGGTRVEIR

SEQ ID NO: 25435 - DNA, 321 bp, Artificial Sequence
  Description of Artificial Sequence: Synthetic polynucleotide
gacatccagatgacccagtctccatcctccctgtcttcatctgtaggagacagagtcaccatcacttgccgggcaagtcaggccattagaaatgatttaggctggtatcagcagaaaccagggaaagcccctaagcgcctgatccatgctgcattcaggttgcaaagtggggtcccatcaaggttcagcggcagtggatctgggacagaattcactctcacaatcagcagcctgcagcctgaagattttgcaacttattactgtctacagcataatagttaccctctcactttcggcggagggaccaaggtggggatcaaa

SEQ ID NO: 25436 - protein, 107 aa, Artificial Sequence
  Description of Artificial Sequence: Synthetic polypeptide
DIQMTQSPSSLSSSVGDRVTITCRASQAIRNDLGWYQQKPGKAPKRLIHAAFRLQSGVPSRFSGSGSGTEFTLTISSLQPEDFATYYCLQHNSYPLTFGGGTKVGIK

SEQ ID NO: 25437 - DNA, 336 bp, Artificial Sequence
  Description of Artificial Sequence: Synthetic polynucleotide
gatattgtgatgacccagactccactctctctgtccgtcacccctggacagtcggcctccatctcctgcaagtctagtcaaagcctcctgcatagtgaaggaaagacctatttgtattggtacttgcagaagccaggccagcctccacagctcctgatctatgaagtttccaaccggttctctggagtgccagataggttcagcggcagcgggtcagggacagattttacactgaaaatcagccgggtggaggctgaggatgttggggtttattactgcatacaaagtatacaacttccgatcaccttcggccaagggacacgactggagattaaa

SEQ ID NO: 25438 - protein, 112 aa, Artificial Sequence
  Description of Artificial Sequence: Synthetic polypeptide
DIVMTQTPLSLSVTPGQSASISCKSSQSLLHSEGKTYLYWYLQKPGQPPQLLIYEVSNRFSGVPDRFSGSGSGTDFTLKISRVEAEDVGVYYCIQSIQLPITFGQGTRLEIK

SEQ ID NO: 25439 - DNA, 321 bp, Artificial Sequence
  Description of Artificial Sequence: Synthetic polynucleotide
gacatccagatgacccagtctccatcctccccgtctgcttctgtaggagacagagtcaccatcacttgccaggcgagtcaagacattagcaactatttagattggtatcagcagaaaccagggaaagcccctaaactcctgatatacgatgcatccaatttggaaacaggggtcccatcaaggttcagtggaagtggatctgggacagattttgctttcaccatcagcagcctgcagcctgaagatattgcaacatattactgtcaacagtgtgataatctcccgctcactttcggcggagggaccaaggtggagatcaaa

SEQ ID NO: 25440 - protein, 107 aa, Artificial Sequence
  Description of Artificial Sequence: Synthetic polypeptide
DIQMTQSPSSPSASVGDRVTITCQASQDISNYLDWYQQKPGKAPKLLIYDASNLETGVPSRFSGSGSGTDFAFTISSLQPEDIATYYCQQCDNLPLTFGGGTKVEIK

SEQ ID NO: 25441 - DNA, 321 bp, Artificial Sequence
  Description of Artificial Sequence: Synthetic polynucleotide
gacatccagatgacccagtctccatcctccctgtctgcatctgtaggagacagaatcaccatcacttgccgggcaagtcagagcattctcagctatttgaattggtatcagcagaaaccaggaaaggcccctaaactcctgatctatgttgcatccagtttccaaagtggggtcccatcaaggttcagtggcagtggatctgggacagatttcactctcaccatcagcagtctgcaacctgatgattttgcaacttactactgtcaacagagttacagtccccctctcactttcggcggagggaccaaggtggagatcaaa

SEQ ID NO: 25442 - protein, 107 aa, Artificial Sequence
  Description of Artificial Sequence: Synthetic polypeptide
DIQMTQSPSSLSASVGDRITITCRASQSILSYLNWYQQKPGKAPKLLIYVASSFQSGVPSRFSGSGSGTDFTLTISSLQPDDFATYYCQQSYSPPLTFGGGTKVEIK

SEQ ID NO: 25443 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcaggatattagcagctggttggcctggtttcagcagaaaccagggaaagcccctaagctcctgatctatgctgcatccagtttgcaaaatggggtcccgtcaaggttcagcggcagtggatctgggacagatttcactctcaccatcagcagcctgcagcctgaagattttgcaacttactattgccaacagactaacagtttcccattcactttcggccctgggaccaaagtggatatcaaa

SEQ ID NO: 25444 - protein, 107 aa, Artificial Sequence
  Description of Artificial Sequence: Synthetic polypeptide
DIQMTQSPSSVSASVGDRVTITCRASQDISSWLAWFQQKPGKAPKLLIYAASSLQNGVPSRFSGSGSGTDFTLTISSLQPEDFATYYCQQTNSFPFTFGPGTKVDIK

SEQ ID NO: 25445 - DNA, 321 bp, Artificial Sequence
  Description of Artificial Sequence: Synthetic polynucleotide
gacatccagatgacccagtctccatcctccctgtctgcatctgtaggagacagagtcaccctcacttgccgggcaagtcagggcattagaaatgatttaggctggtatcagcagaaaccagggatagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatcgttacccattcactttcggccctgggaccaaagtggatatcaaa

SEQ ID NO: 25446 - protein, 107 aa, Artificial Sequence
  Description of Artificial Sequence: Synthetic polypeptide
DIQMTQSPSSLSASVGDRVTLTCRASQGIRNDLGWYQQKPGIAPKRLIYAASSLQSGVPSRFSGSGSGTEFTLTISSLQPEDFATYYCLQHNRYPFTFGPGTKVDIK

SEQ ID NO: 25447 - DNA, 318 bp, Artificial Sequence
  Description of Artificial Sequence: Synthetic polynucleotide
gacatccagatgacccagtctccaacctccctgtctgcatctgtgggagacagagtcaccatcacttgccaggcgagtcaggacattaccaactttttaaattggtatcagcagaaaccagggaaagcccctaagctcctgatctacgatgcctccaatttggaaacaggggtcccatcaaggttcagtggaagtggatctgggacagattttactttcaccatcagcagccttcagcctgaagatattgcaacatattactgtcaacagtatgataatctgatcaccttcggccaagggacacgactggagattaaa

SEQ ID NO: 25448 - protein, 106 aa, Artificial Sequence
  Description of Artificial Sequence: Synthetic polypeptide
DIQMTQSPTSLSASVGDRVTITCQASQDITNFLNWYQQKPGKAPKLLIYDASNLETGVPSRFSGSGSGTDFTFTISSLQPEDIATYYCQQYDNLITFGQGTRLEIK

SEQ ID NO: 25449 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattaacatttatttagcctggtttcagcagaaaccagggaaagcccctaagtccctgatctatgctgcatccagtttgcaaagtggggtcccatcgaagttcagcggcagtggatctgggacagatttcactctcaccatcagcagtctgcagcctgaagattttgcaacttattactgccaacagtataatagttatcctctcactttcggcggagggaccaaggtggagatcaaa

SEQ ID NO: 25450 - protein, 107 aa, Artificial Sequence
  Description of Artificial Sequence: Synthetic polypeptide
DIQMTQSPSSLSASVGDRVTITCRASQDINIYLAWFQQKPGKAPKSLIYAASSLQSGVPSKFSGSGSGTDFTLTISSLQPEDFATYYCQQYNSYPLTFGGGTKVEIK

SEQ ID NO: 25451 - DNA, 339 bp, Artificial Sequence
  Description of Artificial Sequence: Synthetic polynucleotide
gacatcgtcatgacccagtctccagactccctggctgtgtctctgggcgagagggccaccatcaactgcaagtccagccagagtgttttacatagttccaacaataagaactacttagtttggtaccagcagagaccaggacagcctcctaacctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctccgacgttcggccaagggaccaaggtggaaatcaaa

SEQ ID NO: 25452 - protein, 113 aa, Artificial Sequence
  Description of Artificial Sequence: Synthetic polypeptide
DIVMTQSPDSLAVSLGERATINCKSSQSVLHSSNNKNYLVWYQQRPGQPPNLLIYWASTRESGVPDRFSGSGSGTDFTLTISSLQAEDVAVYYCQQYYSTPPTFGQGTKVEIK

SEQ ID NO: 25453 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaataatttaggctggtatcagcagaaaccagggaaagcccctaagcgcctgatcaatgctgcatccagtttacaaagtggggtcccatcaaggttcagcggcagtggatctgggacagaattcactctcacaatcagcagcctgcagcctgaagattttgcaacttattactgtctacaggataatagtcacccgttcactttcggcggagggaccaaggtggagatcaaa

SEQ ID NO: 25454 - protein, 107 aa, Artificial Sequence
  Description of Artificial Sequence: Synthetic polypeptide
DIQMTQSPSSLSASVGDRVTITCRASQDIRNNLGWYQQKPGKAPKRLINAASSLQSGVPSRFSGSGSGTEFTLTISSLQPEDFATYYCLQDNSHPFTFGGGTKVEIK

SEQ ID NO: 25455 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagttttagccactatttaaattggtatcagcagaaaccagggaaagcccctaacctcctgatctttgctgtatccagtttgcaaagtggggtcccatcaaggttcagtggcagtggatctgggacagatttcactctcaccatcagtagtctgcaacctgaagattttgcaatttacttctgtcaacagagttacagtaccccattcactttcggccctgggaccaaagtggatatcaaa

SEQ ID NO: 25456 - protein, 107 aa, Artificial Sequence
  Description of Artificial Sequence: Synthetic polypeptide
DIQMTQSPSSLSASVGDRVTITCRASQSFSHYLNWYQQKPGKAPNLLIFAVSSLQSGVPSRFSGSGSGTDFTLTISSLQPEDFAIYFCQQSYSTPFTFGPGTKVDIK

SEQ ID NO: 25457 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatcttttaggctggtatcagcagaaaccagggaaagcccctaagcgcttgatctatgctgcatccagtttgcaaagtggggtcccatcaaggttcagcggcagtggatctgggacagagttcactctcacaatcagcagcctgcagcctgaagattttgcaacttattactgtctacagtataatagttacccattcactttcggccctgggaccaaagtggatatcaga

SEQ ID NO: 25458 - protein, 107 aa, Artificial Sequence
  Description of Artificial Sequence: Synthetic polypeptide
DIQMTQSPSSLSASVGDRVTITCRASQDIRNLLGWYQQKPGKAPKRLIYAASSLQSGVPSRFSGSGSGTEFTLTISSLQPEDFATYYCLQYNSYPFTFGPGTKVDIR

SEQ ID NO: 25459 - DNA, 321 bp, Artificial Sequence
  Description of Artificial Sequence: Synthetic polynucleotide
gacatccagatgacccagtctccatcttccgtgtctgcatctgtaggcgacagagtcaccatcacttgtcgggcgagtcagggtattaggaagtggttagcctggtatcagcagaaaccagggaaagcccctaagctcctgatctatgctgcatccagtttgcaaagtggggtcccgtcaaggttcagcggcagtggatctgggacagatttcactctcaccatcagcagcctgcagcctgaagattttgcaacttactattgtcaacaggctaacagtttcccattcactttcggccctgggaccaaagtggatatcaaa

SEQ ID NO: 25460 - protein, 107 aa, Artificial Sequence
  Description of Artificial Sequence: Synthetic polypeptide
DIQMTQSPSSVSASVGDRVTITCRASQGIRKWLAWYQQKPGKAPKLLIYAASSLQSGVPSRFSGSGSGTDFTLTISSLQPEDFATYYCQQANSFPFTFGPGTKVDIK

SEQ ID NO: 25461 - DNA, 321 bp, Artificial Sequence
  Description of Artificial Sequence: Synthetic polynucleotide
gacatccagatgacccagtctccatcctccctgtctgtatctgtaggagacagagtcaccatcacttgccgggcaagtcagagcattttcagatatttaaattggtatcagcagaaaccaggaagagcccctaagctcctgatctttgctgcatccagtttccaaagtggggtcccatcaaggttcagtggcagtggatctgggacagacttcactctcaccatcagcagcctacaacctgaagattttgcaacttactactgtcaacagacttacagtccccctctcactttcggcggagggaccaaggtggagatcaaa

SEQ ID NO: 25462 - protein, 107 aa, Artificial Sequence
  Description of Artificial Sequence: Synthetic polypeptide
DIQMTQSPSSLSVSVGDRVTITCRASQSIFRYLNWYQQKPGRAPKLLIFAASSFQSGVPSRFSGSGSGTDFTLTISSLQPEDFATYYCQQTYSPPLTFGGGTKVEIK

SEQ ID NO: 25463 - DNA, 321 bp, Artificial Sequence
  Description of Artificial Sequence: Synthetic polynucleotide
gacatccagatgacccagtctccatcttccgtgtctgcatctgtgggagacagagtcaccatcacttgtcgggcgagtcagggtattagcagctggttagcctggtatcagcagaaatcagggaatgcccctaagctcctgatctatgctgcatccagattgcaaagtggggtcccatcaaggttcagcggcagtggatctggtacatatttcactctcattatcagcagcctgcagtctgaagattttgcaacttactattgtcaacaggctaacagtttcccattcactttcggccctgggaccaaagtggatatcaaa

SEQ ID NO: 25464 - protein, 107 aa, Artificial Sequence
  Description of Artificial Sequence: Synthetic polypeptide
DIQMTQSPSSVSASVGDRVTITCRASQGISSWLAWYQQKSGNAPKLLIYAASRLQSGVPSRFSGSGSGTYFTLIISSLQSEDFATYYCQQANSFPFTFGPGTKVDIK

SEQ ID NO: 25465 - DNA, 321 bp, Artificial Sequence
  Description of Artificial Sequence: Synthetic polynucleotide
gacatccagatgacccagtctccatcttctgtgtgtgcatatgtaggagacagagtcaccatcacttgtcgggtgagtcaggatattagcaaatggttagcctggtttcagcagaaaccagggaaagcccctaaattcttgatatatgttgcatccggtttgcaaagtggggtcccatcaaggttcagcggcagtggatctgggacagatttcactttcaccatcagcagcctgcagcctgaagattttgcaacttactattgtcaacaggctaacagtttcccattcactttcggccctgggaccaaagtggatatcaaa

SEQ ID NO: 25466 - protein, 107 aa, Artificial Sequence
  Description of Artificial Sequence: Synthetic polypeptide
DIQMTQSPSSVCAYVGDRVTITCRVSQDISKWLAWFQQKPGKAPKFLIYVASGLQSGVPSRFSGSGSGTDFTFTISSLQPEDFATYYCQQANSFPFTFGPGTKVDIK

SEQ ID NO: 25467 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatactgcatccaatttacaaagtggggtcccatcaaggttcagcggcagtggatctgggacagaattcactctcacaatcagcagcctgcagcctgaagattttgcaacttattactgtctacagcataatagttatccgtggacgttcggccaagggaccaaggtggaaatcaaa

SEQ ID NO: 25468 - protein, 107 aa, Artificial Sequence; identical to SEQ ID NO: 25340
  Description of Artificial Sequence: Synthetic polypeptide

SEQ ID NO: 25469 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatcgttaccctttcactttcggccctgggaccaaagtggatttcaaa

SEQ ID NO: 25470 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNRYPFTFGPGTKVDFK

SEQ ID NO: 25471 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctccagcatggtgaaggaaagacctatttgtattggtacgtgcagaagccaggccagcctccacagctcctgatctatgaagtttcctatcggttttctggagtgccagataggttcagtggtagtgggtcagggacagatttcacactgaaaatcagccgggtggaggttgaggatgttggggtttattactgcatgcaaagtacacagcttccgctcaccttcggcggagggaccaaggtggagatcaaa

SEQ ID NO: 25472 - protein, 112 aa, Artificial Sequence
  Description of Artificial Sequence: Synthetic polypeptide
DIVMTQTPLSLSVTPGQPASISCKSSQSLQHGEGKTYLYWYVQKPGQPPQLLIYEVSYRFSGVPDRFSGSGSGTDFTLKISRVEVEDVGVYYCMQSTQLPLTFGGGTKVEIK

SEQ ID NO: 25473 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaaagatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgtggacgttcggccaagggaccaaggtggaaatcaaa

SEQ ID NO: 25474 - protein, 107 aa, Artificial Sequence
  Description of Artificial Sequence: Synthetic polypeptide
DIQMTQSPSSLSASVGDRVTITCRASQGIRKDLGWYQQKPGKAPKRLIYAASSLQSGVPSRFSGSGSGTEFTLTISSLQPEDFATYYCLQHNSYPWTFGQGTKVEIK

SEQ ID NO: 25475 - DNA, 336 bp, Artificial Sequence
  Description of Artificial Sequence: Synthetic polynucleotide
gatattgtgatgacccagactccactctctctgtccgtcacacctggacagtcggcctccatctcctgcaagtctagtcagagcctcctgcatagtgaaggaaagacctatttgtattggtacctgcagaagccaggccagcctccacagctcctgatctatgaagtttccaaccggatctctggagtgccagataggttcagtggcagcgggtcagggacagatttcacactgaaaatcagccgggtggaggctgaggatgttggggtttattactgcatgcaaagtatacagcttccgctcactttcggcggagggaccaaggtggagatcaaa

SEQ ID NO: 25476 - protein, 112 aa, Artificial Sequence
  Description of Artificial Sequence: Synthetic polypeptide
DIVMTQTPLSLSVTPGQSASISCKSSQSLLHSEGKTYLYWYLQKPGQPPQLLIYEVSNRISGVPDRFSGSGSGTDFTLKISRVEAEDVGVYYCMQSIQLPLTFGGGTKVEIK

SEQ ID NO: 25477 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatttagtttgcaaagtggggtcccatcaaggttcagcggcagtggatctgggacagaattcactctcacaatcagcagcctgcagcctgaagattttgcaacttattactgtctacagcataatagttaccctttcactttcggccctgggaccaaagtggatatcaaa

SEQ ID NO: 25478 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAAFSLQSGVPSRFSGSGSGTEFTLTISSLQPEDFATYYCLQHNSYPFTFGPGTKVDIK

SEQ ID NO: 25479 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctattctgcatccagtttacaaagtggggtcccatcaaggttcagcggcagtggatctgggacagaattcactctcacaatcagcagcctgcagcctgaagattttgcaacttattactgtctacagcataatagttacccgtggacgttcggcctagggaccaaggtggaaatcaaa

SEQ ID NO: 25480 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYSASSLQSGVPSRFSGSGSGTEFTLTISSLQPEDFATYYCLQHNSYPWTFGLGTKVEIK

SEQ ID NO: 25481 - DNA, 339 bp, Artificial Sequence
  Description of Artificial Sequence: Synthetic polynucleotide
gacatcgtgatgacccagtctccagactccctgactgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcaatttattactgtcagcaatattatagtactccgtgcagttttggccaggggaccaagctggagatcaac

SEQ ID NO: 25482 - protein, 113 aa, Artificial Sequence
  Description of Artificial Sequence: Synthetic polypeptide
DIVMTQSPDSLTVSLGERATINCKSSQSVLYSSNNKNYLAWYQQKPGQPPKLLIYWASTRESGVPDRFSGSGSGTDFTLTISSLQAEDVAIYYCQQYYSTPCSFGQGTKLEIN

SEQ ID NO: 25483 - DNA, 321 bp, Artificial Sequence
  Description of Artificial Sequence: Synthetic polynucleotide
gacatccagatgacccagtctccatcctcactgtctgcatctgtaggagacagagtcaccatcacatgtcgggcgagtcagggcattagcaattacttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagtctgaagattttgcaacgtactactgccaacaatataaaagtcacccattcactttcggccctgggaccaaagtggatatcaaa

SEQ ID NO: 25484 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTDFTLTISSLQSEDFATYYCQQYKSHPFTFGPGTKVDIK

SEQ ID NO: 25485 - DNA, 321 bp, Artificial Sequence
  Description of Artificial Sequence: Synthetic polynucleotide
gacatccagatgacccagtctccatcctcactgtctgcatctgtaggagacagagtcaccatctcttgtcgggcgagtcaggtcattaagaattatttagtctgggttcagcagaaaccagggaaagcccctaagtccctgatctatgctgcgtccagtttgcaaagtggggtcccatcaacgttcagcggcagtggatctgggacagatttcactctcaccatcagcagcctgcagcctgaagattttgcaacttattactgcctacagtttcatagttacccattcactttcggccctgggaccaaaatggatatcaaa

SEQ ID NO: 25486 - protein, 107 aa, Artificial Sequence
  Description of Artificial Sequence: Synthetic polypeptide
DIQMTQSPSSLSASVGDRVTISCRASQVIKNYLVWVQQKPGKAPKSLIYAASSLQSGVPSTFSGSGSGTDFTLTISSLQPEDFATYYCLQFHSYPFTFGPGTKMDIK

SEQ ID NO: 25487 - DNA, 321 bp, Artificial Sequence
  Description of Artificial Sequence: Synthetic polynucleotide
gacatccagatgacccagtctccatcctccctgtctgcatctgtaggagacagagtcaccttcacttgccgggcaagtcagggcattagaaatgatttaggctggtttcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcatagtagttacccgctcactttcggcggagggaccaaggtggagatcaaa

SEQ ID NO: 25488 - protein, 107 aa, Artificial Sequence
  Description of Artificial Sequence: Synthetic polypeptide
DIQMTQSPSSLSASVGDRVTFTCRASQGIRNDLGWFQQKPGKAPKRLIYAASSLQSGVPSRFSGSGSGTEFTLTISSLQPEDFATYYCLQHSSYPLTFGGGTKVEIK

SEQ ID NO: 25489 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgtagggccagtcagagtgttagcagttccttagcctggtaccggcagaaacctggccaggctcccaggctcctcatctatggtgcatccaccagggccactggtatcccggccaggttcagtggcagtgggtctgggacagagttcactctcaccatcagcagcctgcagtctgaagattttgcagtttattgctgtcagcagtataataactggccattcactttcggccctgggaccaaaatagatatcaaa

SEQ ID NO: 25490 - protein, 107 aa, Artificial Sequence
  Description of Artificial Sequence: Synthetic polypeptide
EIVMTQSPATLSVSPGERATLSCRASQSVSSSLAWYRQKPGQAPRLLIYGASTRATGIPARFSGSGSGTEFTLTISSLQSEDFAVYCCQQYNNWPFTFGPGTKIDIK

SEQ ID NO: 25491 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcaggttattagcaactggttagcctggtatcagctgaaaccagggaaagcccctaagctcctgatctatactgcatccagtttgcaaagtggggtcccatcaaggttcagcggcaatgaatctgggacagatttcactctcaccatcagcagcctgcagcctgaagattttgcaacttactattgtcaacaggctaacagtttcccgtggacgttcggccaagggaccaaggtggaaatcaaa

SEQ ID NO: 25492 - protein, 107 aa, Artificial Sequence
  Description of Artificial Sequence: Synthetic polypeptide
DIQMTQSPSSVSASVGDRVTITCRASQVISNWLAWYQLKPGKAPKLLIYTASSLQSGVPSRFSGNESGTDFTLTISSLQPEDFATYYCQQANSFPWTFGQGTKVEIK

SEQ ID NO: 25493 - DNA, 336 bp, Artificial Sequence
  Description of Artificial Sequence: Synthetic polynucleotide
gacattgtgatgacccagactccactctctctgtccgtcacccctggacagccggcctccatctcctgcaagtctagtcagagcctcctgcatagtgagggaaagacctatttgtattggtacctgcagaagccaggccagcctccacagttcctgatctatgaagtttccaaccggttctctggagtgccagataggttcagtggcagcgggtcagggacagatttcacactgaaaatcagccgggtggaggctgaggatgttgggatttattactgcatgcaaagtataaagtatccgctcactttcggcggagggaccaaggtggagatcaaa

SEQ ID NO: 25494 - protein, 112 aa, Artificial Sequence
  Description of Artificial Sequence: Synthetic polypeptide
DIVMTQTPLSLSVTPGQPASISCKSSQSLLHSEGKTYLYWYLQKPGQPPQFLIYEVSNRFSGVPDRFSGSGSGTDFTLKISRVEAEDVGIYYCMQSIKYPLTFGGGTKVEIK

SEQ ID NO: 25495 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaccttactactgtcaacagagttacaatatttcattcactttcggccctgggaccaaagtggatatcaaa

SEQ ID NO: 25496 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFAPYYCQQSYNISFTFGPGTKVDIK

SEQ ID NO: 25497 - DNA, 321 bp, Artificial Sequence; identical to SEQ ID NO: 25495
  Description of Artificial Sequence: Synthetic polynucleotide

SEQ ID NO: 25498 - protein, 107 aa, Artificial Sequence; identical to SEQ ID NO: 25496
  Description of Artificial Sequence: Synthetic polypeptide

SEQ ID NO: 25499 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaaagatttaggctggtatcagcagaaaccagggaaagcccctaagcgcctgatctttgctgcatccagtttgcaaagtggggtcccatcaaggttcagcggcagtggatctgggacagaattcactctcacaatcagcagcctgcagcctgaagattttgcaacttattactgtctacagcataatagttacccgtggacgttcggccaagggaccaaggtggaaatcaaa

SEQ ID NO: 25500 - protein, 107 aa, Artificial Sequence
  Description of Artificial Sequence: Synthetic polypeptide
DIQMTQSPSSLSASVGDRVTITCRASQGIRKDLGWYQQKPGKAPKRLIFAASSLQSGVPSRFSGSGSGTEFTLTISSLQPEDFATYYCLQHNSYPWTFGQGTKVEIK

SEQ ID NO: 25501 - DNA, 321 bp, Artificial Sequence
  Description of Artificial Sequence: Synthetic polynucleotide
gacatccagatgacccagtctccatcctccctgtctgcatctgtaggagacagagtcaccgtcacttgccgggcaagtcagggcattagagatgatttaggctggtatcagcagaaaccagggaaagcccctgagcgcctgatctatgctgcatccagtttgcaaagtggggtcccatcaaggttcagcggcagtggatctgggacagagttcactctcacaatcagcagcctgcagcctgaagattttgcaacttattactgtctacagcattatagttaccctcgcagttttggccaggggaccaagctggagatcaaa

SEQ ID NO: 25502 - protein, 107 aa, Artificial Sequence
  Description of Artificial Sequence: Synthetic polypeptide
DIQMTQSPSSLSASVGDRVTVTCRASQGIRDDLGWYQQKPGKAPERLIYAASSLQSGVPSRFSGSGSGTEFTLTISSLQPEDFATYYCLQHYSYPRSFGQGTKLEIK

SEQ ID NO: 25503 - DNA, 336 bp, Artificial Sequence
  Description of Artificial Sequence: Synthetic polynucleotide
gatattgtgatgacccagactccactctctctgtccgtcacacctggacagccggcctccatctcctgcaagtctagtcagagcctcctgcatagtgaaggaaagacctatttgtattggtacctgcagaagccaggccagcctccacagctcctgatctatgaagtttccaaccggatctctggagtgccagataggttcagtggcagcgggtcagggacagatttcacactgaaaatcagccgggtggaggctgaggatgttggggtttattactgcatgcaaagtatacagcttccgctcactttcggcggagggaccaaggtggagatcaaa

SEQ ID NO: 25504 - protein, 112 aa, Artificial Sequence
  Description of Artificial Sequence: Synthetic polypeptide
DIVMTQTPLSLSVTPGQPASISCKSSQSLLHSEGKTYLYWYLQKPGQPPQLLIYEVSNRISGVPDRFSGSGSGTDFTLKISRVEAEDVGVYYCMQSIQLPLTFGGGTKVEIK

SEQ ID NO: 25505 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttacacatctccaacaataacaattacttagcttggtaccagcagcaaccaggacagcctcctaaactgctcatttactgggcatctatccgggaatccggggtccctgaccgattcagtggcagcgggtctgggacagatttcactctcaccatcagcagcctgcaggctgaagatgtggcagtttattactgtcagcaatattatagtattccgtgcagttttggccaggggaccaagctggagatcaaa

SEQ ID NO: 25506 - protein, 113 aa, Artificial Sequence
  Description of Artificial Sequence: Synthetic polypeptide
DIVMTQSPDSLAVSLGERATINCKSSQSVLHISNNNNYLAWYQQQPGQPPKLLIYWASIRESGVPDRFSGSGSGTDFTLTISSLQAEDVAVYYCQQYYSIPCSFGQGTKLEIK

SEQ ID NO: 25507 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaataacaactccttaacttggtaccagctgaaaccaggacagcctcctaagaagctcatttactgggcatctacccgggaatccggggtccctgaccgattcagtggcagcgggtctgggacagatttcactctcaccatcagcagcctgcaggctgaagatgtggcagtttattactgtcagcaatattatagtactcctccgacgttcggccaagggtccaaggtggaaatcaaa

SEQ ID NO: 25508 - protein, 113 aa, Artificial Sequence
  Description of Artificial Sequence: Synthetic polypeptide
DIVMTQSPDSLAVSLGERATINCKSSQSVLYSSNNNNSLTWYQLKPGQPPKKLIYWASTRESGVPDRFSGSGSGTDFTLTISSLQAEDVAVYYCQQYYSTPPTFGQGSKVEIK

SEQ ID NO: 25509 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattaccaactttttaaattggtatcagcagaaaccagggaaagcgcctaaactcctgatcttcgctgcatccagtttgcaaagtggaatcccatcaaggttcagtggcagtggatctgggacagatttcactctcaccatcagcagtctgcaacctgaagattttgcaacttactactgtcaacagagttacagtatcccgtggacgttcggccaagggaccaaggtggaaatcaaa

SEQ ID NO: 25510 - protein, 107 aa, Artificial Sequence
  Description of Artificial Sequence: Synthetic polypeptide
DIQMTQSPSSLSASVGDRVTITCRASQSITNFLNWYQQKPGKAPKLLIFAASSLQSGIPSRFSGSGSGTDFTLTISSLQPEDFATYYCQQSYSIPWTFGQGTKVEIK

SEQ ID NO: 25511 - DNA, 324 bp, Artificial Sequence
  Description of Artificial Sequence: Synthetic polynucleotide
gacatccagatgacccagtctccatcctccctgtctgcatctgtaggagacagaatcaccatcacttgccgggcaagtcagggcattggaaatgatttaggctggtatcagcagaaaccagggaaagcccctgagcgcctgatctatgctgcatccagtttgcaaagtggggtcccatcaaggttcagcggcagtggatctgggacagaattcactctcacaatcagcagcctgcagcctgaagattttgcaacttattactgtctacaacataatagtttccctccgtggacgttcggccaagggaccaaggtggaaatcaaa

SEQ ID NO: 25512 - protein, 108 aa, Artificial Sequence
  Description of Artificial Sequence: Synthetic polypeptide
DIQMTQSPSSLSASVGDRITITCRASQGIGNDLGWYQQKPGKAPERLIYAASSLQSGVPSRFSGSGSGTEFTLTISSLQPEDFATYYCLQHNSFPPWTFGQGTKVEIK

SEQ ID NO: 25513 - DNA, 336 bp, Artificial Sequence
  Description of Artificial Sequence: Synthetic polynucleotide
gatattgtgatgactcagtctccactctccctgcccgtcacccctggagagccggcctccatctcctgcaggtctagtcagagcctcctacatagtaatggatacaactatttggattggtacctgcagaagccagggcagtctccacagctcctgatctatttggtttctaatcgggcctccggggtccctgacaggttcagtggcagtggatcaggcacagattttacactgaaaatcagcagagtgggggctgaggatgttggggtttatttctgcctgcaagctctacaaactcctctcaccttcggccaagggacacgactggagattaaa

SEQ ID NO: 25514 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLVSNRASGVPDRFSGSGSGTDFTLKISRVGAEDVGVYFCLQALQTPLTFGQGTRLEIK

SEQ ID NO: 25515 - DNA, 321 bp, Artificial Sequence
  Description of Artificial Sequence: Synthetic polynucleotide
gacatccagatgacccagtctccatcctccctgtctgcatatgtaggagacagagtcaccatcacttgccgggcaagtcagaacattttcagctatttaaattggtatcagcagaaaccagggaaagcccctaaggtcctgatctatgctgtatttagtttgcaaagtggggtcccatcaaggttcagtggcagtggatctgggacagatttcactctcaccatcagcagtctgcaacctgaagattttgcaacttactactgtcaacagagttacagtaccccattcactttcggccctgggaccaaagtggatatcaaa

SEQ ID NO: 25516 - protein, 107 aa, Artificial Sequence
  Description of Artificial Sequence: Synthetic polypeptide
DIQMTQSPSSLSAYVGDRVTITCRASQNIFSYLNWYQQKPGKAPKVLIYAVFSLQSGVPSRFSGSGSGTDFTLTISSLQPEDFATYYCQQSYSTPFTFGPGTKVDIK

SEQ ID NO: 25517 - DNA, 321 bp, Artificial Sequence
  Description of Artificial Sequence: Synthetic polynucleotide
gacatccagatgacccagtctccatcctccctgtctgcatctgtaggagacagagtcaccatcatttgccgggcaagtcagagcattatcagttatttaaattggtatcagcagaaaccagggaaagcccctaagctcctgatctatgctacatccagtttgcaaagtggggtcccatcaaggttcagtggcagtggatctgggacagatttcactctcaccatcagcagtctgcaacctgaagattttgcaacttactactgtcaacagacttacagtcccccgctcactttcggcggagggaccaaggtggagatcaaa

SEQ ID NO: 25518 - protein, 107 aa, Artificial Sequence
  Description of Artificial Sequence: Synthetic polypeptide
DIQMTQSPSSLSASVGDRVTIICRASQSIISYLNWYQQKPGKAPKLLIYATSSLQSGVPSRFSGSGSGTDFTLTISSLQPEDFATYYCQQTYSPPLTFGGGTKVEIK

SEQ ID NO: 25519 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatcccgtttgcaaagtggggtcccatcaaggttcagcggcagtggatctgggacagaattcactctcacaatcagcagcctgcagcctgaagattttgcaacttattactgtctacagcatagtaattaccctctcactttcggcggagggaccagggttgagatcaaa

SEQ ID NO: 25520 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASRLQSGVPSRFSGSGSGTEFTLTISSLQPEDFATYYCLQHSNYPLTFGGGTRVEIK

SEQ ID NO: 25521 - DNA, 321 bp, Artificial Sequence
  Description of Artificial Sequence: Synthetic polynucleotide
gacatccatatgacccagtctccatcctccctgtctgcatctgtaggagacagagtcaccatcacttgccgggcaagtcaggacattagaaataatttaggctggtatcagcagaaaccagggaaagcccctaagcgcctgatctatactgcatccagtttgcaaagtggggtcccatcaaggttcagcggcagtggatctgggacagaattcactctcacaatcagcagcctgcagcctgaagattttgcgacttattactgtctacagtataatagttacccattcactttcggccctgggaccaaagtggatatcaaa

SEQ ID NO: 25522 - protein, 107 aa, Artificial Sequence
  Description of Artificial Sequence: Synthetic polypeptide
DIHMTQSPSSLSASVGDRVTITCRASQDIRNNLGWYQQKPGKAPKRLIYTASSLQSGVPSRFSGSGSGTEFTLTISSLQPEDFATYYCLQYNSYPFTFGPGTKVDIK

SEQ ID NO: 25523 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctaatctatgctgcattcagtttgcaaagtggggtcccatcaaggttcagcggcagtggatctgggacagaattcactctcacaatcagcagcctgcagcctgaagattttgcaacttattactgtctacagcataatagttatccgctcactttcggcggagggaccaaggtggagatcaaa

SEQ ID NO: 25524 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAAFSLQSGVPSRFSGSGSGTEFTLTISSLQPEDFATYYCLQHNSYPLTFGGGTKVEIK

SEQ ID NO: 25525 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttaacagcaacttagcctggtaccagcagaaacctggccaggctcccaggctcctcatctctgttgcatccaccagggccactggtatcccagccaggttcaatggcagtgggtctgggacagagttcactctcaccatcagcagcctgcagtctgaagattttgcagtttattactgtcagcagtataatgactggccgtgtagttttggccaggggaccaagctggagatcaaa

SEQ ID NO: 25526 - protein, 107 aa, Artificial Sequence
  Description of Artificial Sequence: Synthetic polypeptide
EIVMTQSPATLSVSPGERATLSCRASQSVNSNLAWYQQKPGQAPRLLISVASTRATGIPARFNGSGSGTEFTLTISSLQSEDFAVYYCQQYNDWPCSFGQGTKLEIK

SEQ ID NO: 25527 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggccattagaaatgatttaggctggtatcagcagaaaccagggaaagcccctaagcgcctgatctatcctgcatcccgtttgcaaagtggggtcccatcaaggttcagcggcagtggatctgggacagaattcactctcacaatcagcagcctgcagcctgaagattttgcaacttattactgtctacagtataatagttaccctccgtggacgttcggccaagggtccaaggtggaaatcaaa

SEQ ID NO: 25528 - protein, 108 aa, Artificial Sequence
  Description of Artificial Sequence: Synthetic polypeptide
DIQMTQSPSSLSASVGDRVTITCRASQAIRNDLGWYQQKPGKAPKRLIYPASRLQSGVPSRFSGSGSGTEFTLTISSLQPEDFATYYCLQYNSYPPWTFGQGSKVEIK

SEQ ID NO: 25529 - DNA, 321 bp, Artificial Sequence
  Description of Artificial Sequence: Synthetic polynucleotide
gacatccagatgacccagtctccatcttccgtgtctgcatctgtaggagacagagtcaccttcacttgtcgggcgagtcaggatattagcagctggttagcctggtatcagcagaatccagggaaggcccctaaactcctgatctatgctgcatccagtttgcaaagtggggtcccatcaaggttcagcggcagtggatctgggacaaatttcactctcaccatcagcagcctccagcctgaagattttgcaacttactattgtcaacagactaacagtttccctctcactttcggcggagggaccaaggtggagatcaaa

SEQ ID NO: 25530 - protein, 107 aa, Artificial Sequence
  Description of Artificial Sequence: Synthetic polypeptide
DIQMTQSPSSVSASVGDRVTFTCRASQDISSWLAWYQQNPGKAPKLLIYAASSLQSGVPSRFSGSGSGTNFTLTISSLQPEDFATYYCQQTNSFPLTFGGGTKVEIK

SEQ ID NO: 25531 - DNA, 321 bp, Artificial Sequence
  Description of Artificial Sequence: Synthetic polynucleotide
gacatcctgatgacccagtctccatcctcactgtctgcatctgtaggagacagagtcaccatcacttgtcgggcgagtcagggcattagcacttatttagcctggtttcagcagacaccagggacagcccctaagtccctgatctatgctgcatccagtttgcaaggtggggtcccatcaaagttcagcggcagtggatctgggacagatttcactctcaccatcagcagcctgcagcctgaagattttgcaacttattactgccatcagtataatagtttcccatttaagttcgggcgtgggaccaaagtggatatcaca

SEQ ID NO: 25532 - protein, 107 aa, Artificial Sequence
  Description of Artificial Sequence: Synthetic polypeptide
DILMTQSPSSLSASVGDRVTITCRASQGISTYLAWFQQTPGTAPKSLIYAASSLQGGVPSKFSGSGSGTDFTLTISSLQPEDFATYYCHQYNSFPFKFGRGTKVDIT

SEQ ID NO: 25533 - DNA, 321 bp, Artificial Sequence
  Description of Artificial Sequence: Synthetic polynucleotide
gacatccagctgacccagtctccatcctccctgtctgcatctgtaggagacagagtcaccatcacttgccgggcaagtcaggacattagaaatgatttaggctggtatcagcagaggccagggaaagcccctaagcgcctgatctatcctgcatccagtttgctaagtggggtcccatcaaggttcagcggcagtggatctgggacagaattcactctcacaatcagcagcctgcagcctgaagattttgcaacttactactgtctacaggataatagttacccattcactttcggccctgggaccaaagtggatagcaaa

SEQ ID NO: 25534 - protein, 107 aa, Artificial Sequence
  Description of Artificial Sequence: Synthetic polypeptide
DIQLTQSPSSLSASVGDRVTITCRASQDIRNDLGWYQQRPGKAPKRLIYPASSLLSGVPSRFSGSGSGTEFTLTISSLQPEDFATYYCLQDNSYPFTFGPGTKVDSK

SEQ ID NO: 25535 - DNA, 321 bp, Artificial Sequence
  Description of Artificial Sequence: Synthetic polynucleotide
gacatccagatgacccagtctccatcctccctgtctgtatctgtaggagacagagtcaccatcacttgccgggcaagtcagggcattagaaatgctttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccattcactttcggccctgggaccaaagtggatatcaaa

SEQ ID NO: 25536 - protein, 107 aa, Artificial Sequence
  Description of Artificial Sequence: Synthetic polypeptide
DIQMTQSPSSLSVSVGDRVTITCRASQGIRNALGWYQQKPGKAPKRLIYAASSLQSGVPSRFSGSGSGTEFTLTISSLQPEDFATYYCLQHNSYPFTFGPGTKVDIK

SEQ ID NO: 25537 - DNA, 321 bp, Artificial Sequence; identical to SEQ ID NO: 25495
  Description of Artificial Sequence: Synthetic polynucleotide

SEQ ID NO: 25538 - protein, 107 aa, Artificial Sequence; identical to SEQ ID NO: 25496
  Description of Artificial Sequence: Synthetic polypeptide

SEQ ID NO: 25539 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcagcttagcctggtaccagcagaaacctggccaggctcccaggctcctcatctatggtgcatccaccagggccactggtttcccagccaggttcaatggcagtgggtcttggacagaattcactctcaccatcagcagcctgcagtctgaagattttgcaatttattactgtcagcagtataatgactggccgtgcagttttggccaggggaccaagctggagatcaaa

SEQ ID NO: 25540 - protein, 107 aa, Artificial Sequence
  Description of Artificial Sequence: Synthetic polypeptide
EIVMTQSPATLSVSPGERATLSCRASQSVSSSLAWYQQKPGQAPRLLIYGASTRATGFPARFNGSGSWTEFTLTISSLQSEDFAIYYCQQYNDWPCSFGQGTKLEIK

SEQ ID NO: 25541 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatctgcagaaaccagggaaagcccctaagcgcctgatctatgctgcatccagtttgctaagtggggtcccatcaaggttcagcggcagtggatctgggacagaattcactctcacaatcagcagcctgcagcctgaagattttgcaacttattactgtctacagcataatagttacccattcactttcggccctgggaccaaagtggatatcaaa

SEQ ID NO: 25542 - protein, 107 aa, Artificial Sequence
  Description of Artificial Sequence: Synthetic polypeptide
DIQMTQSPSSLSASVGDRVTITCRASQGIRNDLGWYLQKPGKAPKRLIYAASSLLSGVPSRFSGSGSGTEFTLTISSLQPEDFATYYCLQHNSYPFTFGPGTKVDIK

SEQ ID NO: 25543 - DNA, 321 bp, Artificial Sequence
  Description of Artificial Sequence: Synthetic polynucleotide
gacatccagatgacccagtctccatcttccgtgtctgcatctgtaggagacagagtctccatcacttgtcgggcgagtcaggatattagcaactggttagcctggtatcagcagaaaccagggaaagcccctaagctcctgatctatgctgcatccagtttgcaaagtggggtcccatcaaggttcagcggcagtggttctgggacagatttcactctcaccatcagcagcctgcagcctgaagattttgcaacttactcttgtcaacagggtaacagtttcccattcactttcggccctgggaccaaagtggatatcaaa

SEQ ID NO: 25544 - protein, 107 aa, Artificial Sequence
  Description of Artificial Sequence: Synthetic polypeptide
DIQMTQSPSSVSASVGDRVSITCRASQDISNWLAWYQQKPGKAPKLLIYAASSLQSGVPSRFSGSGSGTDFTLTISSLQPEDFATYSCQQGNSFPFTFGPGTKVDIK

SEQ ID NO: 25545 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggtcattagaaatgatttaggctggtatcagcagaagccagggaaagcccctaagcgcttgatctatgctgcatccagtttgcaaagtggggtcccatcaaggttcagcggcagtggatctgggacagaattcactctcacaatcagcagcctgcagcctgaagattttgcaacttatcactgtctacagtatggtagtttcccattcactttcggccctgggaccaaagtggatatcaaa

SEQ ID NO: 25546 - protein, 107 aa, Artificial Sequence
  Description of Artificial Sequence: Synthetic polypeptide
DIQMTQSPSSLSASVGDRVTITCRASQVIRNDLGWYQQKPGKAPKRLIYAASSLQSGVPSRFSGSGSGTEFTLTISSLQPEDFATYHCLQYGSFPFTFGPGTKVDIK

SEQ ID NO: 25547 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaggtggttagcctggtatcagcagaaaccagggaaagcccctaacctcctgatctatgctgcatccaatttgcaaagtggggtcccatcaaggttcagcggcagtggatctgggacagatttcactctcaccatcagcagcctgcagcctgaagattttgcaacttactattgtcaacaggctaacagtttcccattcactttcggccctgggaccaaagtagatatcaaa

SEQ ID NO: 25548 - protein, 107 aa, Artificial Sequence
  Description of Artificial Sequence: Synthetic polypeptide
DIQMTQSPSSVSASVGDRVTITCRASQGISRWLAWYQQKPGKAPNLLIYAASNLQSGVPSRFSGSGSGTDFTLTISSLQPEDFATYYCQQANSFPFTFGPGTKVDIK

SEQ ID NO: 25549 - DNA, 321 bp, Artificial Sequence
  Description of Artificial Sequence: Synthetic polynucleotide
gaaatagtgatgacgcagtctccagccatcctgtctgtgtttccaggggaaagagccaccctctcctgcagggccagtcagagtgttagcagcgacttagcctggtaccagcagaaacctggccaggctcccaggctcctcatctatggtgcatccaccagggccactggtatgccagccaggttcagtggcggtgggtctgggacagagttcactctcaccatcagcagcctgcagtctgaacattttgcagtttattactgtcagcagtatagtaactggccattcactttcggccctgggaccaaagtggatatcaaa

SEQ ID NO: 25550 - protein, 107 aa, Artificial Sequence
  Description of Artificial Sequence: Synthetic polypeptide
EIVMTQSPAILSVFPGERATLSCRASQSVSSDLAWYQQKPGQAPRLLIYGASTRATGMPARFSGGGSGTEFTLTISSLQSEHFAVYYCQQYSNWPFTFGPGTKVDIK

SEQ ID NO: 25551 - DNA, 324 bp, Artificial Sequence; identical to SEQ ID NO: 25511
  Description of Artificial Sequence: Synthetic polynucleotide

SEQ ID NO: 25552 - protein, 108 aa, Artificial Sequence; identical to SEQ ID NO: 25512
  Description of Artificial Sequence: Synthetic polypeptide

SEQ ID NO: 25553 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaactggttagcctggtatcagcagaaaccagggaaagcccctaagctcctgatctatactgcatccagtttgcaaagtggggtcccatcaaggttcagcggcaatgaatctgggacagatttcactctcaccatcagcagcctgcagcctgaagattttgcaacttactattgtcaacaggctaacagtttcccgtggacgttcggccaagggaccaaggtggaaatcaaa

SEQ ID NO: 25554 - protein, 107 aa, Artificial Sequence
  Description of Artificial Sequence: Synthetic polypeptide
DIQMTQSPSSVSASVGDRVTITCRASQGISNWLAWYQQKPGKAPKLLIYTASSLQSGVPSRFSGNESGTDFTLTISSLQPEDFATYYCQQANSFPWTFGQGTKVEIK

SEQ ID NO: 25555 - DNA, 339 bp, Artificial Sequence
  Description of Artificial Sequence: Synthetic polynucleotide
gacatcgtgatgacccagtctccagactccctgactgtgtctctgggcgagagggccaccatcaactgcaagtccagccaaagtgttttacacagctccaacaattataactacttagcttggtaccagcagagaccaggacagcctcctaagctggtcatttactgggcatctacccgggcatccggggtccctgaccgattcagtggcagcgggtctgggacagatttcactctcaccatcagcagcctgcaggctgaagatatggcagtttattactgtcagcaatattatagtactccgtggacgttcggccaagggaccaaggtggaattcaaa

SEQ ID NO: 25556 - protein, 113 aa, Artificial Sequence
  Description of Artificial Sequence: Synthetic polypeptide
DIVMTQSPDSLTVSLGERATINCKSSQSVLHSSNNYNYLAWYQQRPGQPPKLVIYWASTRASGVPDRFSGSGSGTDFTLTISSLQAEDMAVYYCQQYYSTPWTFGQGTKVEFK

SEQ ID NO: 25557 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttattcagctccaacaattacaattacttagcttggtaccagcagaaaacaggacagcctcccaagctgatcatttactgggcatctacccgggaatccggggtccctgaccgattcagtggcagcgggtctgggacagatttcactctcaccatcagcagcctgcaggctgaagatgtggcaatttattactgtcagcaatattatagtaatccgtgtagttttggccaggggaccaagctggagatcaaa

SEQ ID NO: 25558 - protein, 113 aa, Artificial Sequence
  Description of Artificial Sequence: Synthetic polypeptide
DIVMTQSPDSLAVSLGERATINCKSSQSVLFSSNNYNYLAWYQQKTGQPPKLIIYWASTRESGVPDRFSGSGSGTDFTLTISSLQAEDVAIYYCQQYYSNPCSFGQGTKLEIK

SEQ ID NO: 25559 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgctgcatctaccagggccactggtatcccagccaggttcagtggcagtgggtctgggacagagttcactctcaccatcagcagcctgcagtctgaagattttgcagtttattactgtcagcagtatgataactggccattcactttcggccctgggaccaaagtggataacaag

SEQ ID NO: 25560 - protein, 107 aa, Artificial Sequence
  Description of Artificial Sequence: Synthetic polypeptide
EIVMTQSPATLSVSPGERATLSCRASQSVSSDLAWYQQKPGQAPRLLIYAASTRATGIPARFSGSGSGTEFTLTISSLQSEDFAVYYCQQYDNWPFTFGPGTKVDNK

SEQ ID NO: 25561 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcgacttagcctggtaccagcagagacctggccaggctcccaggctcctcatctatgctgcatctaccagggccactggtatcccagccaggttcagtggcagtgggtctgggacagagttcactctcaccatcagcagcctgcagtctgaggattttgcagtttattactgtcagcagtttaataactggccattcactttcggccctgggaccaaagtggatatcaaa

SEQ ID NO: 25562 - protein, 107 aa, Artificial Sequence
  Description of Artificial Sequence: Synthetic polypeptide
EIVMTQSPATLSVSPGERATLSCRASQSVSSDLAWYQQRPGQAPRLLIYAASTRATGIPARFSGSGSGTEFTLTISSLQSEDFAVYYCQQFNNWPFTFGPGTKVDIK

SEQ ID NO: 25563 - DNA, 321 bp, Artificial Sequence
  Description of Artificial Sequence: Synthetic polynucleotide
gacatccagatgacccagtctccatcctccctgtctgcatctgtaggggacagagtcaccatcacttgccgggcaagtcagggcattagaaatgatttaggctggtttctgcagacaccagggaaagcccctaagcgcctgatctatgctgcatccagtttgctaagtggggtcccatcacggttcggcggcagtggatctgggacagaattcactctcacaatcagcagcctgcagcctgaagattttgcaacttattactgtctacagcataatagttacccattcactttcggccctgggaccaaagtggagatcaaa

SEQ ID NO: 25564 - protein, 107 aa, Artificial Sequence
  Description of Artificial Sequence: Synthetic polypeptide
DIQMTQSPSSLSASVGDRVTITCRASQGIRNDLGWFLQTPGKAPKRLIYAASSLLSGVPSRFGGSGSGTEFTLTISSLQPEDFATYYCLQHNSYPFTFGPGTKVEIK

SEQ ID NO: 25565 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccggccagagtattttatacagctccaacaataacaactacttagcttggtaccagcagaaaccaggacagcctcctaagaaactcatttactgggcatctacccgggattccggggtccctgcccgattcagtggcagcgggtctgggacagatttcactctcaccatcagcagcctgcaggctgaagatgtggcagtttattactgtcagcaatattatagtactcctccgacgttcggccaagggtccaaggtggaaatcaaa

SEQ ID NO: 25566 - protein, 113 aa, Artificial Sequence
  Description of Artificial Sequence: Synthetic polypeptide
DIVMTQSPDSLAVSLGERATINCKSGQSILYSSNNNNYLAWYQQKPGQPPKKLIYWASTRDSGVPARFSGSGSGTDFTLTISSLQAEDVAVYYCQQYYSTPPTFGQGSKVEIK

SEQ ID NO: 25567 - DNA, 321 bp, Artificial Sequence
  Description of Artificial Sequence: Synthetic polynucleotide
gaaatagtgatgacgcagtctccagccaccctgtctgtgtgtccaggggaaagagccaccctctcctgcagggccagtcagagtgttagcagctccttagcctggtaccagcagaaacctggccaggctcccaggctcctcatctatggtgcatccaccagggccactggtatcccagccaggttcagtggcagtgggtctgggacagaattcactctcaccatcagcagcctgcagtctgaagattttgcagtttattactgtcagcagtataataactggccattcactttcggccctgggaccaaagtggatatcaaa

SEQ ID NO: 25568 - protein, 107 aa, Artificial Sequence
  Description of Artificial Sequence: Synthetic polypeptide
EIVMTQSPATLSVCPGERATLSCRASQSVSSSLAWYQQKPGQAPRLLIYGASTRATGIPARFSGSGSGTEFTLTISSLQSEDFAVYYCQQYNNWPFTFGPGTKVDIK

SEQ ID NO: 25569 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaagtgatttagactggtatcagcagaaaccagggaaagcccctaagcgcctgatctatgctgcatccagtttgcaaagtggggtcccatcaaggttcagcggcagtggatctgggacagaattcactctcgcaatcagcagcctgcggcctgaagattttgcaacttattactgtctccagcataataatttcccattcactttcggccctgggaccaaggtggatatcaaa

SEQ ID NO: 25570 - protein, 107 aa, Artificial Sequence
  Description of Artificial Sequence: Synthetic polypeptide
DIQMTQSPSSLSASVGDRVTITCRASQGIRSDLDWYQQKPGKAPKRLIYAASSLQSGVPSRFSGSGSGTEFTLAISSLRPEDFATYYCLQHNNFPFTFGPGTKVDIK

SEQ ID NO: 25571 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcgacttagtctggtaccagcagaaacctggccaggctcccaggctcctcatctatggtgtatccaccagggccactggtatcccagccaggttcagtggcagtgggtctgggacagagttcactctcaccatcagcagcctgcagtctgaagattttgcagtttattactgtcagcagtataataactggccattcactttcggccctgggaccaaagtggatatcaaa

SEQ ID NO: 25572 - protein, 107 aa, Artificial Sequence
  Description of Artificial Sequence: Synthetic polypeptide
EIVMTQSPATLSVSPGERATLSCRASQSVSSDLVWYQQKPGQAPRLLIYGVSTRATGIPARFSGSGSGTEFTLTISSLQSEDFAVYYCQQYNNWPFTFGPGTKVDIK

SEQ ID NO: 25573 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatagtgagggaaagacctatttgtattggtacgtgcagaagccaggccagcctccacaactcctgatctatgaagtttcctatcggttttctggagtgccagataggttcagtggcagcgggtcagggacagatttcacactgaaaatcagccgggtggaggctgaggatgttggggtttattactgcatgcaaagtatacagcttccgctcactttcggcggagggaccaaggtggagatcaaa

SEQ ID NO: 25574 - protein, 112 aa, Artificial Sequence
  Description of Artificial Sequence: Synthetic polypeptide
DIVMTQTPLSLSVTPGQPASISCKSSQSLLHSEGKTYLYWYVQKPGQPPQLLIYEVSYRFSGVPDRFSGSGSGTDFTLKISRVEAEDVGVYYCMQSIQLPLTFGGGTKVEIK

SEQ ID NO: 25575 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaataacaactacttagcttggtaccagcagagaccaggacagcctcctaagttgctcatttactggtcatctacccgggaatccggggtccctgaccgattcagtggcagcgggtctgggacagatttcactctcaccatcagcagcctgcaggctgaagatgtggcagtttattactgtcagcaatattttagtattccgtgcagttttggccaggggaccaagctggagatcaaa

SEQ ID NO: 25576 - protein, 113 aa, Artificial Sequence
  Description of Artificial Sequence: Synthetic polypeptide
DIVMTQSPDSLAVSLGERATINCKSSQSVLYSSNNNNYLAWYQQRPGQPPKLLIYWSSTRESGVPDRFSGSGSGTDFTLTISSLQAEDVAVYYCQQYFSIPCSFGQGTKLEIK

SEQ ID NO: 25577 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgctgggccagtcagagtgtttacagcagcttcttagcctggttccagcagaaatctggccaggctcccaggctcctcatctatggtgcatccagcagggccactggcatcccagacaggttcagtggcagtgggtctgggacagacttcactctcaccatcagcagactggagcctgaagattttgcagtgttttactgtcagcaatatggtacctcaccgtggacgttcggccaagggaccaaggtggaaatcaaa

SEQ ID NO: 25578 - protein, 108 aa, Artificial Sequence
  Description of Artificial Sequence: Synthetic polypeptide
EIVLTQSPGTLSLSPGERATLSCWASQSVYSSFLAWFQQKSGQAPRLLIYGASSRATGIPDRFSGSGSGTDFTLTISRLEPEDFAVFYCQQYGTSPWTFGQGTKVEIK

SEQ ID NO: 25579 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattatcagctatttaaattggtatcagcagaaaccagggaaagcccctaaactcctgatctatggtgcatccagtttgcagagtggggtcccatcaaggttcagtggcagtggatccgggacagatttcactctcaccatcagcagtctgcaacctgaagattttgcaacttactactgtcaacagagttacagtacccctatgttcagttttggccaggggaccaagctggagatcaaa

SEQ ID NO: 25580 - protein, 108 aa, Artificial Sequence
  Description of Artificial Sequence: Synthetic polypeptide
DIQMTQSPSSLSASVGDRVTITCRASQSIISYLNWYQQKPGKAPKLLIYGASSLQSGVPSRFSGSGSGTDFTLTISSLQPEDFATYYCQQSYSTPMFSFGQGTKLEIK

SEQ ID NO: 25581 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcatctacttagcctggttcctgcagaaacctggccaggctcccaggctcctcatctatggtgcatccagcagggccactggcatcccagacaggttcagtggcagtgggtctgggacagacttcactctgaccatcagcagactggagcctgaagattttgcagtgtattactgtcaccagtatggtaactcaccattcactttcggccctgggaccaaagtggatttcaaa

SEQ ID NO: 25582 - protein, 108 aa, Artificial Sequence
  Description of Artificial Sequence: Synthetic polypeptide
EIVLTQSPGTLSLSPGERATLSCRASQSVSSIYLAWFLQKPGQAPRLLIYGASSRATGIPDRFSGSGSGTDFTLTISRLEPEDFAVYYCHQYGNSPFTFGPGTKVDFK

SEQ ID NO: 25583 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccagggtggagatcaaa

SEQ ID NO: 25584 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTRVEIK

SEQ ID NO: 25585 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctattctgcatccagtttacaaagtggggtcccatcaaggttcagcggcagtggatctgggacagaattcactctcacaatcagcagcctgcagcctgaagattttgcaacttattactgtctacagcataatagttacccgtggacgttcggccaagggaccaaggtggaaatcaaa

SEQ ID NO: 25586 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYSASSLQSGVPSRFSGSGSGTEFTLTISSLQPEDFATYYCLQHNSYPWTFGQGTKVEIK

SEQ ID NO: 25587 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttacttctgtcaacagagtttcagtaattcgatcaccttcggccaagggacacgactggagattaaa

SEQ ID NO: 25588 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYFCQQSFSNSITFGQGTRLEIK

SEQ ID NO: 25589 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatttaggctggtatcagcagcacccagggaaagcccctaagcgcctgatctatgctgcatccagtttacaaagtggggtcccatcaaggttcagcggcactagatctgggacagaattcactctcacaatcagcagcctgcagcctgaagattttgcaacttattactgtctacagcataatagttacccgtggacgttcggccaagggaccaaggtggaaatcaaa

SEQ ID NO: 25590 - protein, 107 aa, Artificial Sequence
  Description of Artificial Sequence: Synthetic polypeptide
DIQMTQSPSSLSASVGDRVTITCRASQDIRNDLGWYQQHPGKAPKRLIYAASSLQSGVPSRFSGTRSGTEFTLTISSLQPEDFATYYCLQHNSYPWTFGQGTKVEIK

SEQ ID NO: 25591 - DNA, 339 bp, Artificial Sequence
  Description of Artificial Sequence: Synthetic polynucleotide
gacatcgtgatgacccagtttccagactccctggctgtgtctctgggcgagagggccaccatcaactgcaagtccagccagactgttttatacaggtccaacaattacaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattttagtactcctccgacgttcggccaagggaccaaggtggaaatcaaa

SEQ ID NO: 25592 - protein, 113 aa, Artificial Sequence
  Description of Artificial Sequence: Synthetic polypeptide
DIVMTQFPDSLAVSLGERATINCKSSQTVLYRSNNYNYLAWYQQKPGQPPKLLIYWASTRESGVPDRFSGSGSGTDFTLTISSLQAEDVAVYYCQQYFSTPPTFGQGTKVEIK

SEQ ID NO: 25593 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattttcagctatttaaattggtatcagcagaatccggggaaagcccctaagctcctgatctatgcgtcatccagtttgcaaagtggggtcccatcaaggttaagtggcaatggatctgggacagatttcattctcaccatcagcagtctgcaacctgaagattttgcaacttactactgtcaacagagttacagtaccccattcactttcggccctgggaccagagtggatatcaaa

SEQ ID NO: 25594 - protein, 107 aa, Artificial Sequence
  Description of Artificial Sequence: Synthetic polypeptide
DIQMTQSPSSLSASVGDRVTITCRASQSIFSYLNWYQQNPGKAPKLLIYASSSLQSGVPSRLSGNGSGTDFILTISSLQPEDFATYYCQQSYSTPFTFGPGTRVDIK

SEQ ID NO: 25595 - DNA, 321 bp, Artificial Sequence
  Description of Artificial Sequence: Synthetic polynucleotide
gacatccagatgacccagtctccatcctccctgtctgcatctgtaggagacagagtcatcatctcttgccgggcaagtcagagcattttcagctatttaaattggtatcaggtgaaaccagggaaagcccctaagctcctgatctatgatacatccactttgcaaactggggtcccatcaaggttcagtggcagtggatctgggacagatttcactctcaccatcaacagtctgcaacctgaagattttgcaacttactactgtcaacagagttacggtatccccatcaccttcggccaagggacacgactggagattcaa

SEQ ID NO: 25596 - protein, 107 aa, Artificial Sequence
  Description of Artificial Sequence: Synthetic polypeptide
DIQMTQSPSSLSASVGDRVIISCRASQSIFSYLNWYQVKPGKAPKLLIYDTSTLQTGVPSRFSGSGSGTDFTLTINSLQPEDFATYYCQQSYGIPITFGQGTRLEIQ

SEQ ID NO: 25597 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccataagtccctgatctatgctgcatccagtttgcaaagtggggtcccatcaaagttcagcggcagtggatctgggacagatttcactctcaccatcagcagcctgcagcctgaagattttgcaacttattactgccaacaatatcatagttacccattcactttcggccctgggaccaaagtggatatcaga

SEQ ID NO: 25598 - protein, 107 aa, Artificial Sequence
  Description of Artificial Sequence: Synthetic polypeptide
DIQMTQSPSSLSASVGDRVTITCRASQGISNYLAWFQQKPGKAHKSLIYAASSLQSGVPSKFSGSGSGTDFTLTISSLQPEDFATYYCQQYHSYPFTFGPGTKVDIR

SEQ ID NO: 25599 - DNA, 321 bp, Artificial Sequence
  Description of Artificial Sequence: Synthetic polynucleotide
gacatccagatgacccagtctccatcttccgtgtctgcatctgtcggagacagagtcaccatcacttgtcgggcgagtcagggtattagcagctggttagcctggtatcagcagaaaccagggaaagcccctaacctcctgatctatgctgcatccagtttgcaaagtggggtcccatcaaggttcagcggcagtggatctgggacagatttcacgctcaccatcagcggcctgcagcctgaagattttgcaacttacttttgtcaacagattaacagtttccctctcactttcggcggagggaccaaggtggcgatcaaa

SEQ ID NO: 25600 - protein, 107 aa, Artificial Sequence
  Description of Artificial Sequence: Synthetic polypeptide
DIQMTQSPSSVSASVGDRVTITCRASQGISSWLAWYQQKPGKAPNLLIYAASSLQSGVPSRFSGSGSGTDFTLTISGLQPEDFATYFCQQINSFPLTFGGGTKVAIK

SEQ ID NO: 25601 - DNA, 321 bp, Artificial Sequence
  Description of Artificial Sequence: Synthetic polynucleotide
gacatccagatgacccagtctccgtcctccctgtctacatctgtaggagacagagtcaccatcacttgccgggcaagtcagagcattttcagctatttacattggtatcagcagaaaccagggaaagcccctaagctcctgatctctgctgcatccagtttacaaagtggggtcccatcaaggttcagtggcagtggatctgggacagatttcactctcaccatcagtagtctgcaacctgaagattttgcaactttctactgtcaacagacttacagtcccccgctcactttcggcggagggaccaaggtggagatcaaa

SEQ ID NO: 25602 - protein, 107 aa, Artificial Sequence
  Description of Artificial Sequence: Synthetic polypeptide
DIQMTQSPSSLSTSVGDRVTITCRASQSIFSYLHWYQQKPGKAPKLLISAASSLQSGVPSRFSGSGSGTDFTLTISSLQPEDFATFYCQQTYSPPLTFGGGTKVEIK

SEQ ID NO: 25603 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcacggttcagcggcagtaaatctgggacagaattcactctcacaatcagcagcttgcagcctgaagatcttgcaacttattactgtctacagcataatagttacccgctcactttcggcggagggaccaaggtggagatcaaa

SEQ ID NO: 25604 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSKSGTEFTLTISSLQPEDLATYYCLQHNSYPLTFGGGTKVEIK

SEQ ID NO: 25605 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaaacgcctgatctatgctgcatccagtttgcaaagtggggtcccatcaaggttcagcggcagtggatctgggacagaattcactctcacaatcagcagcctacagcctgaagatcttgcaacttattactgtctacagcattatagttaccctcggacgttcggccaagggaccaaggtggaaatcaaa

SEQ ID NO: 25606 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDLATYYCLQHYSYPRTFGQGTKVEIK

SEQ ID NO: 25607 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacattaagaaatatttaaattggtatcagcagaaaccagggaaagcccctaagttcctgatctatggtgcatccagtttgcaaagtggggtcccatcaaggttcagtggcagtggatctgggacagatttcactctcaccatcagtagtctgcaacctgaagattttgcagcttactactgtcaacagagttacaatatttcgttcactttcggcggagggaccaaggtggagctcaaa

SEQ ID NO: 25608 - protein, 107 aa, Artificial Sequence
  Description of Artificial Sequence: Synthetic polypeptide
DIQMTQSPSSLSASVGDRVTITCRASQNIKKYLNWYQQKPGKAPKFLIYGASSLQSGVPSRFSGSGSGTDFTLTISSLQPEDFAAYYCQQSYNISFTFGGGTKVELK

SEQ ID NO: 25609 - DNA, 321 bp, Artificial Sequence
  Description of Artificial Sequence: Synthetic polynucleotide
gacatccagatgacccagtctccatcctccctgtctgcagctgtaggagacagagtcaccatcacttgccgggcaagtcagggcattagaaatgatttaggctggtatcagcagaaaccagggaaagcccctaagtgcctgatctatgctgcatccagtttgcaaagtggggtcccatcaaggttcagcggcagtggatctgggacagaattcactctcacaatcagcagcctgcagcctgaagattttgcaacttattattgtctacaccattatagttaccctcggacgttcggccaagggaccaaggtggaaatcaaa

SEQ ID NO: 25610 - protein, 107 aa, Artificial Sequence
  Description of Artificial Sequence: Synthetic polypeptide
DIQMTQSPSSLSAAVGDRVTITCRASQGIRNDLGWYQQKPGKAPKCLIYAASSLQSGVPSRFSGSGSGTEFTLTISSLQPEDFATYYCLHHYSYPRTFGQGTKVEIK

SEQ ID NO: 25611 - DNA, 336 bp, Artificial Sequence
  Description of Artificial Sequence: Synthetic polynucleotide
gaaattgtgatgacccagactccactctctctgtccgtcacccctggacagccggcctccatctcctgcaagtctagtcagagcctccttcatggtgatggaaagacctatttgttttggtacctgcagaagccaggccagcctccacaggtcctgatctatgaagtttccaaccggttgtgtggagtgccagacaggttcagtggcagcgggtcagggacagatttctcattgaaaatcagccgggtggaggctgaggacgttggggtttattactgcatgcaaagtatacaggttccgtggacgttcggccaagggaccaaggtggaaatcaca

SEQ ID NO: 25612 - protein, 112 aa, Artificial Sequence
  Description of Artificial Sequence: Synthetic polypeptide
EIVMTQTPLSLSVTPGQPASISCKSSQSLLHGDGKTYLFWYLQKPGQPPQVLIYEVSNRLCGVPDRFSGSGSGTDFSLKISRVEAEDVGVYYCMQSIQVPWTFGQGTKVEIT

SEQ ID NO: 25613 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagctggttagcctggtatcagcagaaaccagggaaagcccttaagctcttgatctatgctgcatccagtttgcaaagtggggtcccatcaaggttcagcggcagtggatctgggacagatttcactctcaccatcagcagcctgcagcctgaagattttgcaacttactattgtcaacagattaacagtttccctctcactttcggcggagggaccaaggtggagatcaaa

SEQ ID NO: 25614 - protein, 107 aa, Artificial Sequence
  Description of Artificial Sequence: Synthetic polypeptide
DIQMTQSPSSVSASVGDRVTITCRASQGISSWLAWYQQKPGKALKLLIYAASSLQSGVPSRFSGSGSGTDFTLTISSLQPEDFATYYCQQINSFPLTFGGGTKVEIK

SEQ ID NO: 25615 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctacacgcctgatctatactgcatccactttgcaaagtggggtcccatcaaggttcagcggcagtggatctgggacagaattcactctcacaatcagcagcctgcagcctgaagattttgcaacttattactgtctacagcataatggttacccattcactttcggccctgggaccaaagtggatatcaaa

SEQ ID NO: 25616 - protein, 107 aa, Artificial Sequence
  Description of Artificial Sequence: Synthetic polypeptide
DIQMTQSPSSLSASVGDRVTITCRASQGIRNDLGWYQQKPGKAPTRLIYTASTLQSGVPSRFSGSGSGTEFTLTISSLQPEDFATYYCLQHNGYPFTFGPGTKVDIK

SEQ ID NO: 25617 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcgagtcaggacattagcaattatttaaattggtatcagcagaaaccagggacagcccctaacctcctgatctctgatgcatccattttggaaacaggggtcccatcaacgttcagtggaagtggatctgggacagattttactttcaccatcagcagcctgcagcctgaagatattgcaacatattactgtcaacagagtgataatctcccgtgcagttttggccaggggaccaaggtggagatcaaa

SEQ ID NO: 25618 - protein, 107 aa, Artificial Sequence
  Description of Artificial Sequence: Synthetic polypeptide
DIQMTQSPSSLSASVGDRVTITCRASQDISNYLNWYQQKPGTAPNLLISDASILETGVPSTFSGSGSGTDFTFTISSLQPEDIATYYCQQSDNLPCSFGQGTKVEIK

SEQ ID NO: 25619 - DNA, 321 bp, Artificial Sequence
  Description of Artificial Sequence: Synthetic polynucleotide
gacatccagatgacccagtctccctcttccgtgtctgcatctgtaggagacagagtcaccatcacttgtcgggcgagtcagaatattaccacctggttagcctggtatcagcagaaaccagggaaagcccctaaactcctgatctctgctgcatccagtttgcaaagtggggtcccatcaaggttcagcggcagtggatctgggacagatttcactctcaccatcagcagcctgcagcctgaagattttgcaacttatatttgtcaacaggctaacagttttccattcactttcggccctgggaccaaactggatatcaaa

SEQ ID NO: 25620 - protein, 107 aa, Artificial Sequence
  Description of Artificial Sequence: Synthetic polypeptide
DIQMTQSPSSVSASVGDRVTITCRASQNITTWLAWYQQKPGKAPKLLISAASSLQSGVPSRFSGSGSGTDFTLTISSLQPEDFATYICQQANSFPFTFGPGTKLDIK

SEQ ID NO: 25621 - DNA, 321 bp, Artificial Sequence
  Description of Artificial Sequence: Synthetic polynucleotide
gacatccagttgacccagtctccatcctccctgtctgcatctgtaggagacagagtcaccatcacttgccgggcgagtcaggtcattagcagttatttacattggtatcagcagaaaccagggaaagttcctaaggtcctgatctatagtgcatccaatttgcaatgtggagtcccatctcggttcagcggcagtggatctgggacagatttcactctcaccttcagcagcctgcagcctgaagatgttgcaacttattacggtcaacggccttacaatgccccgctcactttcggcggagggaccaaggtggagatcaaa

SEQ ID NO: 25622 - protein, 107 aa, Artificial Sequence
  Description of Artificial Sequence: Synthetic polypeptide
DIQLTQSPSSLSASVGDRVTITCRASQVISSYLHWYQQKPGKVPKVLIYSASNLQCGVPSRFSGSGSGTDFTLTFSSLQPEDVATYYGQRPYNAPLTFGGGTKVEIK

SEQ ID NO: 25623 - DNA, 321 bp, Artificial Sequence
  Description of Artificial Sequence: Synthetic polynucleotide
gacatccagatgacccagtctccatcctccgtgtctgcatctgtaggagacagagtcaccatcacttgtcgggcgagtcagggtattagcagctggttagcctggtatcagcagaaaccagggaaagcccctaagctcttgatctatgctgcatccagtttgcaaagtggggtcccatcaaggttcagcggcagtggatctgggacagatttcactctcaccatcagcagcctgcagcctgaagattttgcaactttctattgtcaacaggttaacagtttccctctcactttcggcggagggaccaaggtggagatcaaa

SEQ ID NO: 25624 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATFYCQQVNSFPLTFGGGTKVEIK

SEQ ID NO: 25625 - DNA, 321 bp, Artificial Sequence
  Description of Artificial Sequence: Synthetic polynucleotide
gacatccagatgacccagtctccgtcctcactatctgcatctgtaggagacagagtcaccatcacttgtcgggcgagtcaggacattaacaattatttagcctggtttcagcagaaaccagggaaagcccctaggtccctaatttatgctgcatccagtttgcacagtggggtcccatcacagttcagcgccagtggttctgggtcagatttcactcttactatcagcagcctgcagcctgaagattttgcaacttattactgcccactgtataaaagttatccactcacttttggccctgggaccaaagtggatatcaaa

SEQ ID NO: 25626 - protein, 107 aa, Artificial Sequence
  Description of Artificial Sequence: Synthetic polypeptide
DIQMTQSPSSLSASVGDRVTITCRASQDINNYLAWFQQKPGKAPRSLIYAASSLHSGVPSQFSASGSGSDFTLTISSLQPEDFATYYCPLYKSYPLTFGPGTKVDIK

SEQ ID NO: 25627 - DNA, 321 bp, Artificial Sequence
  Description of Artificial Sequence: Synthetic polynucleotide
gaaatagtgatgacgcagtctccagtcaccctgtttgtgtctccaggggaaagagccaccctctcctgcagggccagtcagagtgttaacagcaacttagcctggtaccagcagaaacctggccaggctcccaggctcctcatctatggtgcatccaccagggccactggtatcccagccaggttcaatggcagtgggtctgggacagagttcactctcaccatcagcagcctgcagtctgaagattttgcagtttattattgtcagcagtataatgactggccgtgcagttttggcctggagaccaagctggagatcaaa

SEQ ID NO: 25628 - protein, 107 aa, Artificial Sequence
  Description of Artificial Sequence: Synthetic polypeptide
EIVMTQSPVTLFVSPGERATLSCRASQSVNSNLAWYQQKPGQAPRLLIYGASTRATGIPARFNGSGSGTEFTLTISSLQSEDFAVYYCQQYNDWPCSFGLETKLEIK

SEQ ID NO: 25629 - DNA, 321 bp, Artificial Sequence
  Description of Artificial Sequence: Synthetic polynucleotide
gacatccagatgacccagtctccatcctctctgtctgcatctgtaggagacagagtcaccatcacttgtcgggcgagtcaggacattagcacttatttagcctggtttcagcagaaaccagggaaagcccctaagtcactgatctatgctgcatccagtttgcaaagtggggtcccatcaaagttcagcggcagtggatctgggacagatttcactctcaccatcagtagcctgcagcctgaagattttgcaacttattactgccaacagtataatagtttccctctcactttcggcggagggaccaaggtggagatcaaa

SEQ ID NO: 25630 - protein, 107 aa, Artificial Sequence
  Description of Artificial Sequence: Synthetic polypeptide
DIQMTQSPSSLSASVGDRVTITCRASQDISTYLAWFQQKPGKAPKSLIYAASSLQSGVPSKFSGSGSGTDFTLTISSLQPEDFATYYCQQYNSFPLTFGGGTKVEIK

SEQ ID NO: 25631 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagctggttagcctggtatcagcagaaaccagggaaagcccttaagctcttgatctatgctgcatccagtttgcaaagtggggtcccatcaaggttcagcggcagtggatctgggacagatttcactctcaccatcagcagcctgcagcctgaagattttgcaacttactattgtcaacagactaacagtttccctctcactttcggcggagggaccaaggtggagatcaaa

SEQ ID NO: 25632 - protein, 107 aa, Artificial Sequence
  Description of Artificial Sequence: Synthetic polypeptide
DIQMTQSPSSVSASVGDRVTITCRASQGISSWLAWYQQKPGKALKLLIYAASSLQSGVPSRFSGSGSGTDFTLTISSLQPEDFATYYCQQTNSFPLTFGGGTKVEIK

SEQ ID NO: 25633 - DNA, 321 bp, Artificial Sequence
  Description of Artificial Sequence: Synthetic polynucleotide
gacatccagatgacccagtctccatcttccgtgtctgcatctgtaggggacagagtcaccatcacttgtcgggcgagtcagggtattagcagctggttagcctggtatcagcagaaaccagggaaagcccctaagctcttgatctatgctgcatccagtttgcaaagtggggtcccttcaaggttcagcggcagtggatctgggacagatttcactctcaccatcagcagcctgcagcctgaagattttgcaacttactattgtcaacagattaatagtttccctctcactttcggcggagggaccaaggtggagatcaaa

SEQ ID NO: 25634 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQINSFPLTFGGGTKVEIK

SEQ ID NO: 25635 - DNA, 321 bp, Artificial Sequence
  Description of Artificial Sequence: Synthetic polynucleotide
gacatccagttgacccagtctccatcctccctgtctgcatctgtaggagacagagtcaccatcactcgccgggcgagtcagggcattagcaattatttacattggtatcagcagaaaccagggaaagctcctaagctcttgatctattgtgcatccaatttacaatgtggagtcccatcacggttcagcggcagtggatctgggacagatttcactctcacaatcagcagcctgcagcctgaagatgttgcaacttattactgtcaacagcataataattccccgctcactttcggcggagggaccaaggtggagatcaaa

SEQ ID NO: 25636 - protein, 107 aa, Artificial Sequence
  Description of Artificial Sequence: Synthetic polypeptide
DIQLTQSPSSLSASVGDRVTITRRASQGISNYLHWYQQKPGKAPKLLIYCASNLQCGVPSRFSGSGSGTDFTLTISSLQPEDVATYYCQQHNNSPLTFGGGTKVEIK

SEQ ID NO: 25637 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacattttcagctatttaaattggtatcagcagaaaccagggaaagcccctaaactcctgatctttgctgcatccagtttacaaagtggggtcccatcaaggttcagtggcagtggatctgggacagatttcactctcaccatcagcagtctgcaacctgaggactttgcaacttactactgtcaacagacttacagtgtccctttcactttcggccctgggactaaggtggatttcaaa

SEQ ID NO: 25638 - protein, 107 aa, Artificial Sequence
  Description of Artificial Sequence: Synthetic polypeptide
DIQMTQSPSSLSASVGDRVTITCRASQNIFSYLNWYQQKPGKAPKLLIFAASSLQSGVPSRFSGSGSGTDFTLTISSLQPEDFATYYCQQTYSVPFTFGPGTKVDFK

SEQ ID NO: 25639 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgttttaggctggtatcagcagaaaccagggaaagcccctaagcgcctgatctatactgcatccagtttacaaagtggggtcccatcagggttcagcggcagtggatctgggacagaattcactctcacaatcagcagcctgcagcctgaagattttgcaacttattactgtctacagtataatagttacccattcactttcggccctgggaccaaagtggatatcaaa

SEQ ID NO: 25640 - protein, 107 aa, Artificial Sequence
  Description of Artificial Sequence: Synthetic polypeptide
DIQMTQSPSSLSASVGDRVTITCRASQDIRNVLGWYQQKPGKAPKRLIYTASSLQSGVPSGFSGSGSGTEFTLTISSLQPEDFATYYCLQYNSYPFTFGPGTKVDIK

SEQ ID NO: 25641 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggccattagaaatgatttaggctggtatcagcagaaaccagggaaagcccctaagcgcctgatctatcctgcatccagtttgcaaagtggggtcccatcaaggttcagcggcagtggatctgggacagaattcactctcacaatcagcagcctgcagcctgaagattttgcaacttattactgtctacagtataatagttaccctccgtggacgttcggccaagggtccaaggtggaaatcaaa

SEQ ID NO: 25642 - protein, 108 aa, Artificial Sequence
  Description of Artificial Sequence: Synthetic polypeptide
DIQMTQSPSSLSASVGDRVTITCRASQAIRNDLGWYQQKPGKAPKRLIYPASSLQSGVPSRFSGSGSGTEFTLTISSLQPEDFATYYCLQYNSYPPWTFGQGSKVEIK

SEQ ID NO: 25643 - DNA, 321 bp, Artificial Sequence
  Description of Artificial Sequence: Synthetic polynucleotide
gatatccagatgacccagtttccatcctcccagtctgcatctgtaggagacagagtcaccatcacttgccgggcaagtcagggcattagaaatgatttaggttggtatcagcagaaaccagggaaagcccataagcgcttgatctatgctgcatccagttgtcaaagtggggtcccatcaaggttcagcggcagtggatgtgggacagaattcactatctcaatcagcagcatgcagcgtgaagattttgcaacttattactgtatagtgcataatagttaccctcggacgttcggccaagggaccaaggtggaaatcaaa

SEQ ID NO: 25644 - protein, 107 aa, Artificial Sequence
  Description of Artificial Sequence: Synthetic polypeptide
DIQMTQFPSSQSASVGDRVTITCRASQGIRNDLGWYQQKPGKAHKRLIYAASSCQSGVPSRFSGSGCGTEFTISISSMQREDFATYYCIVHNSYPRTFGQGTKVEIK

SEQ ID NO: 25645 - DNA, 321 bp, Artificial Sequence
  Description of Artificial Sequence: Synthetic polynucleotide
gacatccagatgacccagtctccatcttccgtgtgtgcatctgtaggagacagagtcaccatcacttgtcgggagagtcagggtattagcatctggttagcctggtatcagcagaaaccagggaaagcccctaagcttttgatctatgctgcatccagtttgcaaagtggggtcccatcaaggttcagcggcagtggatatgggacagatttcactctcaccatcagcagcgtgcagcctgaagattttgcaacttactattgtcaacaggctaacagtttcccattcactttcggccctgggaccaaagtggatatcaaa

SEQ ID NO: 25646 - protein, 107 aa, Artificial Sequence
  Description of Artificial Sequence: Synthetic polypeptide
DIQMTQSPSSVCASVGDRVTITCRESQGISIWLAWYQQKPGKAPKLLIYAASSLQSGVPSRFSGSGYGTDFTLTISSVQPEDFATYYCQQANSFPFTFGPGTKVDIK

SEQ ID NO: 25647 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttaacagcaacttagcctggtaccagcagaaacctggccaggctcccaggctcctcatctctattgcatccaccagggccactggtatcccagccaggttcaatggcagtgggtctgggacagagttcactctcaccatcagcagcctgcagtctgaagattttgcagtttattactgtcagcagtataatgactggccgtgtagttttggccaggggaccaagctggagatcaaa

SEQ ID NO: 25648 - protein, 107 aa, Artificial Sequence
  Description of Artificial Sequence: Synthetic polypeptide
EIVMTQSPATLSVSPGERATLSCRASQSVNSNLAWYQQKPGQAPRLLISIASTRATGIPARFNGSGSGTEFTLTISSLQSEDFAVYYCQQYNDWPCSFGQGTKLEIK

SEQ ID NO: 25649 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagctggttagcctggtatcagcagaaaccagggaaagcccctaagctcttgatctatgctgcatccagtttgcaaagtggggtcccatcaaggttcagcggcagtggatctgggacagatttcactctcaccatcagcagcctgcagcctgaagattttgcaacttactattgtcaacagattaacagtttccctctcactttcggcggagggaccaaggtggagatcaaa

SEQ ID NO: 25650 - protein, 107 aa, Artificial Sequence; identical to SEQ ID NO: 25634
  Description of Artificial Sequence: Synthetic polypeptide

SEQ ID NO: 25651 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtttcagcagaaaccagggaaagcccctaagcgcctgatctatgctgcatccagtttgcaaagtggggtcccatcaaggttcagcggcagtggatctgggacagaattctctctcacaatcagcagcctgcagcctgaagattttgcaacttattactgtctacaccataatagttatccattcaaatttggccctgggaccaaagtggatatcaaa

SEQ ID NO: 25652 - protein, 107 aa, Artificial Sequence
  Description of Artificial Sequence: Synthetic polypeptide
DIQMTQSPSSLSASVGDRVTITCRASQGIRNDLGWFQQKPGKAPKRLIYAASSLQSGVPSRFSGSGSGTEFSLTISSLQPEDFATYYCLHHNSYPFKFGPGTKVDIK

SEQ ID NO: 25653 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagctattatttagcctggtttcagcagaaaccagggagagcccctaagtccctgatctatgttgcatccagtttgcaaagtggggtcccatcaaggttcagcggcagtggatctgggacagatttcactctcaccatcagcagcctgcagcctgaagattttgcaatttattactgccaacagtatgatagttacccattcactttcggccctgggaccaaagtggatatcaga

SEQ ID NO: 25654 - protein, 107 aa, Artificial Sequence
  Description of Artificial Sequence: Synthetic polypeptide
DIQMTQSPSSLSASVGDRVTITCRASQGISYYLAWFQQKPGRAPKSLIYVASSLQSGVPSRFSGSGSGTDFTLTISSLQPEDFAIYYCQQYDSYPFTFGPGTKVDIR

SEQ ID NO: 25655 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaataatttaggctggtatcagcagagaccagggaaagcccctaagcgcctgatctatgctgcatccagtgtgcaaagtggggtcccatcacggttcagcggcagtggatctgggacagaattcactctcacaatcagcagcctgcagcctgaagattttgcaacttattactgtctacagtataatagttacccattcactttcggccctgggaccaaagtggatatcaaa

SEQ ID NO: 25656 - protein, 107 aa, Artificial Sequence
  Description of Artificial Sequence: Synthetic polypeptide
DIQMTQSPSSLSASVGDRVTITCRASQGIRNNLGWYQQRPGKAPKRLIYAASSVQSGVPSRFSGSGSGTEFTLTISSLQPEDFATYYCLQYNSYPFTFGPGTKVDIK

SEQ ID NO: 25657 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggccagaattcactctctcaatcagcagcctgcagcctgaagattttgcaacttattactgtctacagcataatagttatccgttcactttcggcggagggaccaaggtggagatcaaa

SEQ ID NO: 25658 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGPEFTLSISSLQPEDFATYYCLQHNSYPFTFGGGTKVEIK

SEQ ID NO: 25659 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaagattcagcggcagtggatctgggacagaattcactctcacaatcagcagcctgcagcctgaagattttgcaacttattactgtctacagcatagtacttacccgctcactttcggcggagggaccaaggtggagatcaaa

SEQ ID NO: 25660 - protein, 107 aa, Artificial Sequence; identical to SEQ ID NO: 24464
  Description of Artificial Sequence: Synthetic polypeptide

SEQ ID NO: 25661 - DNA, 321 bp, Artificial Sequence
  Description of Artificial Sequence: Synthetic polynucleotide
gacatccagatgacccagtctccatcctccctgtctgcatctgtaggagacagagtcaccttcacttgccgggcaggtcagaccatttacaattatttaaattggtatcagcagaaaccagggaaagcccctaagctcctgatccatgttgcgtccagtttgcaaagtggggtcccatcaaggttcagtggcagtggatctgggacagatttcactctcgtcattagtagtctgcaacctgaagattttgcaacttactactgtcaacagagttacagtaccccattcactttcggccctgggaccaaagtggatatcaaa

SEQ ID NO: 25662 - protein, 107 aa, Artificial Sequence
  Description of Artificial Sequence: Synthetic polypeptide
DIQMTQSPSSLSASVGDRVTFTCRAGQTIYNYLNWYQQKPGKAPKLLIHVASSLQSGVPSRFSGSGSGTDFTLVISSLQPEDFATYYCQQSYSTPFTFGPGTKVDIK

SEQ ID NO: 25663 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtgttagcaggtggttagcctggtatcagcagaaaccagggaaagcccctaagctcctgatctatgctgcatccagtttgcaaagtggggtcccatcaaggttcagcggcagtggatctgggacagatttcactgtcaccatcagcagcctgcagcctgaagattttgcaacttactattgtcaacaggctaacagtttcccattcactttcggccctgggaccaaagtggatatcaaa

SEQ ID NO: 25664 - protein, 107 aa, Artificial Sequence
  Description of Artificial Sequence: Synthetic polypeptide
DIQMTQSPSSVSASVGDRVTITCRASQGVSRWLAWYQQKPGKAPKLLIYAASSLQSGVPSRFSGSGSGTDFTVTISSLQPEDFATYYCQQANSFPFTFGPGTKVDIK

SEQ ID NO: 25665 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttaacagcaacttagcctggtaccagctgaaacctggccaggctcccaggctcctcatctctattgcatccaccagggccactggtatcccaccccggttcaatggcagtgggtctgggacagagttcactctcaccatcagcagcctgcagtctgaagattttgcagtttattactgtcagcagtataatgactggccgtgtagttttggccaggggaccaagctggagatcaaa

SEQ ID NO: 25666 - protein, 107 aa, Artificial Sequence
  Description of Artificial Sequence: Synthetic polypeptide
EIVMTQSPATLSVSPGERATLSCRASQSVNSNLAWYQLKPGQAPRLLISIASTRATGIPPRFNGSGSGTEFTLTISSLQSEDFAVYYCQQYNDWPCSFGQGTKLEIK

SEQ ID NO: 25667 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaaatggttagcctggtatcagcagaatccagggaaagcccttaagctcttgatctttgctgcatccagtttgcaaagtggggtcccatcaaggttcagcggcagtggatctgggacagatttcactctcaccatcagcagcctccagcctgaagattttgcaaattactattgtcaacagactaacagtttccctctcactttcggcggagggaccaaggtggagatcaaa

SEQ ID NO: 25668 - protein, 107 aa, Artificial Sequence
  Description of Artificial Sequence: Synthetic polypeptide
DIQMTQSPSSVSASVGDRVTITCRASQGISKWLAWYQQNPGKALKLLIFAASSLQSGVPSRFSGSGSGTDFTLTISSLQPEDFANYYCQQTNSFPLTFGGGTKVEIK

SEQ ID NO: 25669 - DNA, 321 bp, Artificial Sequence
  Description of Artificial Sequence: Synthetic polynucleotide
gacatccagatgacccagtctccatcctccctgtctgcatctttaggagacagagtcaccatcacttgccggacaagtcagagcattttcaactatttaaattggtttcagcggaaaccagggaaagcccctaaggtcctgatctatactgcatccagtttgcaaagtgggatcccatcaaggttcagtggcagtggatctgggacagacttcactctcaccatcagcagtctgcaacctgaagattctgcaacttactactgtcaacagagttacagtatcccgctcactttcggcggagggaccaaggtggagatcaaa

SEQ ID NO: 25670 - protein, 107 aa, Artificial Sequence
  Description of Artificial Sequence: Synthetic polypeptide
DIQMTQSPSSLSASLGDRVTITCRTSQSIFNYLNWFQRKPGKAPKVLIYTASSLQSGIPSRFSGSGSGTDFTLTISSLQPEDSATYYCQQSYSIPLTFGGGTKVEIK

SEQ ID NO: 25671 - DNA, 339 bp, Artificial Sequence
  Description of Artificial Sequence: Synthetic polynucleotide
gacatcgtgatgacccagtctccagactccctggctgtgtctctgggcgagagggccaccctcaactgcaagtccagccagagtgttttatacagctccaacaataacaactacttggcttggtaccagcagaaaccaggacagcctcctaaactgctcatttactgggcatctacccgggaatccggggtccctgaccgattcagtggcagcgggtctgggacagatttcactctcactatcagcagcctgcaggctgaagatgtggcagtttattactgtcagcaatattataatattcctccgacgttcggccaagggaccaaggtggaaatcaaa

SEQ ID NO: 25672 - protein, 113 aa, Artificial Sequence
  Description of Artificial Sequence: Synthetic polypeptide
DIVMTQSPDSLAVSLGERATLNCKSSQSVLYSSNNNNYLAWYQQKPGQPPKLLIYWASTRESGVPDRFSGSGSGTDFTLTISSLQAEDVAVYYCQQYYNIPPTFGQGTKVEIK

SEQ ID NO: 25673 - DNA, 321 bp, Artificial Sequence
  Description of Artificial Sequence: Synthetic polynucleotide
gacatccagatgacccagtctccatcctccctgtctacatctgtcggagacagagtcaccatcacttgccgggcaagtcagggcattagaaaggatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatcgttacccgctcactttcggcggagggaccaaggtggagatcaaa

SEQ ID NO: 25674 - protein, 107 aa, Artificial Sequence
  Description of Artificial Sequence: Synthetic polypeptide
DIQMTQSPSSLSTSVGDRVTITCRASQGIRKDLGWYQQKPGKAPKRLIYAASSLQSGVPSRFSGSGSGTEFTLTISSLQPEDFATYYCLQHNRYPLTFGGGTKVEIK

SEQ ID NO: 25675 - DNA, 321 bp, Artificial Sequence
  Description of Artificial Sequence: Synthetic polynucleotide
gacatccaaatgacccagtctccatcttccgtgtctgcatctgtaggagacagagtcaccatcacttgtcgggcgagtcaggatattagcagctggttagcctggtatcagcagaatccagggaaagcccctaaactcttgatctatgctgcatccagtttgcaaagtggggtcccatcaaggttcagcggcagtggatctgggacagatttcactctcaccatcagcagcctccagcctgaagattttgcaacttactattgtcaacagactaacagtttccctctcactttcggcggagggaccaaggtggagatcaaa

SEQ ID NO: 25676 - protein, 107 aa, Artificial Sequence
  Description of Artificial Sequence: Synthetic polypeptide
DIQMTQSPSSVSASVGDRVTITCRASQDISSWLAWYQQNPGKAPKLLIYAASSLQSGVPSRFSGSGSGTDFTLTISSLQPEDFATYYCQQTNSFPLTFGGGTKVEIK

SEQ ID NO: 25677 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagctggttagcctggtatcagcagaaaccagggaaagcccttaagctcttgatatatgctgcatccagtttgcaaagtggggtcccatcaaggttcagcggcagtggatctgggacagatttcactctcaccatcagcagcgtgcagcctgaagattttgcaacttactattgtcaacagattaacagtttccctctcactttcggcggagggaccaaggtggagatcaaa

SEQ ID NO: 25678 - protein, 107 aa, Artificial Sequence
  Description of Artificial Sequence: Synthetic polypeptide
DIQMTQSPSSVSASVGDRVTITCRASQGISSWLAWYQQKPGKALKLLIYAASSLQSGVPSRFSGSGSGTDFTLTISSVQPEDFATYYCQQINSFPLTFGGGTKVEIK

SEQ ID NO: 25679 - DNA, 321 bp, Artificial Sequence
  Description of Artificial Sequence: Synthetic polynucleotide
gacatccagatgacccagtctccatcctccctatctgcatctgtaggagacagagtcaccatcacttgccgggcaagtcagggcattaacaataatttaaactggtttcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggtccaaggtggagatcaaa

SEQ ID NO: 25680 - protein, 107 aa, Artificial Sequence
  Description of Artificial Sequence: Synthetic polypeptide
DIQMTQSPSSLSASVGDRVTITCRASQGINNNLNWFQQKPGKAPKRLIYAASSLQSGVPSRFSGSGSGTEFTLTISSLQPEDFATYYCLQHNSYPLTFGGGSKVEIK

SEQ ID NO: 25681 - DNA, 321 bp, Artificial Sequence
  Description of Artificial Sequence: Synthetic polynucleotide
gacatccagatgacccagtctccatcctcccggtctgcatctgtaggagacagagtcaccatcacttgccgtgcaagtcagggcattagaaatgatttaggatggtatcagcagaaaccaggaaaagcccctaagcgcctgatctatattgcattcagattgcaaattggggtcccatcaaggttcagcggcagtggatctgggacagaattcactctcacaatcagcagcctgcagcctgaagattttgcaacttattactgtatacaccataatagttacccgtggacgttcggccaagggaccaaggtggaaatcaaa

SEQ ID NO: 25682 - protein, 107 aa, Artificial Sequence
  Description of Artificial Sequence: Synthetic polypeptide
DIQMTQSPSSRSASVGDRVTITCRASQGIRNDLGWYQQKPGKAPKRLIYIAFRLQIGVPSRFSGSGSGTEFTLTISSLQPEDFATYYCIHHNSYPWTFGQGTKVEIK

SEQ ID NO: 25683 - DNA, 339 bp, Artificial Sequence
  Description of Artificial Sequence: Synthetic polynucleotide
gacatcgtgatgacccagtctccagactccctggctgtgtctctgggcgagagggtcgccatcaattgcaagtccagccagagtgttttacacagctccaacaataacaactacttagattggtatcagcagaaaccaggacagcttcctaaactgctcattttctgggcatctacccgggaattcggggttcctgaccgattcagtggcagcgggtttgggacagatttcactctcaccatcagcagcctgcaggctgaagatgtggcagattactactgtcaacaatattatattactccgtgcagttttggccaggggaccaagctggagatcaaa

SEQ ID NO: 25684 - protein, 113 aa, Artificial Sequence
  Description of Artificial Sequence: Synthetic polypeptide
DIVMTQSPDSLAVSLGERVAINCKSSQSVLHSSNNNNYLDWYQQKPGQLPKLLIFWASTREFGVPDRFSGSGFGTDFTLTISSLQAEDVADYYCQQYYITPCSFGQGTKLEIK

SEQ ID NO: 25685 - DNA, 321 bp, Artificial Sequence
  Description of Artificial Sequence: Synthetic polynucleotide
gacatccagatgacccagtctccatcctccccgtctgcatctgtaggagacagagtcaccatcacttgccgggcaagtcagggcattagaaatgatttagattggtatcagcagaagccagggaaggcccctcagcgccttatctatgctgcatccagtttgcaaagtggggtcccatcaaggttcagcggcagtggatctgggacagaattcactctcacaatcagcagcctgcagcctgacgattttgcaacttattactgtctacagcataatagttacccattcactttcggccctgggaccaaagtggatatcaaa

SEQ ID NO: 25686 - protein, 107 aa, Artificial Sequence
  Description of Artificial Sequence: Synthetic polypeptide
DIQMTQSPSSPSASVGDRVTITCRASQGIRNDLDWYQQKPGKAPQRLIYAASSLQSGVPSRFSGSGSGTEFTLTISSLQPDDFATYYCLQHNSYPFTFGPGTKVDIK

SEQ ID NO: 25687 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgttttaggctggtatcagcagaaaccagggaaagcccctaagcgcctgatctatgctgcatccagtttacaaagtggggtcccatcaaggttcagcggcagtggatctgggacagaattcactctcacaatcagcagcctgcagcctgaagattttgcaacttattactgtctacagtataatagttacccattcactttcggccctgggaccaaagtggatatcaaa

SEQ ID NO: 25688 - protein, 107 aa, Artificial Sequence
  Description of Artificial Sequence: Synthetic polypeptide
DIQMTQSPSSLSASVGDRVTITCRASQGIRNVLGWYQQKPGKAPKRLIYAASSLQSGVPSRFSGSGSGTEFTLTISSLQPEDFATYYCLQYNSYPFTFGPGTKVDIK

SEQ ID NO: 25689 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagctggttagcctggtatcagcagaatccaggggaagcccctaagctcctgatctatgctgcatccagtttgcaaggtggggtcccatcaaggttcagcggcagtggatctgggacagatttcactctcaccatcagcagcctccagcctgaagattttgcaaattactattgtcaacagactaatagtttccctctcactttcggcggagggaccaaggtggagatcaaa

SEQ ID NO: 25690 - protein, 107 aa, Artificial Sequence
  Description of Artificial Sequence: Synthetic polypeptide
DIQMTQSPSSVSASVGDRVTITCRASQGISSWLAWYQQNPGEAPKLLIYAASSLQGGVPSRFSGSGSGTDFTLTISSLQPEDFANYYCQQTNSFPLTFGGGTKVEIK

SEQ ID NO: 25691 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttagattggtatcagcagacaccagggaaagcccctaagcgcctgatctatgctgcatccagtttgcaaagtggggtcccatcaaggttcagcggcggtggatctgggacagaattctctctcacaatcagcagcctgcagcctgaagattttacaacttattactgtctacagcataatacttacccattcactttcggccctgggaccaaagtggatgtcaaa

SEQ ID NO: 25692 - protein, 107 aa, Artificial Sequence
  Description of Artificial Sequence: Synthetic polypeptide
DIQMTQSPSSLSASVGDRVTITCRASQGIRNDLDWYQQTPGKAPKRLIYAASSLQSGVPSRFSGGGSGTEFSLTISSLQPEDFTTYYCLQHNTYPFTFGPGTKVDVK

SEQ ID NO: 25693 - DNA, 318 bp, Artificial Sequence
  Description of Artificial Sequence: Synthetic polynucleotide
gacatccagatgacccagtctccatcctccctgtctgcatctgtaggagacagagtcatcatcccttgccgggcaagtcagaacattagcagctatttaaattggtatcagcagaaaccagggaaagcccctaaactcctgatctatgctgcatccagtttgcaaagtggggtcccatcaaggttcagtggcagtggatctgggacagatttcactctgaccatcagcagtctgcagcctgaagattttgcaacttactcctgtcaacagacttacagtacccccaccttcggccaagggacacgactggatattaat

SEQ ID NO: 25694 - protein, 106 aa, Artificial Sequence
  Description of Artificial Sequence: Synthetic polypeptide
DIQMTQSPSSLSASVGDRVIIPCRASQNISSYLNWYQQKPGKAPKLLIYAASSLQSGVPSRFSGSGSGTDFTLTISSLQPEDFATYSCQQTYSTPTFGQGTRLDIN

SEQ ID NO: 25695 - DNA, 321 bp, Artificial Sequence
  Description of Artificial Sequence: Synthetic polynucleotide
gacatccagttgacccagtctccatcctccctgtctgcatctgtaggagacagagtcaccatcacttgccgggcgagtcagggcattagcagttatttaaattggtctcagcagaaaccagggaaagttcctaagctcctgatctgtggtgcttccaatttgcaatctggagtcccatctcggttcagcggcagtgcatctgggacagaattcattctcactatcagcagcctgcagcctgaagatgttacaacttattacggtcaacagaattacaatgccccgctcactttcggcggagggaccaaggtggagatcaaa

SEQ ID NO: 25696 - protein, 107 aa, Artificial Sequence
  Description of Artificial Sequence: Synthetic polypeptide
DIQLTQSPSSLSASVGDRVTITCRASQGISSYLNWSQQKPGKVPKLLICGASNLQSGVPSRFSGSASGTEFILTISSLQPEDVTTYYGQQNYNAPLTFGGGTKVEIK

SEQ ID NO: 25697 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagctggttagcctggtatcagcagaaacctgggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggttaacagtttccctctcactttcggcggagggaccaaggtggagctcaaa

SEQ ID NO: 25698 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQVNSFPLTFGGGTKVELK

SEQ ID NO: 25699 - DNA, 321 bp, Artificial Sequence
  Description of Artificial Sequence: Synthetic polynucleotide
gacatccagatgacccagtctccatcttccgtgtctgcatctataggagacagagtcaccatcacttgtcgggcgagtcagggtattagcaactggttagcctggtatcagcagaaaccagggaaagcccctaagctcctgatctatgctgcatccagtttgcaaagtggggtcccgtcaaggttcagcggcagtggatctgagacagatttcactctcaccatcagcagcctgcagcctgaagattttgcaacttactattgtcaacaggttaacagtttccctctcactttcggcggagggaccaaggtggagatcaaa

SEQ ID NO: 25700 - protein, 107 aa, Artificial Sequence
  Description of Artificial Sequence: Synthetic polypeptide
DIQMTQSPSSVSASIGDRVTITCRASQGISNWLAWYQQKPGKAPKLLIYAASSLQSGVPSRFSGSGSETDFTLTISSLQPEDFATYYCQQVNSFPLTFGGGTKVEIK

SEQ ID NO: 25701 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtttcagcagaaaccagggaaagcccctaagcgcctgatctatgctgcatccaatttgcaaagtggggtcccatcaaggttcagcggcagtggatctgggacagaattcactctcacaatcagcagcctgcagcctgaagattttgcaacttattactgtctacagcataatagttacccattcactttcggccctgggaccaaagtggatatcaaa

SEQ ID NO: 25702 - protein, 107 aa, Artificial Sequence
  Description of Artificial Sequence: Synthetic polypeptide
DIQMTQSPSSLSASVGDRVTITCRASQGIRNDLGWFQQKPGKAPKRLIYAASNLQSGVPSRFSGSGSGTEFTLTISSLQPEDFATYYCLQHNSYPFTFGPGTKVDIK

SEQ ID NO: 25703 - DNA, 324 bp, Artificial Sequence
  Description of Artificial Sequence: Synthetic polynucleotide
gacatccagatgacccagtctccatcctccctgtatgcatctgtaggagacagagtcaccatcactcgccgggcaagtcaggacatcagaaatgatttaggctggtatcagcagaaaccagggaaagcccttaagcgcgtgatctatgctgcatccagtttgcaaagtggggtcccatcaagcttcagcggcagtggatctgggacagaattcactctcacaatcagcagcttgcagcctgaagattttgcaacttattacggtatacagcataatagttaccctccgatcaccgtcggccaagggacacgactggagattaaa

SEQ ID NO: 25704 - protein, 108 aa, Artificial Sequence
  Description of Artificial Sequence: Synthetic polypeptide
DIQMTQSPSSLYASVGDRVTITRRASQDIRNDLGWYQQKPGKALKRVIYAASSLQSGVPSSFSGSGSGTEFTLTISSLQPEDFATYYGIQHNSYPPITVGQGTRLEIK

SEQ ID NO: 25705 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcattatagttaccctcggacgttcggccaagggaccaaggtggaaatcaaa

SEQ ID NO: 25706 - protein, 107 aa, Artificial Sequence; identical to SEQ ID NO: 24168
  Description of Artificial Sequence: Synthetic polypeptide

SEQ ID NO: 25707 - DNA, 324 bp, Artificial Sequence
  Description of Artificial Sequence: Synthetic polynucleotide
gaaattgtgttgacgcagtcgccaggcaccctgtctttgtctccaggggagagagccaccctctcctgcagggcccgtcagaatgttgacagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgttttactgtcagcagtatgaacgctcaccgtggacgttcggccaagggaccaaggtggagatcaaa

SEQ ID NO: 25708 - protein, 108 aa, Artificial Sequence
  Description of Artificial Sequence: Synthetic polypeptide
EIVLTQSPGTLSLSPGERATLSCRARQNVDSSYLAWYQQKPGQAPRLLIYGASSRATGIPDRFSGSGSGTDFTLTISRLEPEDFAVFYCQQYERSPWTFGQGTKVEIK

SEQ ID NO: 25709 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagaatatttacagcaactacctagcctggtaccaggagaagcctggccaggctcccagactcctcatctatggtgcatccagcagggccactggcatcccagacaggttcagtggcagtgggtctgggacagacttcactctcaccatcagcagactggagcctgaagattttgtagtgtattactgtcagcagtatgaaagttcaccgtggacgttcggccaagggaccaaggtggaaatcaaa

SEQ ID NO: 25710 - protein, 108 aa, Artificial Sequence
  Description of Artificial Sequence: Synthetic polypeptide
EIVLTQSPGTLSLSPGERATLSCRASQNIYSNYLAWYQEKPGQAPRLLIYGASSRATGIPDRFSGSGSGTDFTLTISRLEPEDFVVYYCQQYESSPWTFGQGTKVEIK

SEQ ID NO: 25711 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaattacaactacttagcttggtaccagcagaaaccaggacagcctcctaagaagctcatttactgggcatctacccgggaatccggggtccctgaccgattcagtggcagcgggtctgggacagatttcactctcaccatcagcagcctgcaggctgaagatgtggcagtttattcctgtcagcaatattatagtagtcctccgacgttcggccaagggaccaaggtggaaatcaaa

SEQ ID NO: 25712 - protein, 113 aa, Artificial Sequence
  Description of Artificial Sequence: Synthetic polypeptide
DIVMTQSPDSLAVSLGERATINCKSSQSVLYSSNNYNYLAWYQQKPGQPPKKLIYWASTRESGVPDRFSGSGSGTDFTLTISSLQAEDVAVYSCQQYYSSPPTFGQGTKVEIK

SEQ ID NO: 25713 - DNA, 339 bp, Artificial Sequence
  Description of Artificial Sequence: Synthetic polynucleotide
gacatcgtgatgacccagtctccagactccctggctgtgtctccgggcgagagggccaccatcaactgcaagtccagccagagtgttttacacagctccaacaataacaattacttagcctggtaccagcagaaaccaggacagcctcctgacctgctcatttactgggcatcaacccgggaatccggggtccctgaccgattcagtggcagcgggtctgggacagatttcactctcaccatcagcagcctgcaggctgaagatgtggcagtttattactgtcagcaatattttagtactccgtggacgttcggccaagggacccaggtggaaatcaaa

SEQ ID NO: 25714 - protein, 113 aa, Artificial Sequence
  Description of Artificial Sequence: Synthetic polypeptide
DIVMTQSPDSLAVSPGERATINCKSSQSVLHSSNNNNYLAWYQQKPGQPPDLLIYWASTRESGVPDRFSGSGSGTDFTLTISSLQAEDVAVYYCQQYFSTPWTFGQGTQVEIK

SEQ ID NO: 25715 - DNA, 324 bp, Artificial Sequence
  Description of Artificial Sequence: Synthetic polynucleotide
gaatttatgttgacgcagtctccaggcaccctgtattggtctccaggggaaagagccaccctctcgtgcagggccagtcagagtgttagcagcagctacttagtctggtatcagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggttgctcaccgctcactttcggcggagggaccaaggtggagatcaca

SEQ ID NO: 25716 - protein, 108 aa, Artificial Sequence
  Description of Artificial Sequence: Synthetic polypeptide
EFMLTQSPGTLYWSPGERATLSCRASQSVSSSYLVWYQQKPGQAPRLLIYGASTRATGIPDRFSGSGSGTDFTLTISRLEPEYFAVYYCQQYGCSPLTFGGGTKVEIT

SEQ ID NO: 25717 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttacacagctccaacaataagaactacttaacttggtaccagcagaaaccaggacagcctcctaagctgctcatttactgggcatctactcgggaatccggggtccctgaccgattcagtggcagcgggtctgggacagatttcagtctcacgatcggcagcctgcaggctgaagatgtggcagtttattactgtcagcaatattatagtattcctccgacgttcggccaagggaccaaggtggaaatcaaa

SEQ ID NO: 25718 - protein, 113 aa, Artificial Sequence
  Description of Artificial Sequence: Synthetic polypeptide
DIVMTQSPDSLAVSLGERATINCKSSQSVLHSSNNKNYLTWYQQKPGQPPKLLIYWASTRESGVPDRFSGSGSGTDFSLTIGSLQAEDVAVYYCQQYYSIPPTFGQGTKVEIK

SEQ ID NO: 25719 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaatgcgaactacttagcttggtaccagcagaaaccaggacagcctcctaacctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtgcagttttggccaggggaccaagctggagatcaaa

SEQ ID NO: 25720 - protein, 113 aa, Artificial Sequence
  Description of Artificial Sequence: Synthetic polypeptide
DIVMTQSPDSLAVSLGERATINCKSSQSVLYSSNNANYLAWYQQKPGQPPNLLIYWASTRESGVPDRFSGSGSGTDFTLTISSLQAEDVAVYYCQQYYSTPCSFGQGTKLEIK

SEQ ID NO: 25721 - DNA, 321 bp, Artificial Sequence
  Description of Artificial Sequence: Synthetic polynucleotide
gaaatagtgatgacgcagtctccagccaccccgtctgtgtctccaggggaaagagccaccctctcctgcagggccagtgtgagtgttgtcaacagcttagcctggtaccagcagaaacctggccaggctcccaggctcctcatccatggtgcatccaccagggccactggtatcccagccaggttcagtggcagtgggtctgggacagagttcactctcaccatcagcagtgtgcagtctgaagattttgcaatttattactgtcagcaatataatgactggccgtgcagttttggccaggggaccaagctggagatcaaa

SEQ ID NO: 25722 - protein, 107 aa, Artificial Sequence
  Description of Artificial Sequence: Synthetic polypeptide
EIVMTQSPATPSVSPGERATLSCRASVSVVNSLAWYQQKPGQAPRLLIHGASTRATGIPARFSGSGSGTEFTLTISSVQSEDFAIYYCQQYNDWPCSFGQGTKLEIK

SEQ ID NO: 25723 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttacacagctccaacaattacaactacttagcttggtaccagcagagaccaggacagcctcctaggctgctcatttactgggcatctacccgggaatccggggtccctgaccgattcagtggcagcggttctgggacagatttcactctcaccatcagcagcctgcaggttgaagatgtggcagtttattactgtcagcaatattatagttctcctccgacgttcggccaagggaccaaggtggaaatcaaa

SEQ ID NO: 25724 - protein, 113 aa, Artificial Sequence
  Description of Artificial Sequence: Synthetic polypeptide
DIVMTQSPDSLAVSLGERATINCKSSQSVLHSSNNYNYLAWYQQRPGQPPRLLIYWASTRESGVPDRFSGSGSGTDFTLTISSLQVEDVAVYYCQQYYSSPPTFGQGTKVEIK

SEQ ID NO: 25725 - DNA, 321 bp, Artificial Sequence
  Description of Artificial Sequence: Synthetic polynucleotide
gacatccagatgacccagtctccatcctccctgtctgcttctgtaggagacagagtcaccatcacttgccgggcaagtcagggcattagaaatgatttaggctggtatcagcagaaaccagggaaagcccctaagcgcctgatctatgctgcatccactttgcaaagtggggtcccatcaaggttcagcggcagtggatctgggacagaattcactctcacaatcagcggcctgcagcctgaagattttgcaacttatcactgtctacagcatagtaattacccgctcactttcggcggagggaccaaggtggagatcaaa

SEQ ID NO: 25726 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASTLQSGVPSRFSGSGSGTEFTLTISGLQPEDFATYHCLQHSNYPLTFGGGTKVEIK

SEQ ID NO: 25727 - DNA, 339 bp, Artificial Sequence
  Description of Artificial Sequence: Synthetic polynucleotide
gacatcgttatgacccagtgtccagactccccggctgtgtctctgggcgagagggccaccatcaattgcaagtccagccagagtgttttattcagctccaacaattataattacttagcttggtaccagcagagaccaggacagcctcatgacctgctcatttactgggcatctacccgggaatccggggtccctgaccgattcagtggcagcgggtctgggacagatttcactctcaccatcagcagcctgcaggctgctgatgtggcagtttattactgtcagcaatatcatagttctcctctgacgttcggccaagggaccacggtgcaaatcaaa

SEQ ID NO: 25728 - protein, 113 aa, Artificial Sequence
  Description of Artificial Sequence: Synthetic polypeptide
DIVMTQCPDSPAVSLGERATINCKSSQSVLFSSNNYNYLAWYQQRPGQPHDLLIYWASTRESGVPDRFSGSGSGTDFTLTISSLQAADVAVYYCQQYHSSPLTFGQGTTVQIK

SEQ ID NO: 25729 - DNA, 324 bp, Artificial Sequence
  Description of Artificial Sequence: Synthetic polynucleotide
gaacttgtgttgacgcagtctccaggcaccctgtctttgtctccaggggaaagagccaccctctcctgcagggccagtcagaatatttacagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattgctgtcagcagtatgaaagctcaccgtggaccttcggccaagggaccaaggtggaaatcaaa

SEQ ID NO: 25730 - protein, 108 aa, Artificial Sequence
  Description of Artificial Sequence: Synthetic polypeptide
ELVLTQSPGTLSLSPGERATLSCRASQNIYSSYLAWYQQKPGQAPRLLIYGASSRATGIPDRFSGSGSGTDFTLTISRLEPEDFAVYCCQQYESSPWTFGQGTKVEIK

SEQ ID NO: 25731 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccgggccactggcatcccagacaggttcagtggcagtgggtctgggacagacttcgctctcaccatcagcagactggagcctgaagattttgcagtgtattactgtcagcactctgataactcaccgtggacgttcggccaagggaccaaggtggaaatcaaa

SEQ ID NO: 25732 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRATGIPDRFSGSGSGTDFALTISRLEPEDFAVYYCQHSDNSPWTFGQGTKVEIK

SEQ ID NO: 25733 - DNA, 324 bp, Artificial Sequence
  Description of Artificial Sequence: Synthetic polynucleotide
gaaattgtgttgacgcagtctccaggcaccctgtctttgtctccaggggaaagagccaccctctcatgcagggccagtcagagtgtttacagcagctacttagcctggtaccagcagaaacctggccaggctcccaggctcctcatttatggtgcatccagccgggccactggcatcccagacaggttcagtggcagtgggtctgggacagacttcgctctcaccatcagcagactggagcctgaagattgtgcagtgtattactgtcagcactctgataactcaccgtggacgttcggccaagggaccaaggtggaaatcaaa

SEQ ID NO: 25734 - protein, 108 aa, Artificial Sequence
  Description of Artificial Sequence: Synthetic polypeptide
EIVLTQSPGTLSLSPGERATLSCRASQSVYSSYLAWYQQKPGQAPRLLIYGASSRATGIPDRFSGSGSGTDFALTISRLEPEDCAVYYCQHSDNSPWTFGQGTKVEIK

SEQ ID NO: 25735 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatttgggacagaattcactctcaccatcagcagcctgcagcctgaagattttgcaacttattactgtcttcagcatagtaattacccgctcactttcggcggagggaccaaggtggagatcaaa

SEQ ID NO: 25736 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGFGTEFTLTISSLQPEDFATYYCLQHSNYPLTFGGGTKVEIK

SEQ ID NO: 25737 - DNA, 324 bp, Artificial Sequence
  Description of Artificial Sequence: Synthetic polynucleotide
gaaattgtgttgacgcagtctccaggcaccctgtctttgtctccaggggaaagagccaccctctcttgcagggccagtcagagtgttaacagcaactacttagcctggtaccagcagaaacctggccaggctcccaggctcctcatctatggtgcattcagcagggccactggcatcccagacagggtcagtggcagtgggtctgggacagacttcaatctcatcatcagcagactggagcctgaagattttgcagtgtattactgtcagcagtatgaaagctcaccgtggacgttcggccaagggaccaaggtggaaatcaaa

SEQ ID NO: 25738 - protein, 108 aa, Artificial Sequence
  Description of Artificial Sequence: Synthetic polypeptide
EIVLTQSPGTLSLSPGERATLSCRASQSVNSNYLAWYQQKPGQAPRLLIYGAFSRATGIPDRVSGSGSGTDFNLIISRLEPEDFAVYYCQQYESSPWTFGQGTKVEIK

SEQ ID NO: 25739 - DNA, 339 bp, Artificial Sequence
  Description of Artificial Sequence: Synthetic polynucleotide
gtcatcgtgttgacccagtctccagactccctggctgtgtctctgggcgagagggccaccatcaactgcaagtccagccagagtgtattacacagctccaacagttacaactacttagcttggtaccagcagaaaccaggacagtctcctaaggtgctcatttactggacatctacccgggaatccggggtccctgaccgattcagtggcagcgggtctgggacagatttcactctcaccatcagcagcctgcaggctgaagatgtggcagtttattactgtcagcaatattatagtagtcctccgacgttcggccaagggaccaaggtggaaatcaaa

SEQ ID NO: 25740 - protein, 113 aa, Artificial Sequence
  Description of Artificial Sequence: Synthetic polypeptide
VIVLTQSPDSLAVSLGERATINCKSSQSVLHSSNSYNYLAWYQQKPGQSPKVLIYWTSTRESGVPDRFSGSGSGTDFTLTISSLQAEDVAVYYCQQYYSSPPTFGQGTKVEIK

SEQ ID NO: 25741 - DNA, 339 bp, Artificial Sequence
  Description of Artificial Sequence: Synthetic polynucleotide
gatatcgtgatgacccagtctccagactccctgactgtgtctctgggcgagagggccaccatcaactgcaagtccagccagagtattttatacaactccaacaataacaactacttagcttggtaccagcagaaaccaggacagcctcctaagctgctcatttactgggcatctacccgggaatccggggtccctgaccgattcagtggcagcgggtctgggacagatttcattctcaccatcagcagcctgcaggctgaagatgtggcagtttactactgtcagcaatattatagcactcctcctactttcggcggagggaccaaggtggagatcaaa

SEQ ID NO: 25742 - protein, 113 aa, Artificial Sequence
  Description of Artificial Sequence: Synthetic polypeptide
DIVMTQSPDSLTVSLGERATINCKSSQSILYNSNNNNYLAWYQQKPGQPPKLLIYWASTRESGVPDRFSGSGSGTDFILTISSLQAEDVAVYYCQQYYSTPPTFGGGTKVEIK

SEQ ID NO: 25743 - DNA, 324 bp, Artificial Sequence
  Description of Artificial Sequence: Synthetic polynucleotide
gaaattgtgttgacgcagtctccaggcacccggtcttggtctccaggggaaagagccaccctctcgtgcagggccagtcagagtgttagcagcagctacttagcctggtaccagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggtaactcaccgctcactttcggcggagggaccaaggtggagatcaaa

SEQ ID NO: 25744 - protein, 108 aa, Artificial Sequence
  Description of Artificial Sequence: Synthetic polypeptide
EIVLTQSPGTRSWSPGERATLSCRASQSVSSSYLAWYQQKPGQAPRLLIYGASTRATGIPDRFSGSGSGTDFTLTISRLEPEYFAVYYCQQYGNSPLTFGGGTKVEIK

SEQ ID NO: 25745 - DNA, 324 bp, Artificial Sequence
  Description of Artificial Sequence: Synthetic polynucleotide
gaatttatgttgacgcagtctccaggcaccctgtctttgtctccaggggaaagagccaccctctcgtgcagggccagtcagagtgttagcagcagctacttagtctggtatcagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggttgctcaccgctcactttcggcggagggaccaaggtggagatcaca

SEQ ID NO: 25746 - protein, 108 aa, Artificial Sequence
  Description of Artificial Sequence: Synthetic polypeptide
EFMLTQSPGTLSLSPGERATLSCRASQSVSSSYLVWYQQKPGQAPRLLIYGASTRATGIPDRFSGSGSGTDFTLTISRLEPEYFAVYYCQQYGCSPLTFGGGTKVEIT

SEQ ID NO: 25747 - DNA, 324 bp, Artificial Sequence
  Description of Artificial Sequence: Synthetic polynucleotide
gaaattgcgttgacgcagtctccaggcaccctgtctttgtctccaggggaaagagccaccctctcctgcagggccagtccgagtgttgacagcagctacttagcctggtaccagcagagacctggccaggctcccaggctcctcatctatggtgcatccagcagggcccctggcatcccagacaggttcagtggcagtgggtctgggacagacttcactctcaccatcagcagactggagcctgaagattttgcagtgtattactgtcagcagtatgaaagttcaccgtggacgttcggccaagggaccaaggtggaaatcaaa

SEQ ID NO: 25748 - protein, 108 aa, Artificial Sequence
  Description of Artificial Sequence: Synthetic polypeptide
EIALTQSPGTLSLSPGERATLSCRASPSVDSSYLAWYQQRPGQAPRLLIYGASSRAPGIPDRFSGSGSGTDFTLTISRLEPEDFAVYYCQQYESSPWTFGQGTKVEIK

SEQ ID NO: 25749 - DNA, 324 bp, Artificial Sequence
  Description of Artificial Sequence: Synthetic polynucleotide
gaaattgtgttgacgcagtcgccaggcaccctgtctttgtctccaggggagagagccaccctctcctgcaggaccagtccgaatgttgacagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgttttactgtcagcagtatgaacgctcaccgtggacgttcggccaagggaccaaggtggaaatcaaa

SEQ ID NO: 25750 - protein, 108 aa, Artificial Sequence
  Description of Artificial Sequence: Synthetic polypeptide
EIVLTQSPGTLSLSPGERATLSCRTSPNVDSSYLAWYQQKPGQAPRLLIYGASSRATGIPDRFSGSGSGTDFTLTISRLEPEDFAVFYCQQYERSPWTFGQGTKVEIK

SEQ ID NO: 25751 - DNA, 324 bp, Artificial Sequence
  Description of Artificial Sequence: Synthetic polynucleotide
gaaattgtgttgacgcagtctccaggcaccctgtctttgtctcaaggggaaagagccaccctctcctgcagggccagtcagagtgttagcagcaggtacttagcctggtaccagcagaaacctggccaggctcccagactcctcatctatggtgcatccagcagggccactggcatcccagacaggttcagtggcagtgggtctgggacagacttcactctcaccatcagcagactggagcctgaagattttgcagtatattactgtcagcattatgatagctcaccgtggacgttcggccaagggaccaaggtggaaatcaaa

SEQ ID NO: 25752 - protein, 108 aa, Artificial Sequence
  Description of Artificial Sequence: Synthetic polypeptide
EIVLTQSPGTLSLSQGERATLSCRASQSVSSRYLAWYQQKPGQAPRLLIYGASSRATGIPDRFSGSGSGTDFTLTISRLEPEDFAVYYCQHYDSSPWTFGQGTKVEIK

SEQ ID NO: 25753 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagactgttttacacagctccaacaattataactacttagcttggtaccagcagaagccaggacagccccctaaggtgctcatttactggacatctacccgggaatccggggtccctgaccgattcagtggcagcgggtctgggacagatttcactctcaccatcagcagcctgcaggctgaagatgtggcagtttattactgtcagcaatattttagtagtcctctgacgttcggccaagggaccaaggtggaaatcaaa

SEQ ID NO: 25754 - protein, 113 aa, Artificial Sequence
  Description of Artificial Sequence: Synthetic polypeptide
DIVMTQSPDSLAVSLGERATINCKSSQTVLHSSNNYNYLAWYQQKPGQPPKVLIYWTSTRESGVPDRFSGSGSGTDFTLTISSLQAEDVAVYYCQQYFSSPLTFGQGTKVEIK

SEQ ID NO: 25755 - DNA, 324 bp, Artificial Sequence
  Description of Artificial Sequence: Synthetic polynucleotide
gaatttatgttgacgcagtctccaggcaccctgtcttggtctccaggggaaagagccaccctctcgtgcagggccagtcagagtgttagcagcagctacttagtctggtatcagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggttgctcaccgctcactttcggcggagggaccaaggtggagatcaca

SEQ ID NO: 25756 - protein, 108 aa, Artificial Sequence
  Description of Artificial Sequence: Synthetic polypeptide
EFMLTQSPGTLSWSPGERATLSCRASQSVSSSYLVWYQQKPGQAPRLLIYGASTRATGIPDRFSGSGSGTDFTLTISRLEPEYFAVYYCQQYGCSPLTFGGGTKVEIT

SEQ ID NO: 25757 - DNA, 321 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcagttacttatcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtaggtcacggacgttcggccaagggaccaaggtggaaatcaga

SEQ ID NO: 25758 - protein, 107 aa, Artificial Sequence
  Description of Artificial Sequence: Synthetic polypeptide
EIVLTQSPGTLSLSPGERATLSCRASQSVSSSYLSWYQQKPGQAPRLLIYGASSRATGIPDRFSGSGSGTDFTLTISRLEPEDFAVYYCQQYGRSRTFGQGTKVEIR

SEQ ID NO: 25759 - DNA, 324 bp, Artificial Sequence
  Description of Artificial Sequence: Synthetic polynucleotide
gaacctgtgttgacgcagtctccaggcaccctgtctttgtctccaggggaaagagccaccctctcctgcagggccagtcagaatatttacagcaactacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattgctgtcagcagtatgaaagctcaccgtggaccttcggccaagggaccaaggtggaaatcaaa

SEQ ID NO: 25760 - protein, 108 aa, Artificial Sequence
  Description of Artificial Sequence: Synthetic polypeptide
EPVLTQSPGTLSLSPGERATLSCRASQNIYSNYLAWYQQKPGQAPRLLIYGASSRATGIPDRFSGSGSGTDFTLTISRLEPEDFAVYCCQQYESSPWTFGQGTKVEIK

SEQ ID NO: 25761 - DNA, 321 bp, Artificial Sequence
  Description of Artificial Sequence: Synthetic polynucleotide
gacatccagatgacccagtctccatcctcactgtctgcatcagtaggagacagagtcaccatcacttgtcgggcgagtcagggcattggcaagtatttagcctggtttcagcagaaaccagggaaagcccctaagtccctgatctatactacatccaatttacaaagtggggccccatcaaagttcagcggcagtggatctgggacagatttcactctcaccatcagcagcctgcagtatgaagattttgcaacttattactgccaacagtacagtaattacccgctcactttcggcggagggaccaaggtggagatcaat

SEQ ID NO: 25762 - protein, 107 aa, Artificial Sequence
  Description of Artificial Sequence: Synthetic polypeptide
DIQMTQSPSSLSASVGDRVTITCRASQGIGKYLAWFQQKPGKAPKSLIYTTSNLQSGAPSKFSGSGSGTDFTLTISSLQYEDFATYYCQQYSNYPLTFGGGTKVEIN

SEQ ID NO: 25763 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtctgagtgttgtcaacagcttagcctggtaccagcagaaacctggccaggctcccaggctcctcatccatggtgcatccaccagggccactggtatcccagccaggttcagtggcagtgggtctgggacagagttcactctcaccatcagcagtctgcagtctgaagattttgcaatttattactgtcagcagtataatgactggccgtgcagttttggccaggggaccaagctggagatcaaa

SEQ ID NO: 25764 - protein, 107 aa, Artificial Sequence
  Description of Artificial Sequence: Synthetic polypeptide
EIVMTQSPATLSVSPGERATLSCRASLSVVNSLAWYQQKPGQAPRLLIHGASTRATGIPARFSGSGSGTEFTLTISSLQSEDFAIYYCQQYNDWPCSFGQGTKLEIK

SEQ ID NO: 25765 - DNA, 336 bp, Artificial Sequence
  Description of Artificial Sequence: Synthetic polynucleotide
gatattgtgatgactcagtctccactctccctgcccgtcacccctggagagccggcctccatctcctgcaggtctagtcagagcctcctgcatagtaatggacacaactatttggattggtacctacagaagccagggcggtctccacagctcctgatctatttgggttctaatcgggcctccggggtccctgagaggttcagtggcagtggatcaggcacagattttacactgaaaatcagcagagtggaggctgaggatgttggggtttattactgcatgcaacctctacaaactccgttcactttcggcggagggaccaaggtggagatcaaa

SEQ ID NO: 25766 - protein, 112 aa, Artificial Sequence
  Description of Artificial Sequence: Synthetic polypeptide
DIVMTQSPLSLPVTPGEPASISCRSSQSLLHSNGHNYLDWYLQKPGRSPQLLIYLGSNRASGVPERFSGSGSGTDFTLKISRVEAEDVGVYYCMQPLQTPFTFGGGTKVEIK

SEQ ID NO: 25767 - DNA, 324 bp, Artificial Sequence; identical to SEQ ID NO: 24135
  Description of Artificial Sequence: Synthetic polynucleotide

SEQ ID NO: 25768 - protein, 108 aa, Artificial Sequence; identical to SEQ ID NO: 24136
  Description of Artificial Sequence: Synthetic polypeptide

SEQ ID NO: 25769 - DNA, 339 bp, Artificial Sequence
  Description of Artificial Sequence: Synthetic polynucleotide
gacatcgtgatgacccagtctccagactccctggctgtgtctctgggcgagggggccaccatcaactgcaagtcccgccagagtgttttacacagctccaacaattacaactacttagcttggtaccagcagaaagcaggacagcctcctaaactgctcatttactgggcttctacccgggaatccggggtccctgaccgattcagtggcagcgggtctgggacagatttcactctcaccatcagcagcctgcaggctgaagatgtggcagtttattactgtcagcaatattatagtactcctccgacgttcggccaagggaccaaggtggaaatcaga

SEQ ID NO: 25770 - protein, 113 aa, Artificial Sequence
  Description of Artificial Sequence: Synthetic polypeptide
DIVMTQSPDSLAVSLGEGATINCKSRQSVLHSSNNYNYLAWYQQKAGQPPKLLIYWASTRESGVPDRFSGSGSGTDFTLTISSLQAEDVAVYYCQQYYSTPPTFGQGTKVEIR

SEQ ID NO: 25771 - DNA, 339 bp, Artificial Sequence
  Description of Artificial Sequence: Synthetic polynucleotide
gacatcgtgatgacccagtctccagactccctggctgtgtctctgggcgagagggccaccatcaactgtaagtccagccagagtattttatacagctccaacaataataactacttagcttggttccagcagaaaccaggacagcctcctaagctgctcatttattgggcatctacccgggaatccggggtccctgaccgattcagtggcagcgggtctgggacagatttcactctcaccatcagcagcctgcaggctgaagatgtggcagtttattactgtcagcaatattatattactcctccgacgttcggccaagggaccaaggtggaaatcaaa

SEQ ID NO: 25772 - protein, 113 aa, Artificial Sequence
  Description of Artificial Sequence: Synthetic polypeptide
DIVMTQSPDSLAVSLGERATINCKSSQSILYSSNNNNYLAWFQQKPGQPPKLLIYWASTRESGVPDRFSGSGSGTDFTLTISSLQAEDVAVYYCQQYYITPPTFGQGTKVEIK

SEQ ID NO: 25773 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgtttacagcagctacttagcctggtaccagcagaaacctggccaggctcccaggctcctcatttatggtgcatccagccgggccactggcatcccagacaggttcagtggcagtgggtctgggacagacttcgctctcaccatcagcagactggagcctgaagattttgcagtgtattactgtcagcactatgataactcaccgtggacgttcggccaagggaccaaggtggaaatcaaa

SEQ ID NO: 25774 - protein, 108 aa, Artificial Sequence
  Description of Artificial Sequence: Synthetic polypeptide
EIVLTQSPGTLSLSPGERATLSCRASQSVYSSYLAWYQQKPGQAPRLLIYGASSRATGIPDRFSGSGSGTDFALTISRLEPEDFAVYYCQHYDNSPWTFGQGTKVEIK

SEQ ID NO: 25775 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccgggccactggcatcccagacaggttcagtggcagtgggtctgggacagacttcgctctcaccatcagcagactggagcctgaagattgtgcagtgtattactgtcagcactatgataactcaccgtggacgttcggccaagggaccaaggtggaaatcaaa

SEQ ID NO: 25776 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRATGIPDRFSGSGSGTDFALTISRLEPEDCAVYYCQHYDNSPWTFGQGTKVEIK

SEQ ID NO: 25777 - DNA, 336 bp, Artificial Sequence
  Description of Artificial Sequence: Synthetic polynucleotide
gatattgtgatgactcagtctccactctccctgcccgtcacccctggagagccggcctccatctcctgcaggtctagtcagagcctcctgcatagtagtggatacaactatttggattggtacctgcagaagccagggcagtctccacagctcctgatctatttgggttctaatcgggcctccggggtccctgacaggttcagtggcagtggatcaggctcagattttacactgaagatcagcagagtggaggctgaggatgttggactttattactgcatgcaagctctacaccctcctctcactttcggcggagggaccaaggtggagatcaaa

SEQ ID NO: 25778 - protein, 112 aa, Artificial Sequence
  Description of Artificial Sequence: Synthetic polypeptide
DIVMTQSPLSLPVTPGEPASISCRSSQSLLHSSGYNYLDWYLQKPGQSPQLLIYLGSNRASGVPDRFSGSGSGSDFTLKISRVEAEDVGLYYCMQALHPPLTFGGGTKVEIK

SEQ ID NO: 25779 - DNA, 324 bp, Artificial Sequence
  Description of Artificial Sequence: Synthetic polynucleotide
gaaattgtgttgacgcagtctccaggcaccctatctttgtctccaggggaaagagccaccctctcctgcagggccagtccgagtgttaacagctactacttagcctggtaccagcagaaacctggccaggctcccaggctcctcatctatggtgcaaccagcagggccactggcatcccagacaggttcagtggcagtgggtctggaacagacttcactctcaccatcagcagactggagcctgaagattttgcagtttatttctgtcagcagtatgaagactcaccgtggacgttcggccaagggaccaaggtggaaatcaaa

SEQ ID NO: 25780 - protein, 108 aa, Artificial Sequence
  Description of Artificial Sequence: Synthetic polypeptide
EIVLTQSPGTLSLSPGERATLSCRASPSVNSYYLAWYQQKPGQAPRLLIYGATSRATGIPDRFSGSGSGTDFTLTISRLEPEDFAVYFCQQYEDSPWTFGQGTKVEIK

SEQ ID NO: 25781 - DNA, 321 bp, Artificial Sequence
  Description of Artificial Sequence: Synthetic polynucleotide
gaaatagtgatgacgcagtctccagtcaccctgtctgtgtctccaggggaaagagccaccctctcctgcagggccagtcagagtgttagcagcagcttagcctggtaccagcagaaacctggcctggctcccaggctcctcatctatggtgcatccaccagggccactggtatcccagccaggttcagtggcagtgggtctgggacagagttctcttttaccatcagcagcctgcagtctgaagattttgcagtttatttctgtcagcagtataatgactggccgtgcagttttggccagggctccaagctggagatccaa

SEQ ID NO: 25782 - protein, 107 aa, Artificial Sequence
  Description of Artificial Sequence: Synthetic polypeptide
EIVMTQSPVTLSVSPGERATLSCRASQSVSSSLAWYQQKPGLAPRLLIYGASTRATGIPARFSGSGSGTEFSFTISSLQSEDFAVYFCQQYNDWPCSFGQGSKLEIQ

SEQ ID NO: 25783 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttgacagcaactacttagcctggtaccagcagaaacctggccaggctcccaggctcctcatctatggtgcatccagcagggcccctggcatcccagacaggttcagtggcagtgggtctgggacagacttcactctcaccatcaacagactggagcctgaagattttgcagtgtatttctgtcagcagtatgaaagctcaccgtggacgttcggccaagggaccaaggtggaaatcaaa

SEQ ID NO: 25784 - protein, 108 aa, Artificial Sequence
  Description of Artificial Sequence: Synthetic polypeptide
EIVLTQSPGTLSLSPGERATLSCRASQSVDSNYLAWYQQKPGQAPRLLIYGASSRAPGIPDRFSGSGSGTDFTLTINRLEPEDFAVYFCQQYESSPWTFGQGTKVEIK

SEQ ID NO: 25785 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaagtatttagcctggtttcagcagaaaccagggaaagcccctaagtccctgatctatgctgcatccagtttgcaaggtggggccccatcaaagttcagcggcagtggatctgggacagatttcactctcaccatcagcagcctgcagcctgaagattttgcaacttattactgccaacagtacagtaattacccgctcactttcggcggagggaccagggtggagatcaaa

SEQ ID NO: 25786 - protein, 107 aa, Artificial Sequence
  Description of Artificial Sequence: Synthetic polypeptide
DIQMTQSPSSLSASVGDRVTITCRASQGISKYLAWFQQKPGKAPKSLIYAASSLQGGAPSKFSGSGSGTDFTLTISSLQPEDFATYYCQQYSNYPLTFGGGTRVEIK

SEQ ID NO: 25787 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagactgttttacacagctccaacaattataactacttagcttggtaccagcagaagccaggacagccccctaaggtgctcctttactggacatctacccgggaatccggggtccctgaccgattcagtggcagcgggtctgggacagatttcactctcaccatcagcagcctgcaggctgaagatgtggcagtttattactgtcagcaatattttagtagtcctccgacgttcggccaagggaccagggtggaaatcaaa

SEQ ID NO: 25788 - protein, 113 aa, Artificial Sequence
  Description of Artificial Sequence: Synthetic polypeptide
DIVMTQSPDSLAVSLGERATINCKSSQTVLHSSNNYNYLAWYQQKPGQPPKVLLYWTSTRESGVPDRFSGSGSGTDFTLTISSLQAEDVAVYYCQQYFSSPPTFGQGTRVEIK

SEQ ID NO: 25789 - DNA, 324 bp, Artificial Sequence
  Description of Artificial Sequence: Synthetic polynucleotide
gaaattgtgttgacgcagtctccaggcaccctgtatttgtctccaggggaaagagccaccctgtcatgcagggccagtcagagtgtttacagcagctacttagcgtggtaccagcagaaacctggccaggctcccaggctcatcatttatggtgcatccagccgggccactggcatcccagacaggttcagtggcagtgggtgtgggacagacttcgctctcaccatcagcagagtggagcatgaagattgtgcagtgtattactgtcagcactatgataactcaccgtggacgttcggccaagggaccaaggtggaaatcaaa

SEQ ID NO: 25790 - protein, 108 aa, Artificial Sequence
  Description of Artificial Sequence: Synthetic polypeptide
EIVLTQSPGTLYLSPGERATLSCRASQSVYSSYLAWYQQKPGQAPRLIIYGASSRATGIPDRFSGSGCGTDFALTISRVEHEDCAVYYCQHYDNSPWTFGQGTKVEIK

SEQ ID NO: 25791 - DNA, 324 bp, Artificial Sequence
  Description of Artificial Sequence: Synthetic polynucleotide
gaaattgtgttgacgcagtctccaggcaccctgtatttgtctccaggggaaagagccaccctctcctgcagggccagtcagagtgtttacagcagctacttagcctggtaccagcagaaacctggccaggctcccaggctcctcatttatggtgcatccagccggtccactggcatcccagacaggttcagtggcagtgggtctgggacagacttcgctctcaccatcagcagactggagcctgaagattttgcagtgtattactgtcagcactatgataactcaccgtggacgttcggccaagggaccaaggtggaaatcaaa

SEQ ID NO: 25792 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRSTGIPDRFSGSGSGTDFALTISRLEPEDFAVYYCQHYDNSPWTFGQGTKVEIK

SEQ ID NO: 25793 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggtaactcaccgctcactttcggcggagggaccaaggtggagatcaaa

SEQ ID NO: 25794 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASTRATGIPDRFSGSGSGTDFTLTISRLEPEYFAVYYCQQYGNSPLTFGGGTKVEIK

SEQ ID NO: 25795 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcaggtacttagcctggtaccagcagaaacctggccaggctcccagactcctcatctatggtgcatccagcagggccactggcatcccagacaggttcagtggcagtgggtctgggacagacttcactctcaccatcagcagactggagcctgcagattttgcagtatattactgtcagcattatgatagctcaccgtggacgttcggccaagggaccaaggtggaaatcaaa

SEQ ID NO: 25796 - protein, 108 aa, Artificial Sequence
  Description of Artificial Sequence: Synthetic polypeptide
EIVLTQSPGTLSLSPGERATLSCRASQSVSSRYLAWYQQKPGQAPRLLIYGASSRATGIPDRFSGSGSGTDFTLTISRLEPADFAVYYCQHYDSSPWTFGQGTKVEIK

SEQ ID NO: 25797 - DNA, 324 bp, Artificial Sequence
  Description of Artificial Sequence: Synthetic polynucleotide
gaatttatgttgacgcagtctccaggcaccctgtgttggtctccaggggaaagagccaccctctcgtgcagggccagtcagagtgttagcagcagctacttagtctggtatcagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggttgctcaccgctcactttcggcggagggaccaaggtggagatcaca

SEQ ID NO: 25798 - protein, 108 aa, Artificial Sequence
  Description of Artificial Sequence: Synthetic polypeptide
EFMLTQSPGTLCWSPGERATLSCRASQSVSSSYLVWYQQKPGQAPRLLIYGASTRATGIPDRFSGSGSGTDFTLTISRLEPEYFAVYYCQQYGCSPLTFGGGTKVEIT

SEQ ID NO: 25799 - DNA, 324 bp, Artificial Sequence
  Description of Artificial Sequence: Synthetic polynucleotide
gaaattgtgttgacgcagtctccaggcaccctgtctttgtctccaggggagagagccaccctctcctgcagggccagtcagagtgttcacagcaggtacttagcctggtaccagcagaaacctggccaggctcccaaactcctcatctttggtgcatccagcagggccactggcatcccagacaggttcagtggcagtgggtctgggacggacttcactctcaccatcagcagactggagcctgaagattttgcagtatattactgtcagcattatgatagctcaccgtggacgttcggccaagggaccaaggtggaaatcaaa

SEQ ID NO: 25800 - protein, 108 aa, Artificial Sequence
  Description of Artificial Sequence: Synthetic polypeptide
EIVLTQSPGTLSLSPGERATLSCRASQSVHSRYLAWYQQKPGQAPKLLIFGASSRATGIPDRFSGSGSGTDFTLTISRLEPEDFAVYYCQHYDSSPWTFGQGTKVEIK

SEQ ID NO: 25801 - DNA, 339 bp, Artificial Sequence
  Description of Artificial Sequence: Synthetic polynucleotide
gacatcgtgatgacccagtctccagattgcctggctgtgtctctgggcgagagggccaccatcaactgcaagtccagccagagtgttttatacacctccaacaataacaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgttgcagtttattattgtcagcactattataatactccgtggaagtttgtccaagggaccaaggtggaaatcaca

SEQ ID NO: 25802 - protein, 113 aa, Artificial Sequence
  Description of Artificial Sequence: Synthetic polypeptide
DIVMTQSPDCLAVSLGERATINCKSSQSVLYTSNNNNYLAWYQQKPGQPPKLLIYWASTRESGVPDRFSGSGSGTDFTLTISSLQAEDVAVYYCQHYYNTPWKFVQGTKVEIT

SEQ ID NO: 25803 - DNA, 324 bp, Artificial Sequence
  Description of Artificial Sequence: Synthetic polynucleotide
gaatttatgttgacgcagtctccaggcaccctgtattggtctccaggggaaagagccaccatctcgtgcagggccagtcagagtgttagcagcagctacttagtctggtatcagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggttgctcaccgctcactttcggcggagggaccaaggtggagatcaca

SEQ ID NO: 25804 - protein, 108 aa, Artificial Sequence
  Description of Artificial Sequence: Synthetic polypeptide
EFMLTQSPGTLYWSPGERATISCRASQSVSSSYLVWYQQKPGQAPRLLIYGASTRATGIPDRFSGSGSGTDFTLTISRLEPEYFAVYYCQQYGCSPLTFGGGTKVEIT

SEQ ID NO: 25805 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccaggcagagtgttgacagcagttatttagcctggtaccagcagaaacgtggccaggctcccaggctcctcatctatggtgcatccagcagggccactggcatcccagacaggttcagtggcagtgggtctgggacagacttcactctcaccatcagcaggctggagcctgaagattttgcagtatattactgtcagcagtatgaaagctcaccgtggacgttcggccaagggaccaaggtggaaatcaaa

SEQ ID NO: 25806 - protein, 108 aa, Artificial Sequence
  Description of Artificial Sequence: Synthetic polypeptide
EIVLTQSPGTLSLSPGERATLSCRARQSVDSSYLAWYQQKRGQAPRLLIYGASSRATGIPDRFSGSGSGTDFTLTISRLEPEDFAVYYCQQYESSPWTFGQGTKVEIK

SEQ ID NO: 25807 - DNA, 339 bp, Artificial Sequence
  Description of Artificial Sequence: Synthetic polynucleotide
gacatcgtgatgacccagtctccagactccctggctgtgtctctgggcgcgagggccaccatcaattgcaggtccagccagagtgttttatacagctccaacaattataactacttagcttggtaccagcagaaaccaggacagcctcctaagctgctcatttactgggcatctacccgggattccggggtccctgaccgattcagtggcagcgggtctgggacagatttcactctcaccatcagcagcctgcaggctgaagatgtggccgtttattactgtcagcaatattatactactccgtgcagttttggccaggggaccaagctggagatcaag

SEQ ID NO: 25808 - protein, 113 aa, Artificial Sequence
  Description of Artificial Sequence: Synthetic polypeptide
DIVMTQSPDSLAVSLGARATINCRSSQSVLYSSNNYNYLAWYQQKPGQPPKLLIYWASTRDSGVPDRFSGSGSGTDFTLTISSLQAEDVAVYYCQQYYTTPCSFGQGTKLEIK

SEQ ID NO: 25809 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggtcattagcaagtatttagcctggtttcagcagaaaccagggaaagcccctaagtccctgatctatgctgcatccagtttgcaaagtggggccccatcaaagttcagcggcagtggatctgggacagatttcactctcaccatcagcagcctgcagcctgaagattttgcaacttattactgccaacagtacagtaattacccgctcactttcggcggagggaccaaggtggagatcaaa

SEQ ID NO: 25810 - protein, 107 aa, Artificial Sequence
  Description of Artificial Sequence: Synthetic polypeptide
DIQMTQSPSSLSASVGDRVTITCRASQVISKYLAWFQQKPGKAPKSLIYAASSLQSGAPSKFSGSGSGTDFTLTISSLQPEDFATYYCQQYSNYPLTFGGGTKVEIK

SEQ ID NO: 25811 - DNA, 339 bp, Artificial Sequence
  Description of Artificial Sequence: Synthetic polynucleotide
gacagcgtgatgacccagtctccagactccctggctgtgtctctgggcgagagggccaccatcaactgcaagtccagccagagtgttttacacagctctaataaaaagaactacttagcttggtaccagcagaaaccaggacagcctcctaagctgctcatttactgggcatctacccgggaatccggggtccctgaccgattcagtggcagcgggtctgggacagatttcactctcaccatcagcagtctgcaggctgaagatgtggcagtttattactgtcagcaatattataggactccgtggacgttcggccaagggaccaaggtggaaatcaaa

SEQ ID NO: 25812 - protein, 113 aa, Artificial Sequence
  Description of Artificial Sequence: Synthetic polypeptide
DSVMTQSPDSLAVSLGERATINCKSSQSVLHSSNKKNYLAWYQQKPGQPPKLLIYWASTRESGVPDRFSGSGSGTDFTLTISSLQAEDVAVYYCQQYYRTPWTFGQGTKVEIK

SEQ ID NO: 25813 - DNA, 339 bp, Artificial Sequence
  Description of Artificial Sequence: Synthetic polynucleotide
gacatcgtgatgacccagtctccagattgcctggctgtgtctctgggcgagagggccaccatcaactgcaagtccagccagagtgttttatacacctccaacaataacaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgttgcagtttattattgtcagcactattataatactccgtggaagtttgtccaagggaccaaggtggaaatcaaa

SEQ ID NO: 25814 - protein, 113 aa, Artificial Sequence
  Description of Artificial Sequence: Synthetic polypeptide
DIVMTQSPDCLAVSLGERATINCKSSQSVLYTSNNNNYLAWYQQKPGQPPKLLIYWASTRESGVPDRFSGSGSGTDFTLTISSLQAEDVAVYYCQHYYNTPWKFVQGTKVEIK

SEQ ID NO: 25815 - DNA, 324 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagaaatttagcctggttccagcagaaacctggccaggctcccaggctcctcatctatggtgcatccatcagggccactggtatcccagccaggttcagtggcagtgggtctgggacagagttcactctcaccatctacagcctgcagtctgaagattttgcagtttattactgtcagcagtataataactggcctccgctcactttcggcggagggaccaaggtggagatcaaa

SEQ ID NO: 25816 - protein, 108 aa, Artificial Sequence
  Description of Artificial Sequence: Synthetic polypeptide
EIVMTQSPATLSVSPGERATLSCRASQSVSRNLAWFQQKPGQAPRLLIYGASIRATGIPARFSGSGSGTEFTLTIYSLQSEDFAVYYCQQYNNWPPLTFGGGTKVEIK

SEQ ID NO: 25817 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttgccagcagcttagcctggtaccagcagaaacctggccaggctcccaggctcctcatctttggtacatccaccagggccactggtatcccagccaggttcagtggcagtgggtctgggacagagttcactctcataatcagcagcctgcagtctgaagattttgcagtttattactgtcagcagtataatgactggccgtgcagttttggcctggggaccaagctggagatcaaa

SEQ ID NO: 25818 - protein, 107 aa, Artificial Sequence
  Description of Artificial Sequence: Synthetic polypeptide
EIVMTQSPATLSVSPGERATLSCRASQSVASSLAWYQQKPGQAPRLLIFGTSTRATGIPARFSGSGSGTEFTLIISSLQSEDFAVYYCQQYNDWPCSFGLGTKLEIK

SEQ ID NO: 25819 - DNA, 321 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagttttagcagcgcctacttagcctggtaccagcagaaacctggccaggctcccaggctcctcatctatggtacttccagcagggccactggcatcccagacaggttcagtggcagtgggtctgggacagatttcactctcaccatcggcagactggagcctgaagattttgcagtgtattactgtcaacagtatggtaactcaaggacgttcggccaagggaccaaggtggaaatcaaa

SEQ ID NO: 25820 - protein, 107 aa, Artificial Sequence
  Description of Artificial Sequence: Synthetic polypeptide
EIVLTQSPGTLSLSPGERATLSCRASQSFSSAYLAWYQQKPGQAPRLLIYGTSSRATGIPDRFSGSGSGTDFTLTIGRLEPEDFAVYYCQQYGNSRTFGQGTKVEIK

SEQ ID NO: 25821 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttgtacagctccaacagtcacaactacttagcttggtaccagcagaaaccaggacagcctcctaaactgctcatttactgggcatctatccgggaatccggggtccctgaccgattcagtggcagcgggtctgggacagatttcactctctccatcagcagcctgcaggctgaagatgtggcagtttattactgtcagcaatattatagtactccgtgcagttttggccaggggaccaagctggagatcaaa

SEQ ID NO: 25822 - protein, 113 aa, Artificial Sequence
  Description of Artificial Sequence: Synthetic polypeptide
DIVMTQSPDSLAVSLGERATINCKSSQSVLYSSNSHNYLAWYQQKPGQPPKLLIYWASIRESGVPDRFSGSGSGTDFTLSISSLQAEDVAVYYCQQYYSTPCSFGQGTKLEIK

SEQ ID NO: 25823 - DNA, 324 bp, Artificial Sequence
  Description of Artificial Sequence: Synthetic polynucleotide
gaaattgtgttgacgcagtcgccaggcaccctgtctttgtctccaggggagagagccaccctctcctgcagggccagtcagaatgttgacagcaactacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgttttactgtcagcagtatgaacgctcaccgtggacgttcggccaagggaccaaggtggaaatcaaa

SEQ ID NO: 25824 - protein, 108 aa, Artificial Sequence
  Description of Artificial Sequence: Synthetic polypeptide
EIVLTQSPGTLSLSPGERATLSCRASQNVDSNYLAWYQQKPGQAPRLLIYGASSRATGIPDRFSGSGSGTDFTLTISRLEPEDFAVFYCQQYERSPWTFGQGTKVEIK

SEQ ID NO: 25825 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagactgttttacacagctccaacaattataactacttagcttggtaccagcagaagccaggacagccccctaaggtgctcatttactggacatctacccgggaatccggggtccctgaccgattcagtggcagcgggtctgggacagatttcactctcaccatcagcagcctgcaggctgaagatgtggcagtttattactgtcagcaatattttagtagtcctccgacgttcggccaagggaccaaggtggaaatcaaa

SEQ ID NO: 25826 - protein, 113 aa, Artificial Sequence
  Description of Artificial Sequence: Synthetic polypeptide
DIVMTQSPDSLAVSLGERATINCKSSQTVLHSSNNYNYLAWYQQKPGQPPKVLIYWTSTRESGVPDRFSGSGSGTDFTLTISSLQAEDVAVYYCQQYFSSPPTFGQGTKVEIK

SEQ ID NO: 25827 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagcttcaacaattacaactacttagcttggtaccagcagaaaccaggacagcctcctaagaagctcatttactgggcatctacccgggaatccggggtccctgaccgattcagtggcagcgggtctgggacagatttcactctcaccatcagcagcctgcaggctgaagatgtggcagtttattcctgtcagcaatattatagtagtcctccgacgttcggccaagggaccaaggtggaaatcaaa

SEQ ID NO: 25828 - protein, 113 aa, Artificial Sequence
  Description of Artificial Sequence: Synthetic polypeptide
DIVMTQSPDSLAVSLGERATINCKSSQSVLYSFNNYNYLAWYQQKPGQPPKKLIYWASTRESGVPDRFSGSGSGTDFTLTISSLQAEDVAVYSCQQYYSSPPTFGQGTKVEIK

SEQ ID NO: 25829 - DNA, 339 bp, Artificial Sequence
  Description of Artificial Sequence: Synthetic polynucleotide
gacatcgttatgacccagtctccagactccctggctgtgtctctgggcgagagggccaccatcaactgcaagtccagccagagtgttttattcagctccaacaattataactacttagcttggtaccagcagagaccaggacagcctcctaacctgctcatttactgggcatctacccgggaatccggggtccctgaccgattcagtggcagcgggtctgggacagatttcactctcaccatcagcagcctgcaggctgctgatgtggcagtttattactgtcagcaatattatagttctcctccgacgttcggccaagggaccacggtgcaaatcaaa

SEQ ID NO: 25830 - protein, 113 aa, Artificial Sequence
  Description of Artificial Sequence: Synthetic polypeptide
DIVMTQSPDSLAVSLGERATINCKSSQSVLFSSNNYNYLAWYQQRPGQPPNLLIYWASTRESGVPDRFSGSGSGTDFTLTISSLQAADVAVYYCQQYYSSPPTFGQGTTVQIK

SEQ ID NO: 25831 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagactgttttacacagcttcaacaattataactacttagcttggtaccagcagaagccaggacagccccctaaggtgctcatttactggacatctacccgggaatccggggtccctgaccgattcagtggcagcgggtctgggacagatttcactctcaccatcagcagcctgcaggctgaagatgtggcagtttattactgtcagcaatattttagtagtcctccgacgttcggccaagggaccaaggtggaaatcaaa

SEQ ID NO: 25832 - protein, 113 aa, Artificial Sequence
  Description of Artificial Sequence: Synthetic polypeptide
DIVMTQSPDSLAVSLGERATINCKSSQTVLHSFNNYNYLAWYQQKPGQPPKVLIYWTSTRESGVPDRFSGSGSGTDFTLTISSLQAEDVAVYYCQQYFSSPPTFGQGTKVEIK

SEQ ID NO: 25833 - DNA, 324 bp, Artificial Sequence
  Description of Artificial Sequence: Synthetic polynucleotide
gaaattgtgttgacgcagtctccaggcaccctgtatttgtcttcaggggaaagagccaccctctcctgcagggccagtcagagtgtttacagcagctacttagcctggtaccagcagaaacctgcccaggctcccaggctcctcatttatggtgcatccagccggtccactggcatcccagacaggttcagtggcagtgggtctgggacagacttcgctctcaccatcagcagactggagcctgaagattttgcagtgtattactgtcagcactatgataactcaccgtggacgttcggccaagggaccaaggtggaaatcaaa

SEQ ID NO: 25834 - protein, 108 aa, Artificial Sequence
  Description of Artificial Sequence: Synthetic polypeptide
EIVLTQSPGTLYLSSGERATLSCRASQSVYSSYLAWYQQKPAQAPRLLIYGASSRSTGIPDRFSGSGSGTDFALTISRLEPEDFAVYYCQHYDNSPWTFGQGTKVEIK

SEQ ID NO: 25835 - DNA, 324 bp, Artificial Sequence
  Description of Artificial Sequence: Synthetic polynucleotide
gaaattgtgttgacgcagtctccaggcaccctgtatttgtctccaggggaaagagccaccctctcctgcagggccagtcagagtgtttacagcagctacttagcctggtaccagcagaaacctgcccaggctcccaggctcctcatctatggtgcatccagccggtccactggcatcccagacaggttcagtggcagtgggtctgggacagacttcgctctcaccatcagcagactggagcctgaagattttgcagtgtattactgtcagcactatgataactcaccgtggacgttcggccaagggaccaaggtggaaatcaaa

SEQ ID NO: 25836 - protein, 108 aa, Artificial Sequence
  Description of Artificial Sequence: Synthetic polypeptide
EIVLTQSPGTLYLSPGERATLSCRASQSVYSSYLAWYQQKPAQAPRLLIYGASSRSTGIPDRFSGSGSGTDFALTISRLEPEDFAVYYCQHYDNSPWTFGQGTKVEIK

SEQ ID NO: 25837 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagttccaacaataataactacttagcttggtaccagcagaaggcaggacagcctcctaagctgctcatttactgggcatctacccgggaatccggggtccctgaccgattcagtggcagcgggtctgggacagatttcactctcaccatcagcagcctgcaggcggaagatgtggcagtttattactgtcagcaatattatagtattcctccgacgttcggccaagggaccaaggtggaaatcaaa

SEQ ID NO: 25838 - protein, 113 aa, Artificial Sequence
  Description of Artificial Sequence: Synthetic polypeptide
DIVMTQSPDSLAVSLGERATINCKSSQSVLYSSNNNNYLAWYQQKAGQPPKLLIYWASTRESGVPDRFSGSGSGTDFTLTISSLQAEDVAVYYCQQYYSIPPTFGQGTKVEIK

SEQ ID NO: 25839 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaagtatttagcctggtttcagcagaaaccagggaaagcccctaagtccctgatctatgctgcatccagtttgcaaggtggggccccatctaagttcagcggcagtggatctgggacagatttcactctcaccatcagcagcctgcagcctgaagattttgcaacttattactgccaacagtacagtaattacccactcactttcggcggagggaccagggtggagatcaaa

SEQ ID NO: 25840 - protein, 107 aa, Artificial Sequence; identical to SEQ ID NO: 25786
  Description of Artificial Sequence: Synthetic polypeptide

SEQ ID NO: 25841 - DNA, 321 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagatttttagcagcagctacttagcctggtaccagcagaaacctggccagtctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacggacgttcggccaagggaccaaggtggaaatcaaa

SEQ ID NO: 25842 - protein, 107 aa, Artificial Sequence
  Description of Artificial Sequence: Synthetic polypeptide
EIVLTQSPGTLSLSPGERATLSCRASQIFSSSYLAWYQQKPGQSPRLLIYGASSRATGIPDRFSGSGSGTDFTLTISRLEPEDFAVYYCQQYGSSRTFGQGTKVEIK

SEQ ID NO: 25843 - DNA, 321 bp, Artificial Sequence
  Description of Artificial Sequence: Synthetic polynucleotide
gaaatagtgatgacgcagtctccagccaccctgtctctgtctccaggggaaagagccaccctctcctgcagggccagtctgagtgttgtcaacagcttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcaatttattactgtcagcagtataatgactggccgtgcagttttggccaggggaccaagctggagatcaaa

SEQ ID NO: 25844 - protein, 107 aa, Artificial Sequence
  Description of Artificial Sequence: Synthetic polypeptide
EIVMTQSPATLSLSPGERATLSCRASLSVVNSLAWYQQKPGQAPRLLIYGASTRATGIPARFSGSGSGTEFTLTISSLQSEDFAIYYCQQYNDWPCSFGQGTKLEIK

SEQ ID NO: 25845 - DNA, 339 bp, Artificial Sequence
  Description of Artificial Sequence: Synthetic polynucleotide
gacatcgtgatgacccagtctccagactgcctggctgtgtctctgggcgagagggccaccatcagctgcatgtccagccagagtgttttacacagcttcaacaataagaactacttaacttggtaccagcagaaaccaggacagcctcctaagctgctcatttactgggcatctacttgggaatccggggtccctgaccgattcagtggcagcgggtctgggacagatttcagtctcccgatcggcagcctgcaggctgaagatgtggcagtttattactgtcagcaatattatagtattcctccgacgttcggccaagggaccaaggtggaaatcaaa

SEQ ID NO: 25846 - protein, 113 aa, Artificial Sequence
  Description of Artificial Sequence: Synthetic polypeptide
DIVMTQSPDCLAVSLGERATISCMSSQSVLHSFNNKNYLTWYQQKPGQPPKLLIYWASTWESGVPDRFSGSGSGTDFSLPIGSLQAEDVAVYYCQQYYSIPPTFGQGTKVEIK

SEQ ID NO: 25847 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttgtacagctccaacagtcacaactacttagcttggtaccagcagaaaccaggacagcctcctaaactgctcattttctgggcatctatccgggaatccggggtccctgaccgattcagtggcagcgggtctgggacagatttcactctctccatcagcagcatgcaggctgaagatgtggcagtttattactgtcagcaatattatagtactccgtgcagttttggccaggggaccaagctggagatcaaa

SEQ ID NO: 25848 - protein, 113 aa, Artificial Sequence
  Description of Artificial Sequence: Synthetic polypeptide
DIVMTQSPDSLAVSLGERATINCKSSQSVLYSSNSHNYLAWYQQKPGQPPKLLIFWASIRESGVPDRFSGSGSGTDFTLSISSMQAEDVAVYYCQQYYSTPCSFGQGTKLEIK

SEQ ID NO: 25849 - DNA, 339 bp, Artificial Sequence
  Description of Artificial Sequence: Synthetic polynucleotide
gacatcgtgatgacccagtctccagactccctggctgtgtctctgggcgagagggccaccatcaactgtaagtccagccagagtattttatacagctccaacaataataactacttagcttggttccagcagaaaccaggacagcctcctaagctgctcatttattgggcatctacccgggaatccggggtccctgaccgattcagtggcagcgggtgtgggacagatttcactctcaccatcagcagcctgcaggctgaagatgtggcagtttattactgtcagcaatattatattactcctccgacgttcggccaagggaccaaggtggaaatcaaa

SEQ ID NO: 25850 - protein, 113 aa, Artificial Sequence
  Description of Artificial Sequence: Synthetic polypeptide
DIVMTQSPDSLAVSLGERATINCKSSQSILYSSNNNNYLAWFQQKPGQPPKLLIYWASTRESGVPDRFSGSGCGTDFTLTISSLQAEDVAVYYCQQYYITPPTFGQGTKVEIK

SEQ ID NO: 25851 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccgggccactggcatcccagacaggttcagtggcagtgggtctgggacagacttcgctctcaccatcagcagactggagcctgaagattttgcagtgtattactgtcagcactatgataactcaccgtggacgttcggccaagggaccaaggtggaaatcaaa

SEQ ID NO: 25852 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRATGIPDRFSGSGSGTDFALTISRLEPEDFAVYYCQHYDNSPWTFGQGTKVEIK

SEQ ID NO: 25853 - DNA, 339 bp, Artificial Sequence
  Description of Artificial Sequence: Synthetic polynucleotide
gacatcgttatgacccagtctccagactccctggctgtgtctctgggcgagagggccaccatcaattgcaagtccagccagagtgttttattcagctccaacaattataattacttagcttggtaccagcagagaccaggacagcctcataacctgctcatttactgggcatctacccgggaatccggggtccctgaccgattcagtggcagcgggtctgggacagatttcactctcaccatcagcagcctgcaggctgctgatgtggcagtttattactgtcagcaatatcatagttctcctctgacgttcggccaagggaccacggtgcaaatcaaa

SEQ ID NO: 25854 - protein, 113 aa, Artificial Sequence
  Description of Artificial Sequence: Synthetic polypeptide
DIVMTQSPDSLAVSLGERATINCKSSQSVLFSSNNYNYLAWYQQRPGQPHNLLIYWASTRESGVPDRFSGSGSGTDFTLTISSLQAADVAVYYCQQYHSSPLTFGQGTTVQIK

SEQ ID NO: 25855 - DNA, 324 bp, Artificial Sequence; identical to SEQ ID NO: 25805
  Description of Artificial Sequence: Synthetic polynucleotide

SEQ ID NO: 25856 - protein, 108 aa, Artificial Sequence; identical to SEQ ID NO: 25806
  Description of Artificial Sequence: Synthetic polypeptide

SEQ ID NO: 25857 - DNA, 324 bp, Artificial Sequence
  Description of Artificial Sequence: Synthetic polynucleotide
gaaattgtgttgacgcagtctccaggcaccctgtctttgtctccaggggaaagagccaccctctcatgcagggccagtcagagtgtttacagcagctacttagcctggtaccagcagaaacctggccaggctcccaggctcctcatttatggtgcatccagccgggccactggcatcccagacaggttcagtggcagtgggtctgggacagacttcgctctcaccatcagcagactggagcctgaagattttgcagtgtattactgtcagcactctgataactcaccgtggacgttcggccaagggaccaaggtggaaatcaaa

SEQ ID NO: 25858 - protein, 108 aa, Artificial Sequence
  Description of Artificial Sequence: Synthetic polypeptide
EIVLTQSPGTLSLSPGERATLSCRASQSVYSSYLAWYQQKPGQAPRLLIYGASSRATGIPDRFSGSGSGTDFALTISRLEPEDFAVYYCQHSDNSPWTFGQGTKVEIK

SEQ ID NO: 25859 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtattttatacagctccaacaattacaactacttagcttggtaccagcagaaaccaggacagcctcctaagttgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtggacgttcggccaagggaccaaggtggaaatcaaa

SEQ ID NO: 25860 - protein, 113 aa, Artificial Sequence
  Description of Artificial Sequence: Synthetic polypeptide
DIVMTQSPDSLAVSLGERATINCKSSQSILYSSNNYNYLAWYQQKPGQPPKLLIYWASTRESGVPDRFSGSGSGTDFTLTISSLQAEDVAVYYCQQYYSTPWTFGQGTKVEIK

SEQ ID NO: 25861 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtctgggacagacttcgctctcaccatcagcagactggagcctgaagattgtgcagtgtattactgtcagcactctgataactcaccgtggacgttcggccaagggaccaaggtggaaatcaaa

SEQ ID NO: 25862 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRSTGIPDRFSGSGSGTDFALTISRLEPEDCAVYYCQHSDNSPWTFGQGTKVEIK

SEQ ID NO: 25863 - DNA, 324 bp, Artificial Sequence
  Description of Artificial Sequence: Synthetic polynucleotide
gaaattgtgttgacgcagtctccaggcacccggtatttgtctccaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtgtgggacagacttcgctctcaccatcagcagagtggagcctgaagattgtgcagtgtattactgtcagcactctgataactcaccgtggacgttcggccaagggaccaaggtggaaatcaaa

SEQ ID NO: 25864 - protein, 108 aa, Artificial Sequence
  Description of Artificial Sequence: Synthetic polypeptide
EIVLTQSPGTRYLSPGERATLSCRASQSVYSSYLAWYQQKPGQAPRLLIYGASSRSTGIPDRFSGSGCGTDFALTISRVEPEDCAVYYCQHSDNSPWTFGQGTKVEIK

SEQ ID NO: 25865 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtctgggacagacttcgctctcaccatcagcagagtggagcctgaagattgtgcagtgtattactgtcagcactctgataactcaccgtggacgttcggccaagggaccaaggtggaaatcaaa

SEQ ID NO: 25866 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRSTGIPDRFSGSGSGTDFALTISRVEPEDCAVYYCQHSDNSPWTFGQGTKVEIK

SEQ ID NO: 25867 - DNA, 324 bp, Artificial Sequence
  Description of Artificial Sequence: Synthetic polynucleotide
gaatttatgttgacgcagtctccaggcaccctgtatttgtctccaggggaaagagccaccctctcgtgcagggccagtcagagtgttagcagcagctacttagtctggtatcagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggttgctcaccgctcactttcggcggagggaccaaggtggagatcaca

SEQ ID NO: 25868 - protein, 108 aa, Artificial Sequence
  Description of Artificial Sequence: Synthetic polypeptide
EFMLTQSPGTLYLSPGERATLSCRASQSVSSSYLVWYQQKPGQAPRLLIYGASTRATGIPDRFSGSGSGTDFTLTISRLEPEYFAVYYCQQYGCSPLTFGGGTKVEIT

SEQ ID NO: 25869 - DNA, 339 bp, Artificial Sequence
  Description of Artificial Sequence: Synthetic polynucleotide
gacatcgtgatgacccagtctccagattgcctggctgtgtctctgggcgagagggccaccatcaactgcaagtccagccagagtgttttatacacctccaacaataacaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgttgcagtttattattgtcagcactacaatgaaactccagggaagtttgtccaagtgaccaaggtggaaatcaca

SEQ ID NO: 25870 - protein, 113 aa, Artificial Sequence
  Description of Artificial Sequence: Synthetic polypeptide
DIVMTQSPDCLAVSLGERATINCKSSQSVLYTSNNNNYLAWYQQKPGQPPKLLIYWASTRESGVPDRFSGSGSGTDFTLTISSLQAEDVAVYYCQHYNETPGKFVQVTKVEIT

SEQ ID NO: 25871 - DNA, 324 bp, Artificial Sequence
  Description of Artificial Sequence: Synthetic polynucleotide
gaaattgtgttgacgcagtctccaggcaccctgtatttgtcttcaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtgtgggacagacttcgctctcaccatcagcagagtggagcctgaagattttgcagtgtattactgtcagcattctgataactcaccgtggacgttcggccaagggaccaaggtggaaatcaaa

SEQ ID NO: 25872 - protein, 108 aa, Artificial Sequence
  Description of Artificial Sequence: Synthetic polypeptide
EIVLTQSPGTLYLSSGERATLSCRASQSVYSSYLAWYQQKPGQAPRLLIYGASSRSTGIPDRFSGSGCGTDFALTISRVEPEDFAVYYCQHSDNSPWTFGQGTKVEIK

SEQ ID NO: 25873 - DNA, 339 bp, Artificial Sequence
  Description of Artificial Sequence: Synthetic polynucleotide
gacatcgtgatgacccagtctccagactccctggctgtgtctctgggcgagagggccaccaccaattgtaagtccagccagagtgttttacacaggtccaacaattacaactacttagcgtggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctccgacgttcggccaagggaccaaggtggaaatcaaa

SEQ ID NO: 25874 - protein, 113 aa, Artificial Sequence
  Description of Artificial Sequence: Synthetic polypeptide
DIVMTQSPDSLAVSLGERATTNCKSSQSVLHRSNNYNYLAWYQQKPGQPPKLLIYWASTRESGVPDRFSGSGSGTDFTLTISSLQAEDVAVYYCQQYYSTPPTFGQGTKVEIK

SEQ ID NO: 25875 - DNA, 324 bp, Artificial Sequence
  Description of Artificial Sequence: Synthetic polynucleotide
gaacttgtgttgacgcagtctccaggcaccctgtctttgtctccagggaaaagagtcaccctctcctgcagggccagtcagaatatttacagcagctacttagcctggtaccagcagaaacctggccaggctcccagactcctcatctatggtgcatccagcagggccactggcatcccagacaggttcagtggcagtgggtctgggacagacttcactctcaccatcaccagactggagcctgaagattttgcagtgtattgctgtcagcagtatgaaagctcaccgtggaccttcggccaagggaccaaggtggaaatcaaa

SEQ ID NO: 25876 - protein, 108 aa, Artificial Sequence
  Description of Artificial Sequence: Synthetic polypeptide
ELVLTQSPGTLSLSPGKRVTLSCRASQNIYSSYLAWYQQKPGQAPRLLIYGASSRATGIPDRFSGSGSGTDFTLTITRLEPEDFAVYCCQQYESSPWTFGQGTKVEIK

SEQ ID NO: 25877 - DNA, 324 bp, Artificial Sequence
  Description of Artificial Sequence: Synthetic polynucleotide
gaaattgtgttgacgcagtctccaggcaccctgtctttgtctccaggggaaatacccaccctctcctgcagggccagtcagagtgttgacagcggctacttagcctggtaccagcagaaacctggccaggctcccaggctcctcatctatggtgcatccagcagggcccctggcatcccagacaggttcagtggcagtgggtctgggacagacttcactctcaccatcagcagactggaacctgaagattttgcagtgtattactgtcagcagtatgaaagctcaccgtggacgttcggccaagggaccaaggtggaaatcaaa

SEQ ID NO: 25878 - protein, 108 aa, Artificial Sequence
  Description of Artificial Sequence: Synthetic polypeptide
EIVLTQSPGTLSLSPGEIPTLSCRASQSVDSGYLAWYQQKPGQAPRLLIYGASSRAPGIPDRFSGSGSGTDFTLTISRLEPEDFAVYYCQQYESSPWTFGQGTKVEIK

SEQ ID NO: 25879 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattaacagcaactacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgttttactgtcagcagtatgagagctcaccgtggacgttcggccaagggaccaaggtggaaatcaaa

SEQ ID NO: 25880 - protein, 108 aa, Artificial Sequence
  Description of Artificial Sequence: Synthetic polypeptide
EIVLTQSPGTLSLSPGERATLSCRASQSINSNYLAWYQQKPGQAPRLLIYGASSRATGIPDRFSGSGSGTDFTLTISRLEPEDFAVFYCQQYESSPWTFGQGTKVEIK

SEQ ID NO: 25881 - DNA, 339 bp, Artificial Sequence
  Description of Artificial Sequence: Synthetic polynucleotide
gacatcgtgttgacccagtcgccagactccctggctgtgtctctgggcgagagggccaccatcaactgcaagtccagacagagtgttttatacagctccaacaattacaactacttaacttggtaccagcagaaaccaggacagcctcctaagctgctcatttactgggcatctacccgggaatccggggtccctgaccgattcagtggcagcgggtctgggacagatttcactctcaccatcagcagcctgcaggctgaagacgtggcagtttattactgtcagcaatattatagttctcctcctactttcggcggagggaccaaggtggagatcaaa

SEQ ID NO: 25882 - protein, 113 aa, Artificial Sequence
  Description of Artificial Sequence: Synthetic polypeptide
DIVLTQSPDSLAVSLGERATINCKSRQSVLYSSNNYNYLTWYQQKPGQPPKLLIYWASTRESGVPDRFSGSGSGTDFTLTISSLQAEDVAVYYCQQYYSSPPTFGGGTKVEIK

SEQ ID NO: 25883 - DNA, 339 bp, Artificial Sequence
  Description of Artificial Sequence: Synthetic polynucleotide
gacatcgtgatgacccagtctccagattgcctggctgtgtctctgggcgagagggccaccatcaactgcaagtccagccagagtgttttatacacctccaacaataacaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgttgcagtttattattgtcagcaatattataatactccgtggacgttcgtccaagggaccaaggtggaaatcaaa

SEQ ID NO: 25884 - protein, 113 aa, Artificial Sequence
  Description of Artificial Sequence: Synthetic polypeptide
DIVMTQSPDCLAVSLGERATINCKSSQSVLYTSNNNNYLAWYQQKPGQPPKLLIYWASTRESGVPDRFSGSGSGTDFTLTISSLQAEDVAVYYCQQYYNTPWTFVQGTKVEIK

SEQ ID NO: 25885 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttgacagcagctacttagcctggtaccagcagaaacctggccaggctcccaggctcctcatctatggtgcatccagcagggcccctggcatcccagacaggttcagtggcagtgggtctgggacagacttcactctcaccatcagcagactggagcctgaagattttgcagtgtattactgtcagcagtatgaaagctcaccgtggacgttcggccaagggaccaaggtggaaatcaaa

SEQ ID NO: 25886 - protein, 108 aa, Artificial Sequence
  Description of Artificial Sequence: Synthetic polypeptide
EIVLTQSPGTLSLSPGERATLSCRASQSVDSSYLAWYQQKPGQAPRLLIYGASSRAPGIPDRFSGSGSGTDFTLTISRLEPEDFAVYYCQQYESSPWTFGQGTKVEIK

SEQ ID NO: 25887 - DNA, 321 bp, Artificial Sequence
  Description of Artificial Sequence: Synthetic polynucleotide
gacatccagatgacccagtctccatcctcactgtctgcatcagtaggagacagagtcaccatcacttgtcgggcgagtcagggcattggcaagtatttagcctggtttcagcagaaaccagggaaagcccctaagtccctgatctatactacatccagtttgcaaagtggggccccatcaaagttcagcggcagtggatctgggacagatttcactctcaccatcagcagcctgcagtatgaagattttgcaacttattactgccaacagtacagtaattacccgctcactttcggcggagggaccaaggtggagatcaat

SEQ ID NO: 25888 - protein, 107 aa, Artificial Sequence
  Description of Artificial Sequence: Synthetic polypeptide
DIQMTQSPSSLSASVGDRVTITCRASQGIGKYLAWFQQKPGKAPKSLIYTTSSLQSGAPSKFSGSGSGTDFTLTISSLQYEDFATYYCQQYSNYPLTFGGGTKVEIN

SEQ ID NO: 25889 - DNA, 321 bp, Artificial Sequence
  Description of Artificial Sequence: Synthetic polynucleotide
gacatccagatgacccagtctccatcctcactgtctgcttctgtaggggacagagtcaccatcacttgtcgggcgagtcagggcattggcaggtatttagcctggtttcagcagaaaccagggagagcccctaagtccctgatctatactgcatccagtttgcaaagtggggccccatcaaagttcagcggcagtggatctgggacagatttcactctcaccatcagcagcctgcagcctgaagattttgcaacttattactgccaacagtacagtaattacccgctcactttcggcggagggaccaaagtggagatcaat

SEQ ID NO: 25890 - protein, 107 aa, Artificial Sequence
  Description of Artificial Sequence: Synthetic polypeptide
DIQMTQSPSSLSASVGDRVTITCRASQGIGRYLAWFQQKPGRAPKSLIYTASSLQSGAPSKFSGSGSGTDFTLTISSLQPEDFATYYCQQYSNYPLTFGGGTKVEIN

SEQ ID NO: 25891 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtgtgggacagacttcgctctcaccatcagcagactggagcctgaagattgtgcagtgtattactgtcagcactctgataactcaccgtggacgttcggccaagggaccaaggtggaaatcaaa

SEQ ID NO: 25892 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRSTGIPDRFSGSGCGTDFALTISRLEPEDCAVYYCQHSDNSPWTFGQGTKVEIK

SEQ ID NO: 25893 - DNA, 324 bp, Artificial Sequence
  Description of Artificial Sequence: Synthetic polynucleotide
gaaattgtgttgacgcagtctccaggcaccctgtatttgtctccaggggaaagagccaccctctcgtgcagggccagtcagagtgttagcagcagctacttagcctggtaccagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggtaactcaccgctcactttcggcggagggaccaaggtggagatcaaa

SEQ ID NO: 25894 - protein, 108 aa, Artificial Sequence
  Description of Artificial Sequence: Synthetic polypeptide
EIVLTQSPGTLYLSPGERATLSCRASQSVSSSYLAWYQQKPGQAPRLLIYGASTRATGIPDRFSGSGSGTDFTLTISRLEPEYFAVYYCQQYGNSPLTFGGGTKVEIK

SEQ ID NO: 25895 - DNA, 324 bp, Artificial Sequence
  Description of Artificial Sequence: Synthetic polynucleotide
gaaattgtgttgacgcagtctccaggcaccctgtctttgtctccaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtctgggacagacttcgctctcaccatcagcagactggagcctgaagattttgcagtgtattactgtcagcactctgataactcaccgtggacgttcggccaagggaccaaggtggaaatcaaa

SEQ ID NO: 25896 - protein, 108 aa, Artificial Sequence
  Description of Artificial Sequence: Synthetic polypeptide
EIVLTQSPGTLSLSPGERATLSCRASQSVYSSYLAWYQQKPGQAPRLLIYGASSRSTGIPDRFSGSGSGTDFALTISRLEPEDFAVYYCQHSDNSPWTFGQGTKVEIK

SEQ ID NO: 25897 - DNA, 324 bp, Artificial Sequence
  Description of Artificial Sequence: Synthetic polynucleotide
gaaattgtgttgacgcagtctccaggcaccctgtatttgtcttcaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtgtgggacagacttcgctctcaccatcagcagagtggagcctgaagattgtgcagtgtattactgtcagcattctgataactcaccgtggacgttcggccaagggaccaaggtggaaatcaaa

SEQ ID NO: 25898 - protein, 108 aa, Artificial Sequence
  Description of Artificial Sequence: Synthetic polypeptide
EIVLTQSPGTLYLSSGERATLSCRASQSVYSSYLAWYQQKPGQAPRLLIYGASSRSTGIPDRFSGSGCGTDFALTISRVEPEDCAVYYCQHSDNSPWTFGQGTKVEIK

SEQ ID NO: 25899 - DNA, 339 bp, Artificial Sequence
  Description of Artificial Sequence: Synthetic polynucleotide
gacatcgttatgacccagtctccagactccctggctgtgtctctgggcgagagggccaccatcaattgcaagtccagccagagtgttttattcagctccaacaattataattacttagcttggtaccagcagagaccaggacagcctcctaacctgctcatttactgggcatctacccgggaatccggggtccctgaccgattcagtggcagcgggtctgggacagatttcactctcaccatcagcagcctgcaggctgctgatgtggcagtttattactgtcagcaatattatagttctcctctgacgttcggccaagggaccacggtgcaaatcaaa

SEQ ID NO: 25900 - protein, 113 aa, Artificial Sequence
  Description of Artificial Sequence: Synthetic polypeptide
DIVMTQSPDSLAVSLGERATINCKSSQSVLFSSNNYNYLAWYQQRPGQPPNLLIYWASTRESGVPDRFSGSGSGTDFTLTISSLQAADVAVYYCQQYYSSPLTFGQGTTVQIK

SEQ ID NO: 25901 - DNA, 339 bp, Artificial Sequence
  Description of Artificial Sequence: Synthetic polynucleotide
gacatcgtgatgacccagtctccagattgcctggctgtgtctctgggcgagagggccaccatcaactgcaagtccagccagagtgttttatacacctccaacaataacaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgttgcagtttattatcgtcagcactacaatgatactccagggaagtttgtccaaggcatcatggtggaaatcaca

SEQ ID NO: 25902 - protein, 113 aa, Artificial Sequence
  Description of Artificial Sequence: Synthetic polypeptide
DIVMTQSPDCLAVSLGERATINCKSSQSVLYTSNNNNYLAWYQQKPGQPPKLLIYWASTRESGVPDRFSGSGSGTDFTLTISSLQAEDVAVYYRQHYNDTPGKFVQGIMVEIT

SEQ ID NO: 25903 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcagctacttagcctggtaccagcagaaacgtggccaggctcccaggctcctcatctatggtgcatccagcagggccactggcattccagacaggttcagtggcagtgggtctgggacagacttcactctcaccatcagcagactggagcctgaagattttgcagtgtattactgtcagcagtatgaaagctcaccgtggacgttcggccaagggaccaaggtggaaatcaaa

SEQ ID NO: 25904 - protein, 108 aa, Artificial Sequence
  Description of Artificial Sequence: Synthetic polypeptide
EIVLTQSPGTLSLSPGERATLSCRASQSVSSSYLAWYQQKRGQAPRLLIYGASSRATGIPDRFSGSGSGTDFTLTISRLEPEDFAVYYCQQYESSPWTFGQGTKVEIK

SEQ ID NO: 25905 - DNA, 324 bp, Artificial Sequence
  Description of Artificial Sequence: Synthetic polynucleotide
gaaattgtgttgacgcagtctccaggcacccggtatttgtctccagtggaaagagccaccctctcatgcagggccagtcagagtgtttacagcagctacttagcctggtaccagcagaaacctggccaggctcccaggctcctcatttatggtgcatccagccggtccactggcctcccagacaggttcagtggcagtgggtgtgggacagacttcgctctcaccatcagcagagtggagcctgaagattgtgcagtgtattactgtcagcattctgataactcaccgtggacgttcggccaagggaccaaggtggaaatcaaa

SEQ ID NO: 25906 - protein, 108 aa, Artificial Sequence
  Description of Artificial Sequence: Synthetic polypeptide
EIVLTQSPGTRYLSPVERATLSCRASQSVYSSYLAWYQQKPGQAPRLLIYGASSRSTGLPDRFSGSGCGTDFALTISRVEPEDCAVYYCQHSDNSPWTFGQGTKVEIK

SEQ ID NO: 25907 - DNA, 324 bp, Artificial Sequence
  Description of Artificial Sequence: Synthetic polynucleotide
gaaattgtgttgacgcagtctccaggcaccctgtcttggtctccaggggaaagagccaccctctcgtgcagggccagtcagagtgttagcagcagctacttagcctggtaccagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggtaactcaccgctcactttcggcggagggaccaaggtggagatcaaa

SEQ ID NO: 25908 - protein, 108 aa, Artificial Sequence
  Description of Artificial Sequence: Synthetic polypeptide
EIVLTQSPGTLSWSPGERATLSCRASQSVSSSYLAWYQQKPGQAPRLLIYGASTRATGIPDRFSGSGSGTDFTLTISRLEPEYFAVYYCQQYGNSPLTFGGGTKVEIK

SEQ ID NO: 25909 - DNA, 324 bp, Artificial Sequence
  Description of Artificial Sequence: Synthetic polynucleotide
gaatttatgttgacgcagtctccaggcaccctgtattggtctccaggggaaagagccaccctctcgagcagggccagtgagagtgttagcagcagctacttagtctggtatcagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggttgctcaccgctcactttcggcggagggaccaaggtggagatcaca

SEQ ID NO: 25910 - protein, 108 aa, Artificial Sequence
  Description of Artificial Sequence: Synthetic polypeptide
EFMLTQSPGTLYWSPGERATLSSRASESVSSSYLVWYQQKPGQAPRLLIYGASTRATGIPDRFSGSGSGTDFTLTISRLEPEYFAVYYCQQYGCSPLTFGGGTKVEIT

SEQ ID NO: 25911 - DNA, 324 bp, Artificial Sequence
  Description of Artificial Sequence: Synthetic polynucleotide
gaatttatgttgacgcagtctccaggcaccctgtcttggtctccaggggaaagagccaccctctcgtgcagggccagtgagagtgttagcagcagctacttagtctggtatcagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggttgctcaccgctcactttcggcggagggaccaaggtggagatcaca

SEQ ID NO: 25912 - protein, 108 aa, Artificial Sequence
  Description of Artificial Sequence: Synthetic polypeptide
EFMLTQSPGTLSWSPGERATLSCRASESVSSSYLVWYQQKPGQAPRLLIYGASTRATGIPDRFSGSGSGTDFTLTISRLEPEYFAVYYCQQYGCSPLTFGGGTKVEIT

SEQ ID NO: 25913 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtctgggacagacttcgctctcaccatcagcagactggagcctgaagattttgcagtgtattactgtcagcactctgataactcaccgtggacgttcggccaagggaccaaggtggaaatcaaa

SEQ ID NO: 25914 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRSTGIPDRFSGSGSGTDFALTISRLEPEDFAVYYCQHSDNSPWTFGQGTKVEIK

SEQ ID NO: 25915 - DNA, 324 bp, Artificial Sequence
  Description of Artificial Sequence: Synthetic polynucleotide
gaaattgtgttgacgcagtctccaggcaccctgtcttggtctccaggggaaagagccaccctctcgtgcagggccagtcagagtgttagcagcagctacttagcctggtaccagcagaaacctggccaggctcccaggctcctcatctatggtgcatccaccagggcctctggcatcccagacaggttcagtggcagtgggtctgggacagacttcactctcaccatcagcagactggagcctgaatattttgcagtttattactgtcagcagtatggtaactcaccgctcactttcggcggagggaccaaggtggagatcaaa

SEQ ID NO: 25916 - protein, 108 aa, Artificial Sequence
  Description of Artificial Sequence: Synthetic polypeptide
EIVLTQSPGTLSWSPGERATLSCRASQSVSSSYLAWYQQKPGQAPRLLIYGASTRASGIPDRFSGSGSGTDFTLTISRLEPEYFAVYYCQQYGNSPLTFGGGTKVEIK

SEQ ID NO: 25917 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatttaggctggtatcagcagaaaccagggaaagcccctaagcgcctgatctgtgctgcatccagtttgcaaagtggggtcccatcaaggttcagcggcagtggatctgggaccgagttcactctcacaatcagcagcctgcagcctgaggattttgcaacttatttctgtctacagcataatgattacccattcactttcggccctgggaccaaagtggatatcaaa

SEQ ID NO: 25918 - protein, 107 aa, Artificial Sequence
  Description of Artificial Sequence: Synthetic polypeptide
DIQMTQSPSSLSASVGDRVTITCRASQDIRNDLGWYQQKPGKAPKRLICAASSLQSGVPSRFSGSGSGTEFTLTISSLQPEDFATYFCLQHNDYPFTFGPGTKVDIK

SEQ ID NO: 25919 - DNA, 324 bp, Artificial Sequence
  Description of Artificial Sequence: Synthetic polynucleotide
gaaattgtgttgacgcagtctccaggcacccggtatttgtctccaggggaaagagccaccctctcatgcagggccagtcagagtgtttacagcagctacttagcctggtaccagcagaaacctggccaggctcccaggctcctcatttatggtgcatccagccggtccacggtcctcccagacaggttcagtggcagtgggtctgggacagacttcgctctcaccatcagcagagtggagcctgaagattgtgcagtgtattactgtcagcactctgataactcaccgtggacgttcggccaagggaccaaggtggaaatcaaa

SEQ ID NO: 25920 - protein, 108 aa, Artificial Sequence
  Description of Artificial Sequence: Synthetic polypeptide
EIVLTQSPGTRYLSPGERATLSCRASQSVYSSYLAWYQQKPGQAPRLLIYGASSRSTVLPDRFSGSGSGTDFALTISRVEPEDCAVYYCQHSDNSPWTFGQGTKVEIK

SEQ ID NO: 25921 - DNA, 324 bp, Artificial Sequence
  Description of Artificial Sequence: Synthetic polynucleotide
gaatttatgttgacgcagtctccaggcaccctgtgtttgtctccaggggaaagagccaccctctcgtgcagggccagtcagagtgttagcagcagctacttagtctggtatcagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggttgctcaccgctcactttcggcggagggaccaaggtggagatcaca

SEQ ID NO: 25922 - protein, 108 aa, Artificial Sequence
  Description of Artificial Sequence: Synthetic polypeptide
EFMLTQSPGTLCLSPGERATLSCRASQSVSSSYLVWYQQKPGQAPRLLIYGASTRATGIPDRFSGSGSGTDFTLTISRLEPEYFAVYYCQQYGCSPLTFGGGTKVEIT

SEQ ID NO: 25923 - DNA, 339 bp, Artificial Sequence
  Description of Artificial Sequence: Synthetic polynucleotide
gacatcgtgatgacccagtctccagattgcctggctgtgtctctgggcgagagggccaccatcaactgcaagtccagccagagtgttttatacacctccaacaataacaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgttgcagtttattattgtcagcactataatgatactccatggaagtttgtccaagggatcaaggtggaaatcaaa

SEQ ID NO: 25924 - protein, 113 aa, Artificial Sequence
  Description of Artificial Sequence: Synthetic polypeptide
DIVMTQSPDCLAVSLGERATINCKSSQSVLYTSNNNNYLAWYQQKPGQPPKLLIYWASTRESGVPDRFSGSGSGTDFTLTISSLQAEDVAVYYCQHYNDTPWKFVQGIKVEIK

SEQ ID NO: 25925 - DNA, 339 bp, Artificial Sequence
  Description of Artificial Sequence: Synthetic polynucleotide
gacatcgtgatgacccagtctccagattgcctggctgtgtctctgggcgagagggccaccatcaactgcaagtccagccagagtgttttatacacctccaacaataacaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgttgcagtttattattgtcagcactattataatactccgtggacgtttgtccaagggaccaaggtggaaatcaaa

SEQ ID NO: 25926 - protein, 113 aa, Artificial Sequence
  Description of Artificial Sequence: Synthetic polypeptide
DIVMTQSPDCLAVSLGERATINCKSSQSVLYTSNNNNYLAWYQQKPGQPPKLLIYWASTRESGVPDRFSGSGSGTDFTLTISSLQAEDVAVYYCQHYYNTPWTFVQGTKVEIK

SEQ ID NO: 25927 - DNA, 324 bp, Artificial Sequence
  Description of Artificial Sequence: Synthetic polynucleotide
gaatttatgttgacgcagtctccaggcaccctgtgttggtctccaggggaaagagccaccctctcgtgcagggccagtgagagtgttagcagcagctacttagtctggtatcagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggttgctcaccgctcactttcggcggagggaccaaggtggagatcaca

SEQ ID NO: 25928 - protein, 108 aa, Artificial Sequence
  Description of Artificial Sequence: Synthetic polypeptide
EFMLTQSPGTLCWSPGERATLSCRASESVSSSYLVWYQQKPGQAPRLLIYGASTRATGIPDRFSGSGSGTDFTLTISRLEPEYFAVYYCQQYGCSPLTFGGGTKVEIT

SEQ ID NO: 25929 - DNA, 324 bp, Artificial Sequence
  Description of Artificial Sequence: Synthetic polynucleotide
gaaattgtgttgacgcagtctccaggcactttgtctttgtctccaggggaaagagccaccctctcctgcagggccagtcagagtgttgacagcggctacttagcctggtaccagcagaaacctggccaggctcccaggctcctcatctatggtgcatccagcaggacccctggcatcccagacaggttcagtggcagtgggtctgggacagacttcactctcaccatcagcagactggagcctgaagattttgcagtgtattactgtcagcagtatgaaagctcaccgtggacgttcggccaagggaccaaggtggaaatcaaa

SEQ ID NO: 25930 - protein, 108 aa, Artificial Sequence
  Description of Artificial Sequence: Synthetic polypeptide
EIVLTQSPGTLSLSPGERATLSCRASQSVDSGYLAWYQQKPGQAPRLLIYGASSRTPGIPDRFSGSGSGTDFTLTISRLEPEDFAVYYCQQYESSPWTFGQGTKVEIK

SEQ ID NO: 25931 - DNA, 324 bp, Artificial Sequence
  Description of Artificial Sequence: Synthetic polynucleotide
gaaattgtgttgacgcagtctccaggcacccggtatttgtcttcagtggaaagagccaccctctcatgcagggccagtcagagtgtttacagcagctacttagcgtggtaccagcagaaacctggccaggctcccaggctcctcatttatggtgcatccagccggtccactggcatcccagacaggttcagtggcagtgggtctgggacagacttcgctctcaccatcagcagactggagcctgaagattgtgcagtgtattactgtcagcactctgataactcaccgtggacgttcggccaagggaccaaggtggaaatcaaa

SEQ ID NO: 25932 - protein, 108 aa, Artificial Sequence
  Description of Artificial Sequence: Synthetic polypeptide
EIVLTQSPGTRYLSSVERATLSCRASQSVYSSYLAWYQQKPGQAPRLLIYGASSRSTGIPDRFSGSGSGTDFALTISRLEPEDCAVYYCQHSDNSPWTFGQGTKVEIK

SEQ ID NO: 25933 - DNA, 339 bp, Artificial Sequence
  Description of Artificial Sequence: Synthetic polynucleotide
gacatcgtgatgacccagtctccagactccctggctgtgtctctgggcgagagggccaccatcatctgcaagtccagccagactgttttacacagctccaacaattataactacttagcttggtaccagcagaagccaggacagccccctaaggtgctcatttactggacatctacccgggaatccggggtccctgaccgattcagtggcagcgggtctgggacagatttcactctcaccatcagcagcctgcaggctgaagatgtggcagtttattactgtcagcaatattttagtagtcctctgacgttcggccaagggaccaaggtggaaatcaaa

SEQ ID NO: 25934 - protein, 113 aa, Artificial Sequence
  Description of Artificial Sequence: Synthetic polypeptide
DIVMTQSPDSLAVSLGERATIICKSSQTVLHSSNNYNYLAWYQQKPGQPPKVLIYWTSTRESGVPDRFSGSGSGTDFTLTISSLQAEDVAVYYCQQYFSSPLTFGQGTKVEIK

SEQ ID NO: 25935 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtccgagtgttcacagcaactacttagcctggtaccagcagaaacctggccaggctcccaggctcctcatctatggtgcatccagcagggccactggcatcccagacaggttcagtggcagtgggtctgggacagacttcattctcaccatcagcagactggagcctgaagattttgcagtgtattactgtcagcagtatgaaagttcaccgtggacgttcggccaagggaccaaggtggaaatcaaa

SEQ ID NO: 25936 - protein, 108 aa, Artificial Sequence
  Description of Artificial Sequence: Synthetic polypeptide
EIVLTQSPGTLSLSPGERATLSCRASPSVHSNYLAWYQQKPGQAPRLLIYGASSRATGIPDRFSGSGSGTDFILTISRLEPEDFAVYYCQQYESSPWTFGQGTKVEIK

SEQ ID NO: 25937 - DNA, 339 bp, Artificial Sequence
  Description of Artificial Sequence: Synthetic polynucleotide
gacatcgtgatgacccagtcgccagactccctggctgtgtctctgggcgagagggccaccatcaactgcaagtccagacagagtgttttacacagctccaacaattacaactacttagcttggtaccagcagaaaccaggacagcctcctgaactactcatttactgggcatctacccgggaatccggggtccctgaccgattcagtggcagcgggtctgggacagatttcactctcaccatcagcagcctgcaggctgaggatgtggcagtttattactgtcagcaatattatagtactcctcctactttcggcggagggaccaaggtggagatcaaa

SEQ ID NO: 25938 - protein, 113 aa, Artificial Sequence
  Description of Artificial Sequence: Synthetic polypeptide
DIVMTQSPDSLAVSLGERATINCKSRQSVLHSSNNYNYLAWYQQKPGQPPELLIYWASTRESGVPDRFSGSGSGTDFTLTISSLQAEDVAVYYCQQYYSTPPTFGGGTKVEIK

SEQ ID NO: 25939 - DNA, 339 bp, Artificial Sequence
  Description of Artificial Sequence: Synthetic polynucleotide
gacatcgtgatgacccagtctccagactccccggctgtgtctctgggcgagagggccaccatcatctgcaagtccagccagactgttttacacagctccaacaattataactacttagcttggtaccagcagaagccaggacagccccctaaggtgctcatttactggacatctacccgggaatccggggtccctgaccgattcagtggcagcgggtctgggacagatttcactctcaccatcagcagcctgcaggctgaagatgtggcagtttattactgtcagcaatattttagtagtcctccgacgttcggccaagggaccaaggtggaaatcaaa

SEQ ID NO: 25940 - protein, 113 aa, Artificial Sequence
  Description of Artificial Sequence: Synthetic polypeptide
DIVMTQSPDSPAVSLGERATIICKSSQTVLHSSNNYNYLAWYQQKPGQPPKVLIYWTSTRESGVPDRFSGSGSGTDFTLTISSLQAEDVAVYYCQQYFSSPPTFGQGTKVEIK

SEQ ID NO: 25941 - DNA, 321 bp, Artificial Sequence; identical to SEQ ID NO: 25809
  Description of Artificial Sequence: Synthetic polynucleotide

SEQ ID NO: 25942 - protein, 107 aa, Artificial Sequence; identical to SEQ ID NO: 25810
  Description of Artificial Sequence: Synthetic polypeptide

SEQ ID NO: 25943 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattaacagcaactacttagcctggtaccagcagaaacctggccaggctcccaggctcctcatctatggtgcatccagcagggccactggcatcccagacaggttcagtggcagtgggtctgggacagacttcactctcaccatcagcagactggagcctgacgattttgcagtgttttactgtcagcagtatgagagctcaccgtggacgttcggccaagggaccaaggtggaaatcaaa

SEQ ID NO: 25944 - protein, 108 aa, Artificial Sequence
  Description of Artificial Sequence: Synthetic polypeptide
EIVLTQSPGTLSLSPGERATLSCRASQSINSNYLAWYQQKPGQAPRLLIYGASSRATGIPDRFSGSGSGTDFTLTISRLEPDDFAVFYCQQYESSPWTFGQGTKVEIK

SEQ ID NO: 25945 - DNA, 321 bp, Artificial Sequence
  Description of Artificial Sequence: Synthetic polynucleotide
gagatagtgatgacgcagtctccagccaccctgtctgtgtctccaggggaaagagccaccctctcctgcagggccagtcaggatgttatcacctacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcactttattactgtcaggagtataatgactggccgtgcagttttggccaggggaccaaggtggagatcaaa

SEQ ID NO: 25946 - protein, 107 aa, Artificial Sequence
  Description of Artificial Sequence: Synthetic polypeptide
EIVMTQSPATLSVSPGERATLSCRASQDVITYLAWYQQKPGQAPRLLIYGASTRATGVPARFSGSGSGTEFTLTISSLQSEDFALYYCQEYNDWPCSFGQGTKVEIK

SEQ ID NO: 25947 - DNA, 339 bp, Artificial Sequence
  Description of Artificial Sequence: Synthetic polynucleotide
gacagcatgatgacccagtctccagactccctggctgtgtctctgggcgagagggccaccatcaactgcaagtccagccagagtgttttacacagctctaataaaaagaactacttagcttggtaccagcagaaaccaggacagcctcctaagctgctcatttactgggcatctacccgggaatccggggtccctgaccgattcagtggcagcgggtctgggacagatttcactctcaccatcagcagtctgcaggctgaagatgtggcagtttattactgtcagcaatattataggactccgtggacgttcggccaagggaccaaggtggaaatcaaa

SEQ ID NO: 25948 - protein, 113 aa, Artificial Sequence
  Description of Artificial Sequence: Synthetic polypeptide
DSMMTQSPDSLAVSLGERATINCKSSQSVLHSSNKKNYLAWYQQKPGQPPKLLIYWASTRESGVPDRFSGSGSGTDFTLTISSLQAEDVAVYYCQQYYRTPWTFGQGTKVEIK

SEQ ID NO: 25949 - DNA, 324 bp, Artificial Sequence
  Description of Artificial Sequence: Synthetic polynucleotide
gaaattgtgttgacgcagtctccaggcaccctgtttttgtctccaggggaaagagccaccctctcctgcagggccagtcagagtgtttacagcagctacttagcctggtaccagcagaaacctgcccaggctcccaggctcctcatctatggtgcatccagccgggccagtggcatcccagacaggttcagtggcagtgggtctgggacagacttcgctctcaccatcagcagactggagcctgaagattttgcagtgtattactgtcagcactatgataactcaccgtggacgttcggccaagggaccaaggtggaaatcaaa

SEQ ID NO: 25950 - protein, 108 aa, Artificial Sequence
  Description of Artificial Sequence: Synthetic polypeptide
EIVLTQSPGTLFLSPGERATLSCRASQSVYSSYLAWYQQKPAQAPRLLIYGASSRASGIPDRFSGSGSGTDFALTISRLEPEDFAVYYCQHYDNSPWTFGQGTKVEIK

SEQ ID NO: 25951 - DNA, 324 bp, Artificial Sequence
  Description of Artificial Sequence: Synthetic polynucleotide
gaaattgtgttgacgcagtctccaggcaccctgtttttgtctccaggggaaagagccaccctctcctgcagggccagtcagagtgtttacagcagctacttagcctggtaccagcagaaacctggccaggctcccaggctcctcatctatggtgcatccagccgggccactggcatcccagacaggttcagtggcagtgggtctgggacagacttcgctctcaccatcagcagactggagcctgaagattttgcagtgtattactgtcagcactatgataactcaccgtggacgttcggccaagggaccaaggtggaaatcaaa

SEQ ID NO: 25952 - protein, 108 aa, Artificial Sequence
  Description of Artificial Sequence: Synthetic polypeptide
EIVLTQSPGTLFLSPGERATLSCRASQSVYSSYLAWYQQKPGQAPRLLIYGASSRATGIPDRFSGSGSGTDFALTISRLEPEDFAVYYCQHYDNSPWTFGQGTKVEIK

SEQ ID NO: 25953 - DNA, 324 bp, Artificial Sequence
  Description of Artificial Sequence: Synthetic polynucleotide
gaatttatgttgacgcagtctccaggcaccctgtctttgtctccaggggaaagagccaccctctcgtgcaggtccagtcagagtgttagcagcagctacttagtctggtatcagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggttgctcaccgctcactttcggcggagggaccaaggtggagatcaca

SEQ ID NO: 25954 - protein, 108 aa, Artificial Sequence
  Description of Artificial Sequence: Synthetic polypeptide
EFMLTQSPGTLSLSPGERATLSCRSSQSVSSSYLVWYQQKPGQAPRLLIYGASTRATGIPDRFSGSGSGTDFTLTISRLEPEYFAVYYCQQYGCSPLTFGGGTKVEIT

SEQ ID NO: 25955 - DNA, 324 bp, Artificial Sequence
  Description of Artificial Sequence: Synthetic polynucleotide
gaaattgtgttgacgcagtctccaggcaccctgtttttgtctcaaggggaaagagccaccctctcctgcagggccagtcagagtgttagcagcaggtacttagcctggtaccagcagaaacctggccaggctcccagactcctcatctatggtgcatccagcagggccactggcatcccagacaggttcagtggcagtgggtctgggacagacttcactctcaccatcagcagactggagcctgaagattttgcagtatattactgtcagcattatgatagctcaccgtggacgttcggccaagggaccaaggtggaaatcaaa

SEQ ID NO: 25956 - protein, 108 aa, Artificial Sequence
  Description of Artificial Sequence: Synthetic polypeptide
EIVLTQSPGTLFLSQGERATLSCRASQSVSSRYLAWYQQKPGQAPRLLIYGASSRATGIPDRFSGSGSGTDFTLTISRLEPEDFAVYYCQHYDSSPWTFGQGTKVEIK

SEQ ID NO: 25957 - DNA, 324 bp, Artificial Sequence
  Description of Artificial Sequence: Synthetic polynucleotide
gaaattgcgttgacgcagtctccaggcaccctgtctttgtctccaggggaaagagccaccctctcctgcagggccagtccgagtgttgacagcagctacttagcctggtaccagcagaaacctggccaggctcccaggctcctcatctatggtgcagccagcagggcccctggcatcccagacaggttcagtggcagtgggtctgggacagacttcactctcaccatcagcagactggagcctgaagactttgtagtgtattactgtcagcagtatgaaagttcaccgtggacgttcggccaagggaccaaggtggaaatcaaa

SEQ ID NO: 25958 - protein, 108 aa, Artificial Sequence
  Description of Artificial Sequence: Synthetic polypeptide
EIALTQSPGTLSLSPGERATLSCRASPSVDSSYLAWYQQKPGQAPRLLIYGAASRAPGIPDRFSGSGSGTDFTLTISRLEPEDFVVYYCQQYESSPWTFGQGTKVEIK

SEQ ID NO: 25959 - DNA, 324 bp, Artificial Sequence
  Description of Artificial Sequence: Synthetic polynucleotide
gaacttgtgttgacgcagtctccaggcaccctgtctttgtctccaggggaaagagccaccctctcctgcagggccagtcagaatatttacagcagctacttagcctggtaccaacagaaacctggccaggctcccaggctcctcatctatggtgcatccagcagggccactggcatcccagacaggttcagtggcagtgggtctgggacagacttcactctcaccatcagcagactggagcctgaagattttgcagtgtattgctgtcagcagtatgaaagctcaccgtggaccttcggccaagggaccaaggtggaaatcaaa

SEQ ID NO: 25960 - protein, 108 aa, Artificial Sequence; identical to SEQ ID NO: 25730
  Description of Artificial Sequence: Synthetic polypeptide

SEQ ID NO: 25961 - DNA, 324 bp, Artificial Sequence
  Description of Artificial Sequence: Synthetic polynucleotide
gaaattgtgttgacgcagtctccaggcaccctgtttttgtctccaggggagagagccaccctctcctgcagggccagtcagagtgttaacagcaactacttagcctggtaccggcagaaacctggccaggctcccaggctcctcatctatggtgcatccagcagggccactggcatcccagacaggttcagtggcagtgggtctgggacagacttcattctcatcatcagcagactggagcctgaggattttgcagtgtattactgtcagcagtatgaaagctcgccgtggacgttcggccaagggaccaaggtggaaatcaaa

SEQ ID NO: 25962 - protein, 108 aa, Artificial Sequence
  Description of Artificial Sequence: Synthetic polypeptide
EIVLTQSPGTLFLSPGERATLSCRASQSVNSNYLAWYRQKPGQAPRLLIYGASSRATGIPDRFSGSGSGTDFILIISRLEPEDFAVYYCQQYESSPWTFGQGTKVEIK

SEQ ID NO: 25963 - DNA, 339 bp, Artificial Sequence; identical to SEQ ID NO: 25873
  Description of Artificial Sequence: Synthetic polynucleotide

SEQ ID NO: 25964 - protein, 113 aa, Artificial Sequence; identical to SEQ ID NO: 25874
  Description of Artificial Sequence: Synthetic polypeptide

SEQ ID NO: 25965 - DNA, 324 bp, Artificial Sequence
  Description of Artificial Sequence: Synthetic polynucleotide
gaaattgtgttgacgcagtctccaggctccctgtctttgtctccaggggaaagagccaccctctcctgcagggccagtcagagtgtttggagcggctacttagcctggtaccagcagaaacctggccaggctcccaggctcctcatctatggtgcatctagcagggccactggcatcccagacaggttcagtggcagtgggtctgggacagacttcactctcaccatcagcagactggagcctgaagattttgcagtgtatttctgtcagcagtatgagagttcaccgtggacgttcggccaagggaccaaggtggaaatcaaa

SEQ ID NO: 25966 - protein, 108 aa, Artificial Sequence
  Description of Artificial Sequence: Synthetic polypeptide
EIVLTQSPGSLSLSPGERATLSCRASQSVWSGYLAWYQQKPGQAPRLLIYGASSRATGIPDRFSGSGSGTDFTLTISRLEPEDFAVYFCQQYESSPWTFGQGTKVEIK

SEQ ID NO: 25967 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttgtacagctccaacagtcacaacttcttagcttggtaccagcagaacccaggacagcctcctaaactgctcattttctgggcatttatccgggaatccggggtccctgaaggattcagtggcagcgggtctggggcagatttcactctctccatcagcggcctacaggcagaagatgtggcagtttattactgtcagcaatattatagtactccgtgcagttttggccaggggaccaagctggagatcaaa

SEQ ID NO: 25968 - protein, 113 aa, Artificial Sequence
  Description of Artificial Sequence: Synthetic polypeptide
DIVMTQSPDSLAVSLGERATINCKSSQSVLYSSNSHNFLAWYQQNPGQPPKLLIFWAFIRESGVPEGFSGSGSGADFTLSISGLQAEDVAVYYCQQYYSTPCSFGQGTKLEIK

SEQ ID NO: 25969 - DNA, 324 bp, Artificial Sequence
  Description of Artificial Sequence: Synthetic polynucleotide
gaatttatgttgacgcagtctccaggcaccctgtctttgtctacaggggaaagagccaccctctcgtgcaggtccagtcagagtgttagcagcagctacttagtctggtatcagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggttgctcaccgctcactttcggcggagggaccaaggtggagatcaca

SEQ ID NO: 25970 - protein, 108 aa, Artificial Sequence
  Description of Artificial Sequence: Synthetic polypeptide
EFMLTQSPGTLSLSTGERATLSCRSSQSVSSSYLVWYQQKPGQAPRLLIYGASTRATGIPDRFSGSGSGTDFTLTISRLEPEYFAVYYCQQYGCSPLTFGGGTKVEIT

SEQ ID NO: 25971 - DNA, 324 bp, Artificial Sequence
  Description of Artificial Sequence: Synthetic polynucleotide
gaaattgtgttgacgcagtctccaggcaccctgtatttgtctccaggggaaagagccaccctctcctgcagggccagtcagagtgtttacagcagctacttagcctggtaccagcagaaacctgcccaggctcccaggctcctcatctatggtgcatccagccgggccactggcatcccagacaggttcagtggcagtgggtctgggacagacttcgctctcaccatcagcagactggagcctgaagattgtgcagtgtattactgtcagcactatgataactcaccgtggacgttcggccaagggaccaaggtggaaatcaaa

SEQ ID NO: 25972 - protein, 108 aa, Artificial Sequence
  Description of Artificial Sequence: Synthetic polypeptide
EIVLTQSPGTLYLSPGERATLSCRASQSVYSSYLAWYQQKPAQAPRLLIYGASSRATGIPDRFSGSGSGTDFALTISRLEPEDCAVYYCQHYDNSPWTFGQGTKVEIK

SEQ ID NO: 25973 - DNA, 324 bp, Artificial Sequence
  Description of Artificial Sequence: Synthetic polynucleotide
gaaattgtgttgacgcagtctccaggcacccggtatttgtctccaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtctgggacagacttcgctctcaccatcagcagactggagcctgaagattgtgcagtgtattactgtcagcactctgataactcaccgtggacgttcggccaagggaccaaggtggaaatcaaa

SEQ ID NO: 25974 - protein, 108 aa, Artificial Sequence
  Description of Artificial Sequence: Synthetic polypeptide
EIVLTQSPGTRYLSPGERATLSCRASQSVYSSYLAWYQQKPGQAPRLLIYGASSRSTGIPDRFSGSGSGTDFALTISRLEPEDCAVYYCQHSDNSPWTFGQGTKVEIK

SEQ ID NO: 25975 - DNA, 339 bp, Artificial Sequence
  Description of Artificial Sequence: Synthetic polynucleotide
gacatcgtgatgacccagtgtccagactccccggctgtgtctctgggcgagagggccaccatcaattgcaagtccagccagagtgttttgcacagatccaacaattataattacttagcttggtaccagcagaaaccaggacagcctcctaacctgctcatttactgggcatctacccgggaatccggggtccctgaccgattcagtggcagcgggtctgggacagatttcactctcaccatcagcagcctgcaggctgctgatgtggcagtttattactgtcagcaatatcatagtagtccactgacgttcggccaagggaccacggtggaaatcaaa

SEQ ID NO: 25976 - protein, 113 aa, Artificial Sequence
  Description of Artificial Sequence: Synthetic polypeptide
DIVMTQCPDSPAVSLGERATINCKSSQSVLHRSNNYNYLAWYQQKPGQPPNLLIYWASTRESGVPDRFSGSGSGTDFTLTISSLQAADVAVYYCQQYHSSPLTFGQGTTVEIK

SEQ ID NO: 25977 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccggtccactggcctcccagacaggttcagtggcagtgggtctgggacagacttcgctctcaccatcagcagactggagcctgaagattgtgcagtgtattactgtcagcactctgataactcaccgtggacgttcggccaagggaccaaggtggaaatcaaa

SEQ ID NO: 25978 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRSTGLPDRFSGSGSGTDFALTISRLEPEDCAVYYCQHSDNSPWTFGQGTKVEIK

SEQ ID NO: 25979 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttgacagcaactacttagcctggtaccagcagaaacctggccaggctcccaggctcctcatctatggtgcatctgccaggaccactggcatcccagacaggttcagtggcagtgggtctgggacagacttcactctcaccatcagcagactggagcctgaagattttgcagtgtattcctgtcagcagtatgaaagctcaccgtggacgttcggccaagggaccaaggtggaaatcaaa

SEQ ID NO: 25980 - protein, 108 aa, Artificial Sequence
  Description of Artificial Sequence: Synthetic polypeptide
EIVLTQSPGTLSLSPGERATLSCRASQSVDSNYLAWYQQKPGQAPRLLIYGASARTTGIPDRFSGSGSGTDFTLTISRLEPEDFAVYSCQQYESSPWTFGQGTKVEIK

SEQ ID NO: 25981 - DNA, 324 bp, Artificial Sequence
  Description of Artificial Sequence: Synthetic polynucleotide
gaatttgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtctgggacagacttcgctctcaccatcagcagagtggagcctgaagattgtgcagtgtattactgtcagcattctgataactcaccgtggacgttcggccaagggaccaaggtggaaatcaaa

SEQ ID NO: 25982 - protein, 108 aa, Artificial Sequence
  Description of Artificial Sequence: Synthetic polypeptide
EFVLTQSPGTLYLSPGERATLSCRASQSVYSSYLAWYQQKPGQAPRLLIYGASSRSTGIPDRFSGSGSGTDFALTISRVEPEDCAVYYCQHSDNSPWTFGQGTKVEIK

SEQ ID NO: 25983 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcacagtggggtcccatcaaagttcagcggcagtggatctgggacagatttcactctcaccatcagcagcctgcagcctgaagattctgcaacttatttctgcctactctatcttacttacccgctcaccttcggccaagggacacgactggagattaaa

SEQ ID NO: 25984 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLHSGVPSKFSGSGSGTDFTLTISSLQPEDSATYFCLLYLTYPLTFGQGTRLEIK

SEQ ID NO: 25985 - DNA, 324 bp, Artificial Sequence
  Description of Artificial Sequence: Synthetic polynucleotide
gaaattgtgttgacgcagtctccaggcaccctgtatttgtctccagtggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtctgggacagacttcgctctcaccatcagcagactggagcctgaagattgtgcagtgtattactgtcagcattctgataactcaccgtggacgttcggccaagggaccaaggtggaaatcaaa

SEQ ID NO: 25986 - protein, 108 aa, Artificial Sequence
  Description of Artificial Sequence: Synthetic polypeptide
EIVLTQSPGTLYLSPVERATLSCRASQSVYSSYLAWYQQKPGQAPRLLIYGASSRSTGIPDRFSGSGSGTDFALTISRLEPEDCAVYYCQHSDNSPWTFGQGTKVEIK

SEQ ID NO: 25987 - DNA, 324 bp, Artificial Sequence
  Description of Artificial Sequence: Synthetic polynucleotide
gaatttgtgttgacgcagtctccaggcaccctgtatttgtctccaggggaaagagccaccctctcgtgcagggccagtcagagtgttagcagcagctacttagcctggtaccagcagaaacctggccaggctcccaggctcctcatctatggtgcatccaccagggcctctggcatcccagacaggttcagtggcagtgggtctgggacagacttcactctcaccatcagcagactggagcctgaatattttgcagtttattactgtcagcagtatggtaactcaccgctcactttcggcggagggaccaaggtggagatcaaa

SEQ ID NO: 25988 - protein, 108 aa, Artificial Sequence
  Description of Artificial Sequence: Synthetic polypeptide
EFVLTQSPGTLYLSPGERATLSCRASQSVSSSYLAWYQQKPGQAPRLLIYGASTRASGIPDRFSGSGSGTDFTLTISRLEPEYFAVYYCQQYGNSPLTFGGGTKVEIK

SEQ ID NO: 25989 - DNA, 339 bp, Artificial Sequence
  Description of Artificial Sequence: Synthetic polynucleotide
gacatcgtgatgacccagtctccagactccctggctgtgtctctgggcgagagggccaccatcaagtgcaagtccagccagagtgttttacacagctccaacaatatgaactacttagcttggtaccagcagaaacctggacagcctcctaaactgctcatttactgggcatctacccggaaatccggggtccctgaccgattcagtggcaccgggtctgggacagatttcactctcaccatcagcagcctgcaggctgaagatgtggcagtttattactgtcagcaatattatagtagtccgtgcagttttggccaggggaccaagctgaagatcaaa

SEQ ID NO: 25990 - protein, 113 aa, Artificial Sequence
  Description of Artificial Sequence: Synthetic polypeptide
DIVMTQSPDSLAVSLGERATIKCKSSQSVLHSSNNMNYLAWYQQKPGQPPKLLIYWASTRKSGVPDRFSGTGSGTDFTLTISSLQAEDVAVYYCQQYYSSPCSFGQGTKLKIK

SEQ ID NO: 25991 - DNA, 324 bp, Artificial Sequence
  Description of Artificial Sequence: Synthetic polynucleotide
gaaattgtgttgacgcagtctccaggcacccggtatttgtctccaggggaaagagccaccctctcatgcagggccagtcagagtgtttacagcagctacttagcctggtaccagcagaaacctggccaggctcccaggctcctcatttatggtgcatccagccggtccactgtcatcccagacaggttcagtggcagtgggtgtgggacagacttcgctctcaccatcagcagagtggagcctgaagattgtgcagtgtattactgtcagcactctgataactcaccgtggacgttcggccaagggaccaaggtggaaatcaaa

SEQ ID NO: 25992 - protein, 108 aa, Artificial Sequence
  Description of Artificial Sequence: Synthetic polypeptide
EIVLTQSPGTRYLSPGERATLSCRASQSVYSSYLAWYQQKPGQAPRLLIYGASSRSTVIPDRFSGSGCGTDFALTISRVEPEDCAVYYCQHSDNSPWTFGQGTKVEIK

SEQ ID NO: 25993 - DNA, 339 bp, Artificial Sequence
  Description of Artificial Sequence: Synthetic polynucleotide
aatatcgtgatgacccagtctccagactccctggctgtgtctctgggcgcgagggccaccatcaactgcaagtccagccagagtgttttacacagctccaacaattacaactacttaacttggtaccagcagaaaccaggacagcctcctaagctgctcctttactgggcatctacccggaaatccggggtccctgaccgattcagtggcagcgggtctgggacagatttcactctcaccatcagcagcctgcaggctgaagatgtggcagtttatttctgtcagcaatattatagttctcctccgacgttcggccaagggaccaaggtggaaatcaaa

SEQ ID NO: 25994 - protein, 113 aa, Artificial Sequence
  Description of Artificial Sequence: Synthetic polypeptide
NIVMTQSPDSLAVSLGARATINCKSSQSVLHSSNNYNYLTWYQQKPGQPPKLLLYWASTRKSGVPDRFSGSGSGTDFTLTISSLQAEDVAVYFCQQYYSSPPTFGQGTKVEIK

SEQ ID NO: 25995 - DNA, 324 bp, Artificial Sequence
  Description of Artificial Sequence: Synthetic polynucleotide
gaaattgtgttgacgcagtctccaggcaccctgtatttgtctccaggggaaagagccaccctgtcatgcagggccagtcagagtgtttacagcagctacttagcctggtaccagcagaaacctggccaggctcccaggctcctcatttatggtgcatccagccggtccacggtcatcccagacaggttcagtggcagtgggtgtgggacagacttcgctctcaccatcagcagagtggagcctgaagattgtgcagtgtattactgtcagcattctgataactcaccgtggacgttcggccaagggaccaaggtggaaatcaaa

SEQ ID NO: 25996 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRSTVIPDRFSGSGCGTDFALTISRVEPEDCAVYYCQHSDNSPWTFGQGTKVEIK

SEQ ID NO: 25997 - DNA, 339 bp, Artificial Sequence
  Description of Artificial Sequence: Synthetic polynucleotide
gacatcgtgatgacccagtctccagattgcctggctgtgtctctgggcgagagggccaccatcaactgcaagtccagccagagtgttttatacacctccaacaataacaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgttgcagtttattattgtcagcaatattataatactccgtggacgtttgtccaagggaccaaggtggaaatcaaa

SEQ ID NO: 25998 - protein, 113 aa, Artificial Sequence; identical to SEQ ID NO: 25884
  Description of Artificial Sequence: Synthetic polypeptide

SEQ ID NO: 25999 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacatctccaacaataataattacttagcttggtaccagcagaaaccaggacagcctcctaaactgctcatttactgggcatctacccgggaatccggggtccctgcccgattcagtggcagcgggtctgggacagatttcactctcaccatcagcagcctgcaggctgaagatgtggcagtttattactgtcagcaatattatagtactcctccgacgttcggccaagggaccaaggtggaaatcaaa

SEQ ID NO: 26000 - protein, 113 aa, Artificial Sequence
  Description of Artificial Sequence: Synthetic polypeptide
DIVMTQSPDSLAVSLGERATINCKSSQSVLYISNNNNYLAWYQQKPGQPPKLLIYWASTRESGVPARFSGSGSGTDFTLTISSLQAEDVAVYYCQQYYSTPPTFGQGTKVEIK

SEQ ID NO: 26001 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatgattacccattcactttcggccctgggaccaaagtggaaatcaaa

SEQ ID NO: 26002 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNDYPFTFGPGTKVEIK

SEQ ID NO: 26003 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgtttacagcagctacttagcctggtaccagcagaaacctggccaggctcccaggctcctcatttatggtgcatccagccggtccactggcatcccagacaggttcagtggcagtgggtctgggacagacttcgctctcaccatcagcagagtggagcctgaagattgtgcagtgtattactgtcagcactctgataactcaccgtggacgttcggccaagggaccaaggtggaaatcaaa

SEQ ID NO: 26004 - protein, 108 aa, Artificial Sequence
  Description of Artificial Sequence: Synthetic polypeptide
EIVLTQSPGTLSLSPGERATLSCRASQSVYSSYLAWYQQKPGQAPRLLIYGASSRSTGIPDRFSGSGSGTDFALTISRVEPEDCAVYYCQHSDNSPWTFGQGTKVEIK

SEQ ID NO: 26005 - DNA, 324 bp, Artificial Sequence
  Description of Artificial Sequence: Synthetic polynucleotide
gaaattgtgttgacgcagtctccaggcaccctgtctttgtctccaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtctgggacagacttcgctctcaccatcagcagactggagcctgaagattgtgcagtgtattactgtcagcactctgataactcaccgtggacgttcggccaagggaccaaggtggaaatcaaa

SEQ ID NO: 26006 - protein, 108 aa, Artificial Sequence
  Description of Artificial Sequence: Synthetic polypeptide
EIVLTQSPGTLSLSPGERATLSCRASQSVYSSYLAWYQQKPGQAPRLLIYGASSRSTGIPDRFSGSGSGTDFALTISRLEPEDCAVYYCQHSDNSPWTFGQGTKVEIK

SEQ ID NO: 26007 - DNA, 324 bp, Artificial Sequence
  Description of Artificial Sequence: Synthetic polynucleotide
gaaattgtgttgacgcagtctccaggcacccggtatttgtctccaggggaaagagccaccctctcctgcagggccagtcagagtgtttacagcagctacttagcctggtaccagcagaaacctggccaggctcccaggctcctcatttatggtgcatccagccggtccactggcatcccagacaggttcagtggcagtgggtctgggacagacttcgctctcaccatcagcagagtggagcctgaagattgtgcagtgtattactgtcagcactctgataactcaccgtggacgttcggccaagggaccaaggtggaaatcaaa

SEQ ID NO: 26008 - protein, 108 aa, Artificial Sequence
  Description of Artificial Sequence: Synthetic polypeptide
EIVLTQSPGTRYLSPGERATLSCRASQSVYSSYLAWYQQKPGQAPRLLIYGASSRSTGIPDRFSGSGSGTDFALTISRVEPEDCAVYYCQHSDNSPWTFGQGTKVEIK

SEQ ID NO: 26009 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttacacagctccaacaattggaattacttagcttggcaccagcagaaaccaggacagcctcctaagttgctcattcactgggcatttactcggaaatccggggtccctgaccgattcagtggcggcgggtctgggacaaatttcactctcaccatcagcagcctgcaggctgaagatgtggcagtttattactgtcagcaatattatagagctcctccgacgttcggccaagggaccaaggtggaaatcaaa

SEQ ID NO: 26010 - protein, 113 aa, Artificial Sequence
  Description of Artificial Sequence: Synthetic polypeptide
DIVMTQSPDSLAVSLGERATINCKSSQSVLHSSNNWNYLAWHQQKPGQPPKLLIHWAFTRKSGVPDRFSGGGSGTNFTLTISSLQAEDVAVYYCQQYYRAPPTFGQGTKVEIK

SEQ ID NO: 26011 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccgggccactggcatcccagacaggttcagtggcagtgggtctgggacagacttcgctctcaccatcagcagagtggagcctgaagattgtgcagtgtattactgtcagcactctgataactcaccgtggacgttcggccaagggaccaaggtggaaatcaaa

SEQ ID NO: 26012 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRATGIPDRFSGSGSGTDFALTISRVEPEDCAVYYCQHSDNSPWTFGQGTKVEIK

SEQ ID NO: 26013 - DNA, 336 bp, Artificial Sequence
  Description of Artificial Sequence: Synthetic polynucleotide
gatattgtgatgactcagtctccactctccctgcccgtcacccctggagagccggcctccatctcctgcaggtctagtcagagcctcctgcatagtagtggatacaactatttggattggtacctgcagaagccagggcagtctccacagctcctgatctatttgggttctaatcgggcctccggggtccctgacaggttcagtggcagtggttcaggcacagattttacactgaaaatcagcagagtggaggctgaggatattggggtttattactgcatgcaagctctacatattcctctcactttcggcggagggaccaaggtggagatcaaa

SEQ ID NO: 26014 - protein, 112 aa, Artificial Sequence
  Description of Artificial Sequence: Synthetic polypeptide
DIVMTQSPLSLPVTPGEPASISCRSSQSLLHSSGYNYLDWYLQKPGQSPQLLIYLGSNRASGVPDRFSGSGSGTDFTLKISRVEAEDIGVYYCMQALHIPLTFGGGTKVEIK

SEQ ID NO: 26015 - DNA, 324 bp, Artificial Sequence
  Description of Artificial Sequence: Synthetic polynucleotide
gaaattgtgttgacgcagtctccaggcaccctgtatttgtcttcaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtctgggacagacttcgctctcaccatcagcagactggagcctgaagattttgcagtgtattactgtcagcactatgataactcaccgtggacgttcggccaagggaccaaggtggaaatcaaa

SEQ ID NO: 26016 - protein, 108 aa, Artificial Sequence
  Description of Artificial Sequence: Synthetic polypeptide
EIVLTQSPGTLYLSSGERATLSCRASQSVYSSYLAWYQQKPGQAPRLLIYGASSRSTGIPDRFSGSGSGTDFALTISRLEPEDFAVYYCQHYDNSPWTFGQGTKVEIK

SEQ ID NO: 26017 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttaacagcaactacttagcctggtaccagcagaaacctggccaggctcccaggctcctcatctatggtgcattcagcagggccactggcatcccagacagggtcagtggcagtgggtctgggacagacttcaatctcatcatcagcagactggagcctgaagattttgcagtgtattactgtcagcagtatgaaagctcagtgtggacgttcggccaagggaccaaggtggaaatcaaa

SEQ ID NO: 26018 - protein, 108 aa, Artificial Sequence
  Description of Artificial Sequence: Synthetic polypeptide
EIVLTQSPGTLSLSPGERATLSCRASQSVNSNYLAWYQQKPGQAPRLLIYGAFSRATGIPDRVSGSGSGTDFNLIISRLEPEDFAVYYCQQYESSVWTFGQGTKVEIK

SEQ ID NO: 26019 - DNA, 324 bp, Artificial Sequence
  Description of Artificial Sequence: Synthetic polynucleotide
gaaattgtgttgacgcagtctccaggcaccctgtatttgtcttcaggggaaagagccaccctctcctgcagggccagtcagagtgtttacagcagctacttagcctggtaccagcagaaacctggccaggctcccaggctcctcatttatggtgcatccagccggtccactgtcatcccagacaggttcagtggcagtgggtctgggacagacttcgctctcaccatcagcagagtggagcctgaagattttgcagtgtattactgtcagcattctgataactctccgtggacgttcggccaagggaccaaggtggaaatcaaa

SEQ ID NO: 26020 - protein, 108 aa, Artificial Sequence
  Description of Artificial Sequence: Synthetic polypeptide
EIVLTQSPGTLYLSSGERATLSCRASQSVYSSYLAWYQQKPGQAPRLLIYGASSRSTVIPDRFSGSGSGTDFALTISRVEPEDFAVYYCQHSDNSPWTFGQGTKVEIK

SEQ ID NO: 26021 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttgacagcaacttcttagcctggtaccagcagaaacctggccaggctcccaggctcctcatctatggtgcatctgccaggaccactggcatcccagacaggttcagtggcagtgggtctgggacagacttcactctcaccatcagcagactggagcctgaagattttgcagtgtattcctgtcagcagtatgaaatctcaccgtggacgttcggccaagggaccaaggtggaaatcaaa

SEQ ID NO: 26022 - protein, 108 aa, Artificial Sequence
  Description of Artificial Sequence: Synthetic polypeptide
EIVLTQSPGTLSLSPGERATLSCRASQSVDSNFLAWYQQKPGQAPRLLIYGASARTTGIPDRFSGSGSGTDFTLTISRLEPEDFAVYSCQQYEISPWTFGQGTKVEIK

SEQ ID NO: 26023 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccggtccactgtcatcccagacaggttcagtggcagtgggtctgggacagacttcgctctcaccatcagcagagtggagcctgaagattgtgcagtgtattactgtcagcactctgataactcaccgtggacgttcggccaagggaccaaggtggaaatcaaa

SEQ ID NO: 26024 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRSTVIPDRFSGSGSGTDFALTISRVEPEDCAVYYCQHSDNSPWTFGQGTKVEIK

SEQ ID NO: 26025 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccgggccactggcatcccagacaggttcagtggcagtgggtctgggacagacttcgctctcaccatcagcagagtggagcatgaagattttgcagtgtattactgtcagcactatgataactcaccgtggacgttcggccaagggaccaaggtggaaatcaaa

SEQ ID NO: 26026 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRATGIPDRFSGSGSGTDFALTISRVEHEDFAVYYCQHYDNSPWTFGQGTKVEIK

SEQ ID NO: 26027 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcatcatttatggtgcatccagccgggccactggcatcccagacaggttcagtggcagtgggtctgggacagacttcgctctcaccatcagcagagtggagcatgaagattttgcagtgtattactgtcagcactatgataactcaccgtggacgttcggccaagggaccaaggtggaaatcaaa

SEQ ID NO: 26028 - protein, 108 aa, Artificial Sequence
  Description of Artificial Sequence: Synthetic polypeptide
EIVLTQSPGTLYLSPGERATLSCRASQSVYSSYLAWYQQKPGQAPRLIIYGASSRATGIPDRFSGSGSGTDFALTISRVEHEDFAVYYCQHYDNSPWTFGQGTKVEIK

SEQ ID NO: 26029 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatattgcatccagtttgcaaagtggggtcccatcaaggttcagcggcagtggatctgggacagaattcactctcacaatcagcagcctgcagcctgaagattttgcaacttattactgtctacagcataatagttacccgatcaccttcggccaagggacacgactggagattaaa

SEQ ID NO: 26030 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYIASSLQSGVPSRFSGSGSGTEFTLTISSLQPEDFATYYCLQHNSYPITFGQGTRLEIK

SEQ ID NO: 26031 - DNA, 339 bp, Artificial Sequence
  Description of Artificial Sequence: Synthetic polynucleotide
gacatcgtgatgacccagtctccagactccctggctgtgtctctgggcgagagggccaccatcatctgcaagtccagccagactgttttacacagctccaacaattataactacttagcttggtaccagcagaagccaggacagccccctaaggtgctcatttactggacatctacccgggaatccggggtccctgaccgattcagtggcagcgggtctgggacagatttcactctcaccatcagcagcctgcaggctgaagatgtggcagtttattactgtcagcaatatcttagtagtcctctgacgttcggccaagggaccaaggtggaaatcaaa

SEQ ID NO: 26032 - protein, 113 aa, Artificial Sequence
  Description of Artificial Sequence: Synthetic polypeptide
DIVMTQSPDSLAVSLGERATIICKSSQTVLHSSNNYNYLAWYQQKPGQPPKVLIYWTSTRESGVPDRFSGSGSGTDFTLTISSLQAEDVAVYYCQQYLSSPLTFGQGTKVEIK

SEQ ID NO: 26033 - DNA, 339 bp, Artificial Sequence
  Description of Artificial Sequence: Synthetic polynucleotide
gacatcgtgatgacccagtctccagactccctgcctgtgtctctgggcgagagggccaccgtcaactgcaagtccagccagagtgttttacacaactccaacaataataactacttggcttggtaccagcagaaaccaggacagcctcctaagctgctcatttactgggcatctacgcgggagtccggggtccctgaccgattcagtggcagcgggtctgggacagatttcactctcaccatcagcagcctgcaggctgaagatgtggcagtttattactgtcaacaatattatagtagtcctccgacgttcggccaagggaccaaggtggaaatcaaa

SEQ ID NO: 26034 - protein, 113 aa, Artificial Sequence
  Description of Artificial Sequence: Synthetic polypeptide
DIVMTQSPDSLPVSLGERATVNCKSSQSVLHNSNNNNYLAWYQQKPGQPPKLLIYWASTRESGVPDRFSGSGSGTDFTLTISSLQAEDVAVYYCQQYYSSPPTFGQGTKVEIK

SEQ ID NO: 26035 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtctgggacagacttcgctctcaccatcagcagactggagcctgaagattgtgcagtgtattactgtcagcactatgataactcaccgtggacgttcggccaagggaccaaggtggaaatcaaa

SEQ ID NO: 26036 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRSTGIPDRFSGSGSGTDFALTISRLEPEDCAVYYCQHYDNSPWTFGQGTKVEIK

SEQ ID NO: 26037 - DNA, 336 bp, Artificial Sequence
  Description of Artificial Sequence: Synthetic polynucleotide
gatattgtgatgactcagtctccactctccctgcccgtcacccctggagagccggcctccatctcatgcaggtatagtcagagcctcgtgcatagtagtggatacaactatttggattggtacctgcagaagccagggcagtctccacagctcgttatctatttgggttctaatcgggcctccggggtccctgacaggttcagtggcagtggatcaggttcagattttacactgaagatcagcagagtggaggctgaggatgttggactttattactgcatgcaagctctacaccctcctctcactttcggcggagggaccaaggtggagatcaaa

SEQ ID NO: 26038 - protein, 112 aa, Artificial Sequence
  Description of Artificial Sequence: Synthetic polypeptide
DIVMTQSPLSLPVTPGEPASISCRYSQSLVHSSGYNYLDWYLQKPGQSPQLVIYLGSNRASGVPDRFSGSGSGSDFTLKISRVEAEDVGLYYCMQALHPPLTFGGGTKVEIK

SEQ ID NO: 26039 - DNA, 339 bp, Artificial Sequence; identical to SEQ ID NO: 25813
  Description of Artificial Sequence: Synthetic polynucleotide

SEQ ID NO: 26040 - protein, 113 aa, Artificial Sequence; identical to SEQ ID NO: 25814
  Description of Artificial Sequence: Synthetic polypeptide

SEQ ID NO: 26041 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtctgggacagacttcgctctcaccatcagcagagtggagcctgaagattgtgcagtgtattactgtcagcactatgataactcaccgtggacgttcggccaagggaccaaggtggaaatcaaa

SEQ ID NO: 26042 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRSTGIPDRFSGSGSGTDFALTISRVEPEDCAVYYCQHYDNSPWTFGQGTKVEIK

SEQ ID NO: 26043 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtctgggacagacttcgctctcaccatcagcagagtggagcatgaagattgtgcagtgtattactgtcagcactatgataactcaccgtggacgttcggccaagggaccaaggtggaaatcaaa

SEQ ID NO: 26044 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRSTGIPDRFSGSGSGTDFALTISRVEHEDCAVYYCQHYDNSPWTFGQGTKVEIK

SEQ ID NO: 26045 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctgcccaggctcccaggctcctcatttatggtgcatccagccggtccactggcatcccagacaggttcagtggcagtgggtctgggacagacttcgctctcaccatcagcagagtggagcctgaagattgtgcagtgtattactgtcagcattctgataactcaccgtggacgttcggccaagggaccaaggtggaaatcaaa

SEQ ID NO: 26046 - protein, 108 aa, Artificial Sequence
  Description of Artificial Sequence: Synthetic polypeptide
EIVLTQSPGTLYLSPGERATLSCRASQSVYSSYLAWYQQKPAQAPRLLIYGASSRSTGIPDRFSGSGSGTDFALTISRVEPEDCAVYYCQHSDNSPWTFGQGTKVEIK

SEQ ID NO: 26047 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcatcatttatggtgcatccagccggtccactggcatcccagacaggttcagtggcagtgggtctgggacagacttcgctctcaccatcagcagagtggagcctgaagattgtgcagtgtattactgtcagcactatgataactcaccgtggacgttcggccaagggaccaaggtggaaatcaaa

SEQ ID NO: 26048 - protein, 108 aa, Artificial Sequence
  Description of Artificial Sequence: Synthetic polypeptide
EIVLTQSPGTLYLSPGERATLSCRASQSVYSSYLAWYQQKPGQAPRLIIYGASSRSTGIPDRFSGSGSGTDFALTISRVEPEDCAVYYCQHYDNSPWTFGQGTKVEIK

SEQ ID NO: 26049 - DNA, 339 bp, Artificial Sequence
  Description of Artificial Sequence: Synthetic polynucleotide
gacatcgtgatgacccagtctccagattgcctggctgtgtctctgggcgagagggccaccatcaactgcaagtccagccagagtgttttatacacctccaacaataacaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgttgcagtttattattgtcagcaatattatactactccgtggacgttcggccaagggaccaaggtggaaatcaaa

SEQ ID NO: 26050 - protein, 113 aa, Artificial Sequence
  Description of Artificial Sequence: Synthetic polypeptide
DIVMTQSPDCLAVSLGERATINCKSSQSVLYTSNNNNYLAWYQQKPGQPPKLLIYWASTRESGVPDRFSGSGSGTDFTLTISSLQAEDVAVYYCQQYYTTPWTFGQGTKVEIK

SEQ ID NO: 26051 - DNA, 324 bp, Artificial Sequence
  Description of Artificial Sequence: Synthetic polynucleotide
gaaattgtgttgacgcagtctccaggcaccctgtatttgtctccaggggaaagagccaccctgtcatgcagggccagtcagagtgtttacagcagctacttagcgtggtaccagcagaaacctggccaggctcccaggctcctcatttatggtgcatccagccgggccacgggcatcccagacaggttcagtggcagtgggtgtgggacagacttcgctctcaccatcagcagagtggagcatgaagattgtgcagtgtattactgtcagcactctgataactcaccgtggacgttcggccaagggaccaaggtggaaatcaaa

SEQ ID NO: 26052 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRATGIPDRFSGSGCGTDFALTISRVEHEDCAVYYCQHSDNSPWTFGQGTKVEIK

SEQ ID NO: 26053 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttggcagcaactacttagcctggtaccagcagaaacgtggccaggctcccaggctcctcatctatggtgcatccagcagggccactgacatcccagacaggttcagtggcagtgggtctgggacagacttcactctcaccatcagcagactggagcctgaagattttgcagtgtattactgtcagcagtatgaaagttcaccgtggacgttcggccaagggaccaaggtggaaatcaaa

SEQ ID NO: 26054 - protein, 108 aa, Artificial Sequence
  Description of Artificial Sequence: Synthetic polypeptide
EIVLTQSPGTLSLSPGERATLSCRASQSVGSNYLAWYQQKRGQAPRLLIYGASSRATDIPDRFSGSGSGTDFTLTISRLEPEDFAVYYCQQYESSPWTFGQGTKVEIK

SEQ ID NO: 26055 - DNA, 336 bp, Artificial Sequence
  Description of Artificial Sequence: Synthetic polynucleotide
gatattgtgatgactcagtctccactctccctccctgtcacccctggagagccggcctccatctcatgcaggtctagtcagagcctcgtgcatagtagtggatacaactatttggattggtacctgcagaagccagggcagtctccacaactcgtgatctatttgggttctaatcgggcctccggggtccctgacaggttcagtggcagtggttcagtcacagattttacactgagaatcagcagagtggaggctgaggatattgggatttattattgcatgcaagctctacatattcctctcactttcggcggagggaccaaggtggagatcaaa

SEQ ID NO: 26056 - protein, 112 aa, Artificial Sequence
  Description of Artificial Sequence: Synthetic polypeptide
DIVMTQSPLSLPVTPGEPASISCRSSQSLVHSSGYNYLDWYLQKPGQSPQLVIYLGSNRASGVPDRFSGSGSVTDFTLRISRVEAEDIGIYYCMQALHIPLTFGGGTKVEIK

SEQ ID NO: 26057 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgccgggccagtcaggatgttatcacctacttagcctggtaccagcagaaacctggccaggctcccaggctcctcatctatggtgcatccaccagggccactggtgtcccagccaggttcagtggcagtgggtctgggacagagttcactctcaccatcaccagcctgcagtctgaagattttgcactttattactgtcaggagtataatgactggccgtgcagttttggccaggggaccaagctggagatcaaa

SEQ ID NO: 26058 - protein, 107 aa, Artificial Sequence
  Description of Artificial Sequence: Synthetic polypeptide
EIVMTQSPATLSVSPGERATLSCRASQDVITYLAWYQQKPGQAPRLLIYGASTRATGVPARFSGSGSGTEFTLTITSLQSEDFALYYCQEYNDWPCSFGQGTKLEIK

SEQ ID NO: 26059 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccggtccactgtcatcccagacaggttcagtggcagtgggtgtgggacagacttcgctctcaccatcagcagactggagcctgaagattgtgcagtgtattactgtcagcattatgataactctccgtggacgttcggccaagggaccaaggtggaaatcaaa

SEQ ID NO: 26060 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRSTVIPDRFSGSGCGTDFALTISRLEPEDCAVYYCQHYDNSPWTFGQGTKVEIK

SEQ ID NO: 26061 - DNA, 339 bp, Artificial Sequence
  Description of Artificial Sequence: Synthetic polynucleotide
gacatcgtgatgacccagtctccagactccctggctgcgtctctgggcgagagggccaccatcaactgcaagtccagtcagaatattttatccagctccaacaataagaactacttaacttggtaccagcagaaaccaggacagcctcctaaaatactcatttactggacatctacccgggaatccggggtccctgaccgattcagtggcagcgggtttgggacagatttcactctcaccatcagcagcctgcaggctgaagatgtggctgtttattactgtcagcaatattttagtgttcctccgacgttcggccaagggaccaaggtggaaatcaaa

SEQ ID NO: 26062 - protein, 113 aa, Artificial Sequence
  Description of Artificial Sequence: Synthetic polypeptide
DIVMTQSPDSLAASLGERATINCKSSQNILSSSNNKNYLTWYQQKPGQPPKILIYWTSTRESGVPDRFSGSGFGTDFTLTISSLQAEDVAVYYCQQYFSVPPTFGQGTKVEIK

SEQ ID NO: 26063 - DNA, 324 bp, Artificial Sequence
  Description of Artificial Sequence: Synthetic polynucleotide
gaaattgtgttgacgcagtctccaggcaccctgtctttgtctccaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtctgggacagacttcgctctcaccatcagcagactggagcctgaagattttgcagtgtattactgtcagcactatgataactcaccgtggacgttcggccaagggaccaaggtggaaatcaaa

SEQ ID NO: 26064 - protein, 108 aa, Artificial Sequence
  Description of Artificial Sequence: Synthetic polypeptide
EIVLTQSPGTLSLSPGERATLSCRASQSVYSSYLAWYQQKPGQAPRLLIYGASSRSTGIPDRFSGSGSGTDFALTISRLEPEDFAVYYCQHYDNSPWTFGQGTKVEIK

SEQ ID NO: 26065 - DNA, 339 bp, Artificial Sequence; identical to SEQ ID NO: 25873
  Description of Artificial Sequence: Synthetic polynucleotide

SEQ ID NO: 26066 - protein, 113 aa, Artificial Sequence; identical to SEQ ID NO: 25874
  Description of Artificial Sequence: Synthetic polypeptide

SEQ ID NO: 26067 - DNA, 324 bp, Artificial Sequence
  Description of Artificial Sequence: Synthetic polynucleotide
gaaattgtgttgacgcagtctccaggcaccctgtatttgtctccaggggaaagagccaccctctcctgcagggccagtcagagtgtttacagcagctacttagcctggtaccagcagaaacctggccaggctcccaggctcctcatctatggtgcatccagccgggccactggcataccagacaggttcagtggcagtgggtctgggacagacttcgctctcaccatcagcagactggagcatgaagattgtgcagtgtattactgtcagcactatgataactcaccgtggacgttcggccaagggaccaaggtggaaatcaaa

SEQ ID NO: 26068 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRATGIPDRFSGSGSGTDFALTISRLEHEDCAVYYCQHYDNSPWTFGQGTKVEIK

SEQ ID NO: 26069 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtgtgggacagacttcgctctcaccatcagcagagtggagcctgaagattttgcagtgtattactgtcagcactctgataactcaccgtggacgttcggccaagggaccaaggtggaaatcaaa

SEQ ID NO: 26070 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRSTGIPDRFSGSGCGTDFALTISRVEPEDFAVYYCQHSDNSPWTFGQGTKVEIK

SEQ ID NO: 26071 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttgacagcagctacctagcctggtaccagcagaaaactggccaggctcccaggctcctcatctatggtgcatccagcagggcccctggcatcccagacaggttcagtggcagtgggtctgggacagacttcactctcaccatcagcagactggagcctgaagattttgcagtgtattactgtcagcagtatgaaagctcaccgtggacgttcggccaagggaccaaggtggaaatcaaa

SEQ ID NO: 26072 - protein, 108 aa, Artificial Sequence
  Description of Artificial Sequence: Synthetic polypeptide
EIVLTQSPGTLSLSPGERATLSCRASQSVDSSYLAWYQQKTGQAPRLLIYGASSRAPGIPDRFSGSGSGTDFTLTISRLEPEDFAVYYCQQYESSPWTFGQGTKVEIK

SEQ ID NO: 26073 - DNA, 324 bp, Artificial Sequence
  Description of Artificial Sequence: Synthetic polynucleotide
gaaattgtgttgacgcagtctccaggcaccctgtctttgtctcaaggggaaagagccaccctctcctgcagggccagtcagagtgttagcagcaggtacttagcctggtaccagcagaaacctggccaggctcccagactcctcatctatggtgcatccagcagggccactggcatcccagacaggttcagtggcagtgggtctgggacagacttcactctcaccatcagcagactggagcctgaagattttgcagtatattactgtcagcattatgatagctcaccgtggacgttcggccaagggaccaaggtggaaaatcaa

SEQ ID NO: 26074 - protein, 108 aa, Artificial Sequence
  Description of Artificial Sequence: Synthetic polypeptide
EIVLTQSPGTLSLSQGERATLSCRASQSVSSRYLAWYQQKPGQAPRLLIYGASSRATGIPDRFSGSGSGTDFTLTISRLEPEDFAVYYCQHYDSSPWTFGQGTKVENQ

SEQ ID NO: 26075 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggccattagagatgatttaggctggtatcagcagaaaccagggaaagcccctcagcgcctgatctttgctgcatccagtttgcaaagtggggtcccatcaaggttcagcggcagtggatctgggacagaattcactctcacaatcagcagcctgcagcctgaagattttgcaacttattactgtctccagcattatagttaccctcggacgttcggccgagggaccaaggtggcaatcaaa

SEQ ID NO: 26076 - protein, 107 aa, Artificial Sequence
  Description of Artificial Sequence: Synthetic polypeptide
DIQMTQSPSSLSASVGDRVTITCRASQAIRDDLGWYQQKPGKAPQRLIFAASSLQSGVPSRFSGSGSGTEFTLTISSLQPEDFATYYCLQHYSYPRTFGRGTKVAIK

SEQ ID NO: 26077 - DNA, 339 bp, Artificial Sequence; identical to SEQ ID NO: 25825
  Description of Artificial Sequence: Synthetic polynucleotide

SEQ ID NO: 26078 - protein, 113 aa, Artificial Sequence; identical to SEQ ID NO: 25826
  Description of Artificial Sequence: Synthetic polypeptide

SEQ ID NO: 26079 - DNA, 339 bp, Artificial Sequence
  Description of Artificial Sequence: Synthetic polynucleotide
aatatcgtgatgacccagtctccagactccctggctgtgtctctgggcgcgagggccaccatcaactgcaagtccagccagagtgttttacacaactccaacaattacaactacttaacttggtaccagcagaaaccaggacagcctcctaagctgctcctttactgggcatctacccggaaatccggggtccctgaccgattcagtggcagcgggtctgggacagatttcactctcaccatcagcagcctgcaggctgaagatgtggcagtttatttctgtcagcaatattatagttctcctccgacgttcggccaagggaccaaggtggaaatcaaa

SEQ ID NO: 26080 - protein, 113 aa, Artificial Sequence
  Description of Artificial Sequence: Synthetic polypeptide
NIVMTQSPDSLAVSLGARATINCKSSQSVLHNSNNYNYLTWYQQKPGQPPKLLLYWASTRKSGVPDRFSGSGSGTDFTLTISSLQAEDVAVYFCQQYYSSPPTFGQGTKVEIK

SEQ ID NO: 26081 - DNA, 339 bp, Artificial Sequence
  Description of Artificial Sequence: Synthetic polynucleotide
gacatcgttatgacccagtctccagactccctggctgtgtctctgggcgagagggccaccatcaattgcaagtccagccagagtgttttattcagctccaacaattataattacttagcttggtaccagcagagaccaggacagcctcctaacctgctcatttactgggcatctacccgggaatccggggtccctgaccgattcagtggcagcgggtctgggacagatttcactctcaccatcagcagcctgcaggctgctgatgtggcagtttattactgtcagcaatatcatagttctcctctgacgttcggccaagggaccacggtgcaaatcaaa

SEQ ID NO: 26082 - protein, 113 aa, Artificial Sequence
  Description of Artificial Sequence: Synthetic polypeptide
DIVMTQSPDSLAVSLGERATINCKSSQSVLFSSNNYNYLAWYQQRPGQPPNLLIYWASTRESGVPDRFSGSGSGTDFTLTISSLQAADVAVYYCQQYHSSPLTFGQGTTVQIK

SEQ ID NO: 26083 - DNA, 339 bp, Artificial Sequence; identical to SEQ ID NO: 25873
  Description of Artificial Sequence: Synthetic polynucleotide

SEQ ID NO: 26084 - protein, 113 aa, Artificial Sequence; identical to SEQ ID NO: 25874
  Description of Artificial Sequence: Synthetic polypeptide

SEQ ID NO: 26085 - DNA, 324 bp, Artificial Sequence
  Description of Artificial Sequence: Synthetic polynucleotide
gaaattgtgttgacgcagtctccaggcaccctgtatttgtctccaggggaaagagccaccttctcatgcagggccagtcagagtgtttacagcagctacttagcgtggtaccagcagaaacctggccaggctcccaggctcctcatttatggtgcatccagccggtccactggcatcccagacaggttcagtggcagtgggtctgggacagacttcgctctcaccatcagcagactggagcctgaagattttgcagtgtattactgtcagcattatgataactcaccgtggacgttcggccaagggaccaaggtggaaatcaaa

SEQ ID NO: 26086 - protein, 108 aa, Artificial Sequence
  Description of Artificial Sequence: Synthetic polypeptide
EIVLTQSPGTLYLSPGERATFSCRASQSVYSSYLAWYQQKPGQAPRLLIYGASSRSTGIPDRFSGSGSGTDFALTISRLEPEDFAVYYCQHYDNSPWTFGQGTKVEIK

SEQ ID NO: 26087 - DNA, 324 bp, Artificial Sequence
  Description of Artificial Sequence: Synthetic polynucleotide
gaaattgtgttgacgcagtctccaggcaccctgtctttgtctccaggggaaagagccaccctctcatgcagggccagtcagagtgtttacagcagctacttagcctggtaccagcagaaacctggccaggctcccaggctcctcatctatggtgcatccagccgggccactggcatcccagacaggttcagtggcagtgggtctgggacagacttcgctctcaccatcagcagactggagcctgaagattgtgcagtgtattactgtcagcactatgataactcaccgtggacgttcggccaagggaccaaggtggaaatcaaa

SEQ ID NO: 26088 - protein, 108 aa, Artificial Sequence
  Description of Artificial Sequence: Synthetic polypeptide
EIVLTQSPGTLSLSPGERATLSCRASQSVYSSYLAWYQQKPGQAPRLLIYGASSRATGIPDRFSGSGSGTDFALTISRLEPEDCAVYYCQHYDNSPWTFGQGTKVEIK

SEQ ID NO: 26089 - DNA, 321 bp, Artificial Sequence
  Description of Artificial Sequence: Synthetic polynucleotide
gaaatagtgatgacgcagtctccagccaccctgtctctgtctccaggggaaagagccaccctctcctgcagggccagtatgagtgttgtcaacagcttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcaatttattactgtcagcagtataatgactggccgtgcagttttggccaggggaccaagctggagatcaaa

SEQ ID NO: 26090 - protein, 107 aa, Artificial Sequence
  Description of Artificial Sequence: Synthetic polypeptide
EIVMTQSPATLSLSPGERATLSCRASMSVVNSLAWYQQKPGQAPRLLIYGASTRATGIPARFSGSGSGTEFTLTISSLQSEDFAIYYCQQYNDWPCSFGQGTKLEIK

SEQ ID NO: 26091 - DNA, 339 bp, Artificial Sequence
  Description of Artificial Sequence: Synthetic polynucleotide
gacatcgttatgacccagtgtccagactccctggctgtgtctctgggcgagagggccaccatcaattgcaagtccagccagagtgttttattcagatccaacaattataattacttagcttggtaccagcagagaccaggacagcctcataacctgctcatttactgggcatctacccgggaatccggggtccctgaccgattcagtggcagcgggtatgggacagatttcactctcaccatcagcagcgtgcaggctgctgatgtggcagtttattactgtcagcaatatcatagttctcctctgacgttcggccaagggaccacggtgcaaatcaaa

SEQ ID NO: 26092 - protein, 113 aa, Artificial Sequence
  Description of Artificial Sequence: Synthetic polypeptide
DIVMTQCPDSLAVSLGERATINCKSSQSVLFRSNNYNYLAWYQQRPGQPHNLLIYWASTRESGVPDRFSGSGYGTDFTLTISSVQAADVAVYYCQQYHSSPLTFGQGTTVQIK

SEQ ID NO: 26093 - DNA, 324 bp, Artificial Sequence
  Description of Artificial Sequence: Synthetic polynucleotide
gaaattgtgttgacgcagtctccaggcaccctgtatttgtctccaggggaaagagccaccctctcctgcagggccagtcagagtgtttacagcagctacttagcctggtaccagcagaaacctggccaggctcccaggctcctcatttatggtgcatccagccggtccactggcatcccagacaggttcagtggcagtgggtgtgggacagacttcgctctcaccatcagcagactggagcctgaagattttgcagtgtattactgtcagcactatgataactcaccgtggacgttcggccaagggaccaaggtggaaatcaaa

SEQ ID NO: 26094 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRSTGIPDRFSGSGCGTDFALTISRLEPEDFAVYYCQHYDNSPWTFGQGTKVEIK

SEQ ID NO: 26095 - DNA, 324 bp, Artificial Sequence
  Description of Artificial Sequence: Synthetic polynucleotide
gaaattgtgttgacgcagtctccaggcaccctgtatttgtcttcaggggaaagagccaccctctcatgcagggccagtcagagtgtttacagcagctacttagcgtggtaccagcagaaacctggccaggctcccaggctcctcatttatggtgcatccagccggtccactggcatcccagacaggttcagtggcagtgggtctgggacagacttcgctctcaccatcagcagagtggagcatgaagattgtgcagtgtattactgtcagcactatgataactcaccgtggacgttcggccaagggaccaaggtggaaatcaaa

SEQ ID NO: 26096 - protein, 108 aa, Artificial Sequence
  Description of Artificial Sequence: Synthetic polypeptide
EIVLTQSPGTLYLSSGERATLSCRASQSVYSSYLAWYQQKPGQAPRLLIYGASSRSTGIPDRFSGSGSGTDFALTISRVEHEDCAVYYCQHYDNSPWTFGQGTKVEIK

SEQ ID NO: 26097 - DNA, 324 bp, Artificial Sequence
  Description of Artificial Sequence: Synthetic polynucleotide
gaaattgtgttgtcgcagtctccaggcatcctgtatttgtcttcaggggaaagagccaccctctcctgcagggccagtcagagtgtttacagcagctacttagcctggtaccagcagaaacctggccaggctcccaggctcctcatttatggtgcatccagccgggccactggcatcccagacaggttcagtggcagtgggtctgggacagacttcgctctcaccatcagcagactggagcctgaagattttgcagtgtattactgtcagcactatgataactctccgtggacgttcggccaagggaccaaggtggaaatcaaa

SEQ ID NO: 26098 - protein, 108 aa, Artificial Sequence
  Description of Artificial Sequence: Synthetic polypeptide
EIVLSQSPGILYLSSGERATLSCRASQSVYSSYLAWYQQKPGQAPRLLIYGASSRATGIPDRFSGSGSGTDFALTISRLEPEDFAVYYCQHYDNSPWTFGQGTKVEIK

SEQ ID NO: 26099 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaatgcgaactacttagcttggtaccagcagaaaccaggacagcctcctaacctgttcatttactgggcatctacccgggaatccggggtccctgaccgattcagtggcagcgggtctgggacagatttcactctcaccatcagcagcctgcaggctgaagatgtggcagtttattactgtcagcaatattatagtactccgtgcagttttggccaggggaccaaggtggagatcaaa

SEQ ID NO: 26100 - protein, 113 aa, Artificial Sequence
  Description of Artificial Sequence: Synthetic polypeptide
DIVMTQSPDSLAVSLGERATINCKSSQSVLYSSNNANYLAWYQQKPGQPPNLFIYWASTRESGVPDRFSGSGSGTDFTLTISSLQAEDVAVYYCQQYYSTPCSFGQGTKVEIK

SEQ ID NO: 26101 - DNA, 324 bp, Artificial Sequence
  Description of Artificial Sequence: Synthetic polynucleotide
gaaattgtgttgacgcagtctccaggcaccctgtctttgtctacaggggaaagagccaccctctcgtgcagggccagtcagagcgttagcagcagctacttagcttggtaccagcagaaacctggccagcctcccaggctcctcatttatggtgcatccaccagggcctctggcatcccagacaggttcagtggcagtgggtctgggacagacttcactctcaccatcagcagactggagcctgaatattttgcagtttattactgtcagcagtatggtaactcaccgctcactttcggcggagggaccaaggtggagatcaaa

SEQ ID NO: 26102 - protein, 108 aa, Artificial Sequence
  Description of Artificial Sequence: Synthetic polypeptide
EIVLTQSPGTLSLSTGERATLSCRASQSVSSSYLAWYQQKPGQPPRLLIYGASTRASGIPDRFSGSGSGTDFTLTISRLEPEYFAVYYCQQYGNSPLTFGGGTKVEIK

SEQ ID NO: 26103 - DNA, 339 bp, Artificial Sequence
  Description of Artificial Sequence: Synthetic polynucleotide
gacagcgtgatgacccagtctccagactccctggctgtgtctctgggcgagagggccaccatcaactgcaagtccagccagagtgttttacacagctctaataaaaagaactacttagcttggtaccagcagaaaccaggacagcctcctaagctgctcatttactgggcatctacctgggaatccggggtccctgaccgattcagtggcagcgggtctgggacagatttcactctcaccatcagcagtctgcaggctgaagatgtggcagtttattactgtcagcaatattataggactccgtggacgttcggccaagggaccaaggtggaaatcaaa

SEQ ID NO: 26104 - protein, 113 aa, Artificial Sequence
  Description of Artificial Sequence: Synthetic polypeptide
DSVMTQSPDSLAVSLGERATINCKSSQSVLHSSNKKNYLAWYQQKPGQPPKLLIYWASTWESGVPDRFSGSGSGTDFTLTISSLQAEDVAVYYCQQYYRTPWTFGQGTKVEIK

SEQ ID NO: 26105 - DNA, 321 bp, Artificial Sequence
  Description of Artificial Sequence: Synthetic polynucleotide
gacatccagatgacccagtctccatcctccctgtctgcttctgtaggagacagagtcaccatcacttgccgggcaagtcagggcattagaaatgatttaggctggtatcagcagaaaccagggaaagcccctaagcgcctgatctatgctgcatccactttgcaaagtggggtcccatcaaggttcagcggcagtggatctgggacagaattcactctcacaatcagcggcctgcagcgtgaagattttgcaacttatcactgtctacagcatagtaattacccgctcactttcggcggagggaccaaggtggagatcaaa

SEQ ID NO: 26106 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASTLQSGVPSRFSGSGSGTEFTLTISGLQREDFATYHCLQHSNYPLTFGGGTKVEIK

SEQ ID NO: 26107 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatttaggctggtatcagcagaaaccagggaaagcccctaagcgcctgatctatggtgtatccagtttgcaaagtggggtcccatcaaggttcagcggcagtggatctgggaccgaattcactctcacaatcagcagcctgcagcgtgaagattttgcaacttattactgtctacagcataatgattacccattcactttcggccgtgggaccaaagtggatatcaaa

SEQ ID NO: 26108 - protein, 107 aa, Artificial Sequence
  Description of Artificial Sequence: Synthetic polypeptide
DIQMTQSPSSLSASVGDRVTITCRASQDIRNDLGWYQQKPGKAPKRLIYGVSSLQSGVPSRFSGSGSGTEFTLTISSLQREDFATYYCLQHNDYPFTFGRGTKVDIK

SEQ ID NO: 26109 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttgcacagctccaacaattataattacttagcttggtaccagcagaaaccaggacagcctcctaacctgctcatttactgggcatctacccgggaatccggggtccctgaccgattcagtggcagcgggtctgggacagatttcactctcaccatcagcagcctgcaggctgctgatgtggcagtttattactgtcagcaatattatagtagtccaccgacgttcggccaagggaccacggtggaaatcaaa

SEQ ID NO: 26110 - protein, 113 aa, Artificial Sequence
  Description of Artificial Sequence: Synthetic polypeptide
DIVMTQSPDSLAVSLGERATINCKSSQSVLHSSNNYNYLAWYQQKPGQPPNLLIYWASTRESGVPDRFSGSGSGTDFTLTISSLQAADVAVYYCQQYYSSPPTFGQGTTVEIK

SEQ ID NO: 26111 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttgtacagctccaacagtcacaactacttagcttggtaccagcagaaaccaggacagcctcctaaactgctcatttactgggcatctatccgggaatccggggtccctgaccgattcagtggcagcgggtctgggacagatttcactctctccatcagcagcatgcaggctgaagatgtggcagtttattactgtcagcaatattatagtactccgtgcagttttggccaggggaccaaggtggagatcaaa

SEQ ID NO: 26112 - protein, 113 aa, Artificial Sequence
  Description of Artificial Sequence: Synthetic polypeptide
DIVMTQSPDSLAVSLGERATINCKSSQSVLYSSNSHNYLAWYQQKPGQPPKLLIYWASIRESGVPDRFSGSGSGTDFTLSISSMQAEDVAVYYCQQYYSTPCSFGQGTKVEIK

SEQ ID NO: 26113 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcttccagtttgcaaagtggggtcccctcaaagttcagcggcagtggatctgggacagatttcactctcaccatcaacagcctgcagcctgaagattttgcaacttattactgccaccagtataatgattacccattcactttcggccctgggaccaaagtggatatcaaa

SEQ ID NO: 26114 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTDFTLTINSLQPEDFATYYCHQYNDYPFTFGPGTKVDIK

SEQ ID NO: 26115 - DNA, 339 bp, Artificial Sequence
  Description of Artificial Sequence: Synthetic polynucleotide
gacatcgtgatgacccagtctccagactccctggctgtgtctctgggcgagagggccaccatcaattgcaagtccagtcagaatattttatccagctccaacaataagaactacttaacttggtaccagcagaaaccaggacagcctcctaaaatactcatttactggacatctacccgggaatccggggtccctgaccgattcagtggcagcgggtttgggacagatttcactctcaccatcagcagcctgcaggctgaagatgtggctgtttattactgtcagcaatattttagtgttcctccgacgttcggccaagggaccaaggtggaaatcaaa

SEQ ID NO: 26116 - protein, 113 aa, Artificial Sequence
  Description of Artificial Sequence: Synthetic polypeptide
DIVMTQSPDSLAVSLGERATINCKSSQNILSSSNNKNYLTWYQQKPGQPPKILIYWTSTRESGVPDRFSGSGFGTDFTLTISSLQAEDVAVYYCQQYFSVPPTFGQGTKVEIK

SEQ ID NO: 26117 - DNA, 324 bp, Artificial Sequence
  Description of Artificial Sequence: Synthetic polynucleotide
gaaattgtgttgacgcagtctccaggcaccctgtatttgtcttcaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtgtgggacagacttcgctctcaccatcagcagactggagcctgaagattgtgcagtgtattactgtcagcattctgataactcaccgtggacgttcggccaagggaccaaggtggaaatcaaa

SEQ ID NO: 26118 - protein, 108 aa, Artificial Sequence
  Description of Artificial Sequence: Synthetic polypeptide
EIVLTQSPGTLYLSSGERATLSCRASQSVYSSYLAWYQQKPGQAPRLLIYGASSRSTGIPDRFSGSGCGTDFALTISRLEPEDCAVYYCQHSDNSPWTFGQGTKVEIK

SEQ ID NO: 26119 - DNA, 339 bp, Artificial Sequence
  Description of Artificial Sequence: Synthetic polynucleotide
gacatcgtgatgacccagtctccagattgcctggctgtgtctctgggcgagagggccaccatcaactgcaagtccagccagagtgttttatacacctccaacaataacaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgttgcagtttattattgtcagcactacaatgatactccatggaagtttgtccaagggaccaaggtggaaatcaca

SEQ ID NO: 26120 - protein, 113 aa, Artificial Sequence
  Description of Artificial Sequence: Synthetic polypeptide
DIVMTQSPDCLAVSLGERATINCKSSQSVLYTSNNNNYLAWYQQKPGQPPKLLIYWASTRESGVPDRFSGSGSGTDFTLTISSLQAEDVAVYYCQHYNDTPWKFVQGTKVEIT

SEQ ID NO: 26121 - DNA, 324 bp, Artificial Sequence
  Description of Artificial Sequence: Synthetic polynucleotide
gaaattgtgttgacgcagtctccaggcaccctgtctttgtctccaggggaaagagccaccctctcatgcagggccagtcagagtgtttacagcagctacttagcctggtaccagcagaaacctggccaggctcccaggctcctcatttatggtgcatccagccgggccactggcatcccagacaggttcagtggcagtgggtgtgggacagacttcgctctcaccatcagcagagtggagcctgaagattgtgcagtgtattactgtcagcactctgataactcaccgtggacgttcggccaagggaccaaggtggaaatcaaa

SEQ ID NO: 26122 - protein, 108 aa, Artificial Sequence
  Description of Artificial Sequence: Synthetic polypeptide
EIVLTQSPGTLSLSPGERATLSCRASQSVYSSYLAWYQQKPGQAPRLLIYGASSRATGIPDRFSGSGCGTDFALTISRVEPEDCAVYYCQHSDNSPWTFGQGTKVEIK

SEQ ID NO: 26123 - DNA, 321 bp, Artificial Sequence
  Description of Artificial Sequence: Synthetic polynucleotide
gacatcaagatgacccagtctccatcttccgtgtctgcatctgtaggagacagagtcaccatcacttgtcgggcgagtcagggtattaacaactggttagtctggtatcagcagaaaccagggaaagcccctaagctcctgatctatgctgcatccagtttgcaaagtggggtcccatcaaggttccgcggcagtggatctgggacagatttcactctcaccatcagcagcctgcagcctgaagattttgcaacttactattgtcaacaggctaacagtttcccattcactttcggccctgggaccaaagtggatatcaaa

SEQ ID NO: 26124 - protein, 107 aa, Artificial Sequence
  Description of Artificial Sequence: Synthetic polypeptide
DIKMTQSPSSVSASVGDRVTITCRASQGINNWLVWYQQKPGKAPKLLIYAASSLQSGVPSRFRGSGSGTDFTLTISSLQPEDFATYYCQQANSFPFTFGPGTKVDIK

SEQ ID NO: 26125 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcggtggatctgggacagaattcactctcacaatcagcagcctgcagcctgaagattttgcaacttattactgtcttcagcatagtacttacccgctcactttcggcggagggaccaaggtggagatcaaa

SEQ ID NO: 26126 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGGGSGTEFTLTISSLQPEDFATYYCLQHSTYPLTFGGGTKVEIK

SEQ ID NO: 26127 - DNA, 318 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcgactatttaaattggtatcagcaaaaaccagggaaagcccctaaggtcctgatctatactacatccagtttgcaaagtggggtcccatcaaggttcagtggcagtggatctgggacagatttcactctcaccatcagcagtctgcaacctgaagattttgcaacttactactgtcaacagagttacagtacccccactttcggcggagggaccaaggtggagatcaaa

SEQ ID NO: 26128 - protein, 106 aa, Artificial Sequence
  Description of Artificial Sequence: Synthetic polypeptide
DIQMTQSPSSLSASVGDRVTITCRASQSISDYLNWYQQKPGKAPKVLIYTTSSLQSGVPSRFSGSGSGTDFTLTISSLQPEDFATYYCQQSYSTPTFGGGTKVEIK

SEQ ID NO: 26129 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatggtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttgggctttatcactgcatgcaaagtatacagcttccgtggacgttcggccaagggaccaaggtggaaatcaaa

SEQ ID NO: 26130 - protein, 112 aa, Artificial Sequence
  Description of Artificial Sequence: Synthetic polypeptide
DIVMTQTPLSLSVTPGQPASISCKSSQSLLHGDGKTYLYWYLQKPGQPPQLLIYEVSNRFSGVPDRFSGSGSGTDFTLKISRVEAEDVGLYHCMQSIQLPWTFGQGTKVEIK

SEQ ID NO: 26131 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaataacaactacttagcttggtaccagcagaaaccaggacagcctcctaagctggtcatttactgggcatctacccgggaatccggggtccctgaccgattcagtggcagcgggtctgggacagatttcactctcaccatcagcagcctgcaggctgaagatgtggcagtttattactgtcagcaatattatagtactccgtgcagttttggccaggggaccaagctggagatcaaa

SEQ ID NO: 26132 - protein, 113 aa, Artificial Sequence
  Description of Artificial Sequence: Synthetic polypeptide
DIVMTQSPDSLAVSLGERATINCKSSQSVLYSSNNNNYLAWYQQKPGQPPKLVIYWASTRESGVPDRFSGSGSGTDFTLTISSLQAEDVAVYYCQQYYSTPCSFGQGTKLEIK

SEQ ID NO: 26133 - DNA, 324 bp, Artificial Sequence
  Description of Artificial Sequence: Synthetic polynucleotide
gaaattgtattgacgcagtctccaggcaccctgtctttatttccaggggaaagagccaccctctcctgcagggccagtcagaatattatcagcagctatttagcctggtaccagcagaaacctggccaggctcccaggctcctcatctttggtgtatctagtcgggccactggcatcccagacaggttcagtggcagtgggtctgggacagacttcactctcaccatcagcagactggagcctgaagattttgcagtgtattactgtcaacaatatggtaggtcaccattcaatttcggccctgggaccaaagtggatatcaac

SEQ ID NO: 26134 - protein, 108 aa, Artificial Sequence
  Description of Artificial Sequence: Synthetic polypeptide
EIVLTQSPGTLSLFPGERATLSCRASQNIISSYLAWYQQKPGQAPRLLIFGVSSRATGIPDRFSGSGSGTDFTLTISRLEPEDFAVYYCQQYGRSPFNFGPGTKVDIN

SEQ ID NO: 26135 - DNA, 321 bp, Artificial Sequence
  Description of Artificial Sequence: Synthetic polynucleotide
gacatccagatgacccagtctccagcttccgtgtctgcatctgtgggagacagagtcaccataacttgtcgggcgagtcagggtattagcaactggttagcctggtatcagcagaaaccagggaaagcccctaaactcctgatctatgctgcatccagtttgcaaggtggggtcccatcaaggttcagcggcagtggatctgggacagatttcactctctccatcagcagcctgcagcctgaagattttgcaacttactattgtcaacagactgacagtttcccattcactttcggccctgggaccaaagtggatatcaaa

SEQ ID NO: 26136 - protein, 107 aa, Artificial Sequence
  Description of Artificial Sequence: Synthetic polypeptide
DIQMTQSPASVSASVGDRVTITCRASQGISNWLAWYQQKPGKAPKLLIYAASSLQGGVPSRFSGSGSGTDFTLSISSLQPEDFATYYCQQTDSFPFTFGPGTKVDIK

SEQ ID NO: 26137 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttacacagctccaacaattataattacttagcttggtaccagcagaaaccaggacagcctcctaaggtgctcatttactgggcatctacccggaaatccggggtccctgaccgattcagtggtagcgggtctgggacagatttcactctcaccatcagcagcctgcaggctgaagatgtggcagtttattattgtcagcaatattatagtactccgtgcagttttggccaggggaccaagctggagatcaaa

SEQ ID NO: 26138 - protein, 113 aa, Artificial Sequence
  Description of Artificial Sequence: Synthetic polypeptide
DIVMTQSPDSLAVSLGERATINCKSSQSVLHSSNNYNYLAWYQQKPGQPPKVLIYWASTRKSGVPDRFSGSGSGTDFTLTISSLQAEDVAVYYCQQYYSTPCSFGQGTKLEIK

SEQ ID NO: 26139 - DNA, 318 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcgactatttaaattggtatcagctgaaaccagggaaagcccctaaggtcctgatctatactacatccagtttgcaaagtggggtcccatcaaggttcagtggcagtggatctgggacagatttcactctcaccatcagcagtctgcaacctgaagattttgcaacttacttctgtcaacagagttacagtacccccactttcggcggagggaccaaggtggagatcaaa

SEQ ID NO: 26140 - protein, 106 aa, Artificial Sequence
  Description of Artificial Sequence: Synthetic polypeptide
DIQMTQSPSSLSASVGDRVTITCRASQSISDYLNWYQLKPGKAPKVLIYTTSSLQSGVPSRFSGSGSGTDFTLTISSLQPEDFATYFCQQSYSTPTFGGGTKVEIK

SEQ ID NO: 26141 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagaatattttacacagctccaacaataacaactacttagcttggtaccagcagaaaccaggacagcctccttacctgctcatttactgggcatctacccgggaatccggggtccctgaccgattcagtggcagcgggtctgggacagatttcactctcaccatcaccagcctgcaggctgaagatgtggcagtttattactgtcagcaatattatactactccgtgcagttttggccaggggaccaagctggagatcact

SEQ ID NO: 26142 - protein, 113 aa, Artificial Sequence
  Description of Artificial Sequence: Synthetic polypeptide
DIVMTQSPDSLAVSLGERATINCKSSQNILHSSNNNNYLAWYQQKPGQPPYLLIYWASTRESGVPDRFSGSGSGTDFTLTITSLQAEDVAVYYCQQYYTTPCSFGQGTKLEIT

SEQ ID NO: 26143 - DNA, 321 bp, Artificial Sequence; identical to SEQ ID NO: 24247
  Description of Artificial Sequence: Synthetic polynucleotide

SEQ ID NO: 26144 - protein, 107 aa, Artificial Sequence; identical to SEQ ID NO: 24146
  Description of Artificial Sequence: Synthetic polypeptide

SEQ ID NO: 26145 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaataattttggctggtatcagcagaaaccagggaaagcccctaagcgcctgatctatgctgcatccagtttgcaaagtggggtcccattaaggttcagcggcagtggatctgggacagaattcactctcacaatcagcagcctgcagcctgaagattttgcaacttattactgtctccaacatgatagttacccgctcactttcggcggagggaccaaggtggagatcaaa

SEQ ID NO: 26146 - protein, 107 aa, Artificial Sequence
  Description of Artificial Sequence: Synthetic polypeptide
DIQMTQSPSSLSASVGDRVTITCRASQDIRNNFGWYQQKPGKAPKRLIYAASSLQSGVPLRFSGSGSGTEFTLTISSLQPEDFATYYCLQHDSYPLTFGGGTKVEIK

SEQ ID NO: 26147 - DNA, 336 bp, Artificial Sequence
  Description of Artificial Sequence: Synthetic polynucleotide
gatattgtgatgacccagactcccctctctctgtccgtcacgcctggacagccggcctccatctcctgcaagtctagtcagagcctcctgcatagtgaaggaaagacctatttgtattggtacctgcagaagccaggccagcctccacagctcctgatctatgaagtttcccaccgggtctctggagtgccagataggttcagtggcagcgggtcagggacagatttcacagtgaaaatcagccgggtggaggctgaggatgttggggtttattactgcatgcaaagtacacagtttcctcccactttcggccctgggaccaaagtggatatcaaa

SEQ ID NO: 26148 - protein, 112 aa, Artificial Sequence
  Description of Artificial Sequence: Synthetic polypeptide
DIVMTQTPLSLSVTPGQPASISCKSSQSLLHSEGKTYLYWYLQKPGQPPQLLIYEVSHRVSGVPDRFSGSGSGTDFTVKISRVEAEDVGVYYCMQSTQFPPTFGPGTKVDIK

SEQ ID NO: 26149 - DNA, 321 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttggcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagcttattcactttcggccctgggaccaaagtggatatcaaa

SEQ ID NO: 26150 - protein, 107 aa, Artificial Sequence
  Description of Artificial Sequence: Synthetic polypeptide
EIVLTQSPGTLSLSPGERATLSCRASQSVGSSYLAWYQQKPGQAPRLLIYGASSRATGIPDRFSGSGSGTDFTLTISRLEPEDFAVYYCQQYGSLFTFGPGTKVDIK

SEQ ID NO: 26151 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttatcagtagctacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcaacaatatggtaggtcaccattcaatttcggccctgggaccaaagtggatatcaaa

SEQ ID NO: 26152 - protein, 108 aa, Artificial Sequence
  Description of Artificial Sequence: Synthetic polypeptide
EIVLTQSPGTLSLSPGERATLSCRASQSVISSYLAWYQQKPGQAPRLLIYGASSRATAIPDRFSGSGSGTDFTLTISRLEPEDFAVYYCQQYGRSPFNFGPGTKVDIK

SEQ ID NO: 26153 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttacacagctccaacaattacaactacttagcttggtaccagctgaaaccaagacagcctcctaagctgctcatttactgggcatctacccgggaatccggggtccctgaccgattcagtggccgcgggtcggggacagacttcactctcaccatcagcagcctgcaggctgaagatgtggcaatttattactgtcagcaatattatagtactccatccactttcggccctgggaccaaagtggagatcaaa

SEQ ID NO: 26154 - protein, 113 aa, Artificial Sequence
  Description of Artificial Sequence: Synthetic polypeptide
DIVMTQSPDSLAVSLGERATINCKSSQSVLHSSNNYNYLAWYQLKPRQPPKLLIYWASTRESGVPDRFSGRGSGTDFTLTISSLQAEDVAIYYCQQYYSTPSTFGPGTKVEIK

SEQ ID NO: 26155 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaataacaactacttagcttggtaccagcagaaaccaggacagcctcctaaactgctcatttactgggcatctacccgggaatccggggtccctgaccgattcagtggcagtgggtctgggacagatttcactctctccatcagcagcctgcaggctgaagatgtggcagtttattactgtcaccaatattatagtactccgtgcagttttggccaggggaccaaactggagatcaaa

SEQ ID NO: 26156 - protein, 113 aa, Artificial Sequence
  Description of Artificial Sequence: Synthetic polypeptide
DIVMTQSPDSLAVSLGERATINCKSSQSVLYSSNNNNYLAWYQQKPGQPPKLLIYWASTRESGVPDRFSGSGSGTDFTLSISSLQAEDVAVYYCHQYYSTPCSFGQGTKLEIK

SEQ ID NO: 26157 - DNA, 321 bp, Artificial Sequence; identical to SEQ ID NO: 24183
  Description of Artificial Sequence: Synthetic polynucleotide

SEQ ID NO: 26158 - protein, 107 aa, Artificial Sequence; identical to SEQ ID NO: 24184
  Description of Artificial Sequence: Synthetic polypeptide

SEQ ID NO: 26159 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacagtaacaactacttagcttggtaccagcagaaaccaggccagcctcctaagctgctcatttactgggcatctgcccgggaatccggggtccctgaccgattcagtggcagcgggtctgggacagatttcactctcaccatcagcagcctgcaggctgaagatgtggcagtttattactgtcagcaatattatactactcctcccactttcggccctgggaccaaagtggatatcaaa

SEQ ID NO: 26160 - protein, 113 aa, Artificial Sequence
  Description of Artificial Sequence: Synthetic polypeptide
DIVMTQSPDSLAVSLGERATINCKSSQSVLYSSNSNNYLAWYQQKPGQPPKLLIYWASARESGVPDRFSGSGSGTDFTLTISSLQAEDVAVYYCQQYYTTPPTFGPGTKVDIK

SEQ ID NO: 26161 - DNA, 333 bp, Artificial Sequence
  Description of Artificial Sequence: Synthetic polynucleotide
gatattgtgatgacccagactccactctctctgtccgtcacccctggacagccggcctccatctcctgcaagactagtcagagcctcctgcatagtgaaggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagctaatcaccttcggccaagggacacgactggagattaaa

SEQ ID NO: 26162 - protein, 111 aa, Artificial Sequence
  Description of Artificial Sequence: Synthetic polypeptide
DIVMTQTPLSLSVTPGQPASISCKTSQSLLHSEGKTYLYWYLQKPGQPPQLLIYEVSNRFSGVPDRFSGSGSGTDFTLKISRVEAEDVGVYYCMQSIQLITFGQGTRLEIK

SEQ ID NO: 26163 - DNA, 324 bp, Artificial Sequence
  Description of Artificial Sequence: Synthetic polynucleotide
caaattgtgttgacgcagtctccaggcaccctgtctttgtctccaggggaaagagccaccctctcctgcagggccagtcagagaattttcagcaactacttagcctggtaccagcagaagcctggccaggctcccaggatcctcatctatggtgcatccagcagggccactggcatcccagacaggatcagtggcagtgggtctgggacagacttcactctcaccatcaccagactggagcctgaagattttgcagtgtattactgtcagcagtatgatagctcaccgtggacgttcggccaagggaccaaggtggaaatcaac

SEQ ID NO: 26164 - protein, 108 aa, Artificial Sequence
  Description of Artificial Sequence: Synthetic polypeptide
QIVLTQSPGTLSLSPGERATLSCRASQRIFSNYLAWYQQKPGQAPRILIYGASSRATGIPDRISGSGSGTDFTLTITRLEPEDFAVYYCQQYDSSPWTFGQGTKVEIN

SEQ ID NO: 26165 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattaacaattatttagcctggtttcagcagaaaccagggaaagcccctaagtccctgatcgttgctgcatccagtttgcaaagtggggtcccatcaaagttcagcggcagtggatctgggacagatttcactctcaccatcagcagcctgcagcctgaagattttgcaacttattactgccaacagtataatagttaccctctcactttcggcggagggaccaaggtggagatcaaa

SEQ ID NO: 26166 - protein, 107 aa, Artificial Sequence
  Description of Artificial Sequence: Synthetic polypeptide
DIQMTQSPSSLSASVGDRVTITCRASQDINNYLAWFQQKPGKAPKSLIVAASSLQSGVPSKFSGSGSGTDFTLTISSLQPEDFATYYCQQYNSYPLTFGGGTKVEIK

SEQ ID NO: 26167 - DNA, 321 bp, Artificial Sequence
  Description of Artificial Sequence: Synthetic polynucleotide
gacatccagatgacccagtctccagcttccgtgtctgcatctgtaggagacagagtcaccataacttgtcgggcgagtcagaatattagcaactggttaacctggtatcagcagaaaccagggaaagcccctaagctcctgatctatgctgcatccagtttgcaaagtggggtcccatcaaggttcagcggcagtggatctgggacagatttcactctctccatcagcagcctgcagcctgaagattttgcaacttactattgtcaacagactgacagtttcccattcactttcggccctgggaccaaagtggatgtcaaa

SEQ ID NO: 26168 - protein, 107 aa, Artificial Sequence
  Description of Artificial Sequence: Synthetic polypeptide
DIQMTQSPASVSASVGDRVTITCRASQNISNWLTWYQQKPGKAPKLLIYAASSLQSGVPSRFSGSGSGTDFTLSISSLQPEDFATYYCQQTDSFPFTFGPGTKVDVK

SEQ ID NO: 26169 - DNA, 321 bp, Artificial Sequence
  Description of Artificial Sequence: Synthetic polynucleotide
gacatccagatgacccagtctccagcttccgtgtctgcatctgtaggagacagagtcaccataacttgtcgggcgagtcagggtattagcaactggttagcctggtatcaggagaaaccagggaaagcccctaaactcctgatctatgctgcatccagtttgcaaagtggggtcccatcaaggttcagcggcagtggatccgggacagatttcactctctccatcagcagcctgcagcctgaagattttgcaacttactattgtcaacagactgacagtttcccattcactttcggccctgggaccaaagtggatgtcaaa

SEQ ID NO: 26170 - protein, 107 aa, Artificial Sequence
  Description of Artificial Sequence: Synthetic polypeptide
DIQMTQSPASVSASVGDRVTITCRASQGISNWLAWYQEKPGKAPKLLIYAASSLQSGVPSRFSGSGSGTDFTLSISSLQPEDFATYYCQQTDSFPFTFGPGTKVDVK

SEQ ID NO: 26171 - DNA, 336 bp, Artificial Sequence
  Description of Artificial Sequence: Synthetic polynucleotide
gctattgtgatgacccagactccactctctctgtccgtcacccctggacagccggcctccatctcctgcaagtctagtcagagcctcctgcatggtgatggaaagacctatttttattggtacctgcagaagccaggccagcctccacagctcctgatctatgaagtttcccaccggttctctggagtgccagataggttcagtggcagcgggtcagggacagatttcacactgaaaatcagccgggtggaggctgaggatgttggggtttattactgcatgcaaagtatacagattccgtggacgttcggccaagggaccaaggtggaaatcaaa

SEQ ID NO: 26172 - protein, 112 aa, Artificial Sequence
  Description of Artificial Sequence: Synthetic polypeptide
AIVMTQTPLSLSVTPGQPASISCKSSQSLLHGDGKTYFYWYLQKPGQPPQLLIYEVSHRFSGVPDRFSGSGSGTDFTLKISRVEAEDVGVYYCMQSIQIPWTFGQGTKVEIK

SEQ ID NO: 26173 - DNA, 321 bp, Artificial Sequence
  Description of Artificial Sequence: Synthetic polynucleotide
gacatccagatgacccagtctccagcttccgtgtctgcatctgtaggagacagagtcaccataacttgtcgggcgagtcagggtattagcaactggttagcctggtatcagcagaaaccagggaaagcccctaagctcctgatctatgctgcatccagtttgcaaagtggggtcccatcaaggttcagcggcaatgaatctgggacagatttcactctctccatcagcagcctgcagcctgaagattttgcaacttactattgtcaacagactgacagtttcccattcactttcggccctgggaccaaagtggatgtcaaa

SEQ ID NO: 26174 - protein, 107 aa, Artificial Sequence
  Description of Artificial Sequence: Synthetic polypeptide
DIQMTQSPASVSASVGDRVTITCRASQGISNWLAWYQQKPGKAPKLLIYAASSLQSGVPSRFSGNESGTDFTLSISSLQPEDFATYYCQQTDSFPFTFGPGTKVDVK

SEQ ID NO: 26175 - DNA, 339 bp, Artificial Sequence
  Description of Artificial Sequence: Synthetic polynucleotide
gacatcgtgatgacccagtctccagactccctggctgtgtctctgggcgagagggccaccatccactgcaagtccagccaacgtgttttacacagctccaacaattataactacttagcttggtaccagcagaaaccaggacagcctcctaagctgctcatttactgggcatctacccgggattccggggtccctgaccgattcagtggcagcgggtctggggccgatttcactctcaccatcagcagcctgcaggctgaagatgtggcactttattactgtcagcaatattatagtactccattcactttcggccctgggaccaaagtggatatcaaa

SEQ ID NO: 26176 - protein, 113 aa, Artificial Sequence
  Description of Artificial Sequence: Synthetic polypeptide
DIVMTQSPDSLAVSLGERATIHCKSSQRVLHSSNNYNYLAWYQQKPGQPPKLLIYWASTRDSGVPDRFSGSGSGADFTLTISSLQAEDVALYYCQQYYSTPFTFGPGTKVDIK

SEQ ID NO: 26177 - DNA, 318 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattatcaactatttaaattggtatcagcagaaaccagggaaagcccctaaggtcctgatctatactgcatccagtttacagagtggggtcccatcaaggttcagtggcagtggatctgggacagatttcactctcaccatcagcagtctgcaacctgaagattttacaacttactactgtcaacagagttacagtacccccactttcggcggagggaccaaggtagagatcgaa

SEQ ID NO: 26178 - protein, 106 aa, Artificial Sequence
  Description of Artificial Sequence: Synthetic polypeptide
DIQMTQSPSSLSASVGDRVTITCRASQSIINYLNWYQQKPGKAPKVLIYTASSLQSGVPSRFSGSGSGTDFTLTISSLQPEDFTTYYCQQSYSTPTFGGGTKVEIE

SEQ ID NO: 26179 - DNA, 336 bp, Artificial Sequence
  Description of Artificial Sequence: Synthetic polynucleotide
gatattgtgatgacccagactccactctctctgtccgtcacccctggacagccggcctccatctcctgtaagtctagtcagagcctcctgcatagtgaaggaaagacctatttgtattggtacctgcagaagccaggccagcctccacagctcctgatctatgaagtttcctaccgggtctctggagtgccagatagattcagtggcagcgggtcagggacagatttcacactgaaaatcagccgggtggaggcagaggatgttggggtctatttctgcatgcaaagtatacagcttccgctcactttcggcggagggaccaaggtggagatcaaa

SEQ ID NO: 26180 - protein, 112 aa, Artificial Sequence
  Description of Artificial Sequence: Synthetic polypeptide
DIVMTQTPLSLSVTPGQPASISCKSSQSLLHSEGKTYLYWYLQKPGQPPQLLIYEVSYRVSGVPDRFSGSGSGTDFTLKISRVEAEDVGVYFCMQSIQLPLTFGGGTKVEIK

SEQ ID NO: 26181 - DNA, 321 bp, Artificial Sequence
  Description of Artificial Sequence: Synthetic polynucleotide
gacatccagatgacccagtctccatcctcactgtctgcatctgtaggagacagagtcagcatcacttgtcgggcgagtcagggcattagcaaatatttagcctggtttcagcagaaaccagggaaagcccctaagtccctgatctttgctgcatccagtttgcaaagtggggtcccatcaaagttcagcggcagtggatctgggacagatttcactctcaccatcagcagcctgcagcctgaagattttgcaacttattactgccaacagtataatagtttcccattcactttcggccctgggaccaaagtggatatcaaa

SEQ ID NO: 26182 - protein, 107 aa, Artificial Sequence
  Description of Artificial Sequence: Synthetic polypeptide
DIQMTQSPSSLSASVGDRVSITCRASQGISKYLAWFQQKPGKAPKSLIFAASSLQSGVPSKFSGSGSGTDFTLTISSLQPEDFATYYCQQYNSFPFTFGPGTKVDIK

SEQ ID NO: 26183 - DNA, 339 bp, Artificial Sequence
  Description of Artificial Sequence: Synthetic polynucleotide
gacatcgtgatgacccagtctctagactccctggctgtgtctctgggcgagagggccaccatcaactgcaagtccagccagagtgctttacacagctccaacaattacaactacttagcttggtaccagcagaaaccaggacagcctcctaaactgctcatttactgggcatctacccggaaatccggggtccctgaccgattcagtggcagcgggtctgggacagatttcactctcaccatcagcagcctgcaggctgaagatgtggcagtttattactgtcagcaatattatagtattcctccgacgttcggccaagggaccaaggtggaaatcaaa

SEQ ID NO: 26184 - protein, 113 aa, Artificial Sequence
  Description of Artificial Sequence: Synthetic polypeptide
DIVMTQSLDSLAVSLGERATINCKSSQSALHSSNNYNYLAWYQQKPGQPPKLLIYWASTRKSGVPDRFSGSGSGTDFTLTISSLQAEDVAVYYCQQYYSIPPTFGQGTKVEIK

SEQ ID NO: 26185 - DNA, 318 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagtaactatttaaattggtatcagcagaaaccagggaaagcccctaaggtcctgatctatattgcatccagtttgcaaagtggggtcccatctaggttcagtggcagtggatctgggacagatttcactctcaccatcagcagtctgcaacctgaagattttgcaacttactactgtcaacagagttacagtacccccactttcggcggagggaccaaggtggagatcaaa

SEQ ID NO: 26186 - protein, 106 aa, Artificial Sequence
  Description of Artificial Sequence: Synthetic polypeptide
DIQMTQSPSSLSASVGDRVTITCRASQSISNYLNWYQQKPGKAPKVLIYIASSLQSGVPSRFSGSGSGTDFTLTISSLQPEDFATYYCQQSYSTPTFGGGTKVEIK

SEQ ID NO: 26187 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatggtgatggaaagacctatttgtattggtacctgcagaggccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttccgtggacgttcggccaagggaccaaggtggaaatcaaa

SEQ ID NO: 26188 - protein, 112 aa, Artificial Sequence
  Description of Artificial Sequence: Synthetic polypeptide
DIVMTQTPLSLSVTPGQPASISCKSSQSLLHGDGKTYLYWYLQRPGQPPQLLIYEVSNRFSGVPDRFSGSGSGTDFTLKISRVEAEDVGVYYCMQSIQLPWTFGQGTKVEIK

SEQ ID NO: 26189 - DNA, 336 bp, Artificial Sequence
  Description of Artificial Sequence: Synthetic polynucleotide
gatattgtgatgacccagactccactctctctgtccgtcactcctggacagccggcctccatctcctgcaagtctagtcagagcctcctgcatagtgagggaaagacctatttgtattggtacctgcagaagccaggccagcctccacagctcctgatctatgaagtttcctaccgggtctctggagtgccagataggttcagtggcagcgggtcagggacagatttcacactgaaaatcagccgggtggaggcagaggatgttggggtctattactgcatgcagagtatacagcttccgctcactttcggcggagggaccaaggtggagatcaaa

SEQ ID NO: 26190 - protein, 112 aa, Artificial Sequence
  Description of Artificial Sequence: Synthetic polypeptide
DIVMTQTPLSLSVTPGQPASISCKSSQSLLHSEGKTYLYWYLQKPGQPPQLLIYEVSYRVSGVPDRFSGSGSGTDFTLKISRVEAEDVGVYYCMQSIQLPLTFGGGTKVEIK

SEQ ID NO: 26191 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctctgctgcatccagtttgcaaagtggggtcccatcaaggttcaccggcagtggatctgggacagaattcactttcacaatcagcagcgtgcagcctgaagattttgcaacttattactgtctacagcatcgtaattacccgctcactttcggcggagggaccaaggtggagatcaaa

SEQ ID NO: 26192 - protein, 107 aa, Artificial Sequence
  Description of Artificial Sequence: Synthetic polypeptide
DIQMTQSPSSLSASVGDRVTITCRASQGIRNDLGWYQQKPGKAPKRLISAASSLQSGVPSRFTGSGSGTEFTFTISSVQPEDFATYYCLQHRNYPLTFGGGTKVEIK

SEQ ID NO: 26193 - DNA, 321 bp, Artificial Sequence
  Description of Artificial Sequence: Synthetic polynucleotide
gacatccagatgacccagtctccttcctccctgtctgcatctgtaggagacagagtcaccatcacttgccgggcaagtcagggcattagaaatgccttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttatttctgtctacagcataatagttaccctctcattttcggcggagggaccaaggtggagatcaaa

SEQ ID NO: 26194 - protein, 107 aa, Artificial Sequence
  Description of Artificial Sequence: Synthetic polypeptide
DIQMTQSPSSLSASVGDRVTITCRASQGIRNALGWYQQKPGKAPKRLIYAASSLQSGVPSRFSGSGSGTEFTLTISSLQPEDFATYFCLQHNSYPLIFGGGTKVEIK

SEQ ID NO: 26195 - DNA, 336 bp, Artificial Sequence
  Description of Artificial Sequence: Synthetic polynucleotide
gatattgtgatgacccagtctccactctctctgttcgtcactcctggacagccggcctccatctcctacaagtctagtcagagcctcctgcatggtgatggaaagacctatttttattggtacctgcagaagccaggccagcctccacagctcttgatttatgaagtttcccaccggttctctggagtgccagataggttcagtggcagcgggtcagggacagatttcacactgaaaatcagccgggtggaggctgaggatgttggggtttattactgcatgcaaagtatacagattccgtggacgttcggccaagggaccaaggtggaaatcaaa

SEQ ID NO: 26196 - protein, 112 aa, Artificial Sequence
  Description of Artificial Sequence: Synthetic polypeptide
DIVMTQSPLSLFVTPGQPASISYKSSQSLLHGDGKTYFYWYLQKPGQPPQLLIYEVSHRFSGVPDRFSGSGSGTDFTLKISRVEAEDVGVYYCMQSIQIPWTFGQGTKVEIK

SEQ ID NO: 26197 - DNA, 321 bp, Artificial Sequence
  Description of Artificial Sequence: Synthetic polynucleotide
gacatccagatgacccagtctccatcctccctgtctgcatctgtaggagccagagtcaccatcacttgccgggcaagtcagggcattagaaatgatttaggctggtatcagcagaaaccagggaaagcccctaagcgcctgatctatgctgcatccaatttgcaaagtggggtcccatcaaggttcagtggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 26198 - protein, 107 aa, Artificial Sequence
  Description of Artificial Sequence: Synthetic polypeptide
DIQMTQSPSSLSASVGARVTITCRASQGIRNDLGWYQQKPGKAPKRLIYAASNLQSGVPSRFSGSGSGTEFTLTISSLQPEDFATYYCLQHNSYPLTFGGGTKVEIK

SEQ ID NO: 26199 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagtcccaacaataacaactacttagcttggtaccagcagaaaccaggacagccccctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtgcagttttggccaggggaccaaggtggagatcaaa

SEQ ID NO: 26200 - protein, 113 aa, Artificial Sequence
  Description of Artificial Sequence: Synthetic polypeptide
DIVMTQSPDSLAVSLGERATINCKSSQSVLYSPNNNNYLAWYQQKPGQPPKLLIYWASTRESGVPDRFSGSGSGTDFTLTISSLQAEDVAVYYCQQYYSTPCSFGQGTKVEIK

SEQ ID NO: 26201 - DNA, 318 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcagttatttaaattggtatcagcagaaaccagggaaagcccctaaggtcatgatctatactgcatccagtttgcaaagtggggtcccatcaaggttcagtggcagtggatctgggacagatttcactctcaccatcaacagtctgcaacctgaagattttgcaacttactactgtcaacagagttacagtatccccactttcggcggagggaccaaggtggagatcaaa

SEQ ID NO: 26202 - protein, 106 aa, Artificial Sequence
  Description of Artificial Sequence: Synthetic polypeptide
DIQMTQSPSSLSASVGDRVTITCRASQSISSYLNWYQQKPGKAPKVMIYTASSLQSGVPSRFSGSGSGTDFTLTINSLQPEDFATYYCQQSYSIPTFGGGTKVEIK

SEQ ID NO: 26203 - DNA, 339 bp, Artificial Sequence
  Description of Artificial Sequence: Synthetic polynucleotide
gacatcgtgatgacccagtctccagactccctggctgtgtctctgggcgagagggccaccatcagctgcaagtccagccagactgttttacacaactccaataatcacaattactttgcttggtaccagcagaaaccaggacagcctcctaagctgctcatttactgggcatctaccctgagatccggggtccctgaccgattcagtggcagcgggtctgggacagatttcactctcaccatcagcagcctgcaggctgaagatgtggcagtttattactgtcagcaatattatagtactcctccgacgttcggccaagggaccaaggtggaaatcaaa

SEQ ID NO: 26204 - protein, 113 aa, Artificial Sequence
  Description of Artificial Sequence: Synthetic polypeptide
DIVMTQSPDSLAVSLGERATISCKSSQTVLHNSNNHNYFAWYQQKPGQPPKLLIYWASTLRSGVPDRFSGSGSGTDFTLTISSLQAEDVAVYYCQQYYSTPPTFGQGTKVEIK

SEQ ID NO: 26205 - DNA, 339 bp, Artificial Sequence
  Description of Artificial Sequence: Synthetic polynucleotide
gacatcgtgatgacccagtctccagactccctggctgtatctctgggcgagagggccaccatcaactgcaagtccagccagagtgttttatccagctccaacgataacaactacttagcttggtaccaacagaaaccaggacggcctcctaagctgctcatttactggtcatctacccgggaatccggggtccctgaccgattcagtggcagcgggtctgggacagatttcactctcaccatcagcagcctgcaggctgaagatgtggcagtttattactgtcaccaatattatagttatcctccgacgttcggccaagggaccaaggtggaaatcaaa

SEQ ID NO: 26206 - protein, 113 aa, Artificial Sequence
  Description of Artificial Sequence: Synthetic polypeptide
DIVMTQSPDSLAVSLGERATINCKSSQSVLSSSNDNNYLAWYQQKPGRPPKLLIYWSSTRESGVPDRFSGSGSGTDFTLTISSLQAEDVAVYYCHQYYSYPPTFGQGTKVEIK

SEQ ID NO: 26207 - DNA, 321 bp, Artificial Sequence
  Description of Artificial Sequence: Synthetic polynucleotide
gacatccagatgacccagtctccttcctccctgtctgcatctgtaggagacagagtcaccatcacttgccgggcaagtcagggcattagaaatgccttaggctggtttcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctctcactttcggcggagggaccaaggtggagatcaaa

SEQ ID NO: 26208 - protein, 107 aa, Artificial Sequence
  Description of Artificial Sequence: Synthetic polypeptide
DIQMTQSPSSLSASVGDRVTITCRASQGIRNALGWFQQKPGKAPKRLIYAASSLQSGVPSRFSGSGSGTEFTLTISSLQPEDFATYYCLQHNSYPLTFGGGTKVEIK

SEQ ID NO: 26209 - DNA, 321 bp, Artificial Sequence
  Description of Artificial Sequence: Synthetic polynucleotide
gacatccagatgacccagtctccatcttccgtgtcggcatctgtaggagacagagtcaccatcacttgtcgggcgagtcagggtattatcagttggttagcctggtatcagcagaaaccaggaaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacagggtaacagtttcccattcactttcggccctgggaccaaagtggatatcaaa

SEQ ID NO: 26210 - protein, 107 aa, Artificial Sequence
  Description of Artificial Sequence: Synthetic polypeptide
DIQMTQSPSSVSASVGDRVTITCRASQGIISWLAWYQQKPGKAPKLLIYAASSLQSGVPSRFSGSGSGTDFTLTISSLQPEDFATYYCQQGNSFPFTFGPGTKVDIK

SEQ ID NO: 26211 - DNA, 321 bp, Artificial Sequence
  Description of Artificial Sequence: Synthetic polynucleotide
gacatccagatgacccagtctccagcttccgtgtctgcatctgtaggagacagagtcaccataacttgtcgggcgagtcagggtattagcaactggttagcctggtatcagcagaaaccagggagagcccctaagctcctgatctatgctgcatccagtttgcaaggtggggtcccatcaaggttcagcggcagtggatctgggacagattacactctctccatcagcagcctgcagcctgaagattttgcaacttactattgtcaacagactgacagtttcccattcactttcggccctgggaccaaagtggatatcaaa

SEQ ID NO: 26212 - protein, 107 aa, Artificial Sequence
  Description of Artificial Sequence: Synthetic polypeptide
DIQMTQSPASVSASVGDRVTITCRASQGISNWLAWYQQKPGRAPKLLIYAASSLQGGVPSRFSGSGSGTDYTLSISSLQPEDFATYYCQQTDSFPFTFGPGTKVDIK

SEQ ID NO: 26213 - DNA, 324 bp, Artificial Sequence
  Description of Artificial Sequence: Synthetic polynucleotide
gaaattgtgttgacgcagtctccaggcaccctgtctttgtttccaggggaaagagtcaccctctcctgcagggccagtcagagtattatcagcaactacttagcctggtaccagcagaaacctggccaggctcccaggctcctcatctttggtgtatctagtagggccactggcatcccagacaggttcagtggcagtgggtctgggacagacttcactctcaccatcagcagactggagcctgaagattttgcagtgtattactgtcaacaatatggtcggtcaccattcaatttcggccctgggaccaaagtggatatcaaa

SEQ ID NO: 26214 - protein, 108 aa, Artificial Sequence
  Description of Artificial Sequence: Synthetic polypeptide
EIVLTQSPGTLSLFPGERVTLSCRASQSIISNYLAWYQQKPGQAPRLLIFGVSSRATGIPDRFSGSGSGTDFTLTISRLEPEDFAVYYCQQYGRSPFNFGPGTKVDIK

SEQ ID NO: 26215 - DNA, 321 bp, Artificial Sequence
  Description of Artificial Sequence: Synthetic polynucleotide
gacatccagatgacccagtctccagcttccgtgtctgcatctgtaggagacagagtcaccataacttgtcgggcgagtcagggtattagcaactggttagcctggtatcagcagaaaccagggaaagcccctaagctcctgatctatgctgcatccagtttgcaaagtggggtcccatcaaggttcagcggcaatgaatctgggacagatttcactctctccatcagcagcctgcagcctgaagattttgcaatttactattgtcaacagactgacagtttcccattcactttcggccctgggaccaaagtggatgtcaaa

SEQ ID NO: 26216 - protein, 107 aa, Artificial Sequence
  Description of Artificial Sequence: Synthetic polypeptide
DIQMTQSPASVSASVGDRVTITCRASQGISNWLAWYQQKPGKAPKLLIYAASSLQSGVPSRFSGNESGTDFTLSISSLQPEDFAIYYCQQTDSFPFTFGPGTKVDVK

SEQ ID NO: 26217 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcggggcattagaaatgatttaggctggtatcagcagaaaccagggaaagcccctaagcgcctgatctatgctgcatccagtttgcagagtggggtcccatcaaggttcagcggcagtggatctgggacagaattcactctcacaatcagcagcctgcagcctgaagattttgcaacttattactgtctacagcattatagttatcctcggacgttcggccaagggaccaaggtggaaatcaaa

SEQ ID NO: 26218 - protein, 107 aa, Artificial Sequence
  Description of Artificial Sequence: Synthetic polypeptide
DIQMTQSPSSLSASVGDRVTITCRASRGIRNDLGWYQQKPGKAPKRLIYAASSLQSGVPSRFSGSGSGTEFTLTISSLQPEDFATYYCLQHYSYPRTFGQGTKVEIK

SEQ ID NO: 26219 - DNA, 321 bp, Artificial Sequence; identical to SEQ ID NO: 26167
  Description of Artificial Sequence: Synthetic polynucleotide

SEQ ID NO: 26220 - protein, 107 aa, Artificial Sequence; identical to SEQ ID NO: 26168
  Description of Artificial Sequence: Synthetic polypeptide

SEQ ID NO: 26221 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccaatttgcaaagtggggtcccatcaaggttcagcggcagtggatctgggacagaattcactctcacaatcagcagcctgcagcctgaagattttgcaatttattactgtctacagcataatagttacccgctcactttcggcggagggaccaaggtggagatcaaa

SEQ ID NO: 26222 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASNLQSGVPSRFSGSGSGTEFTLTISSLQPEDFAIYYCLQHNSYPLTFGGGTKVEIK

SEQ ID NO: 26223 - DNA, 339 bp, Artificial Sequence
  Description of Artificial Sequence: Synthetic polynucleotide
gacatcgtgatgacccagtctccagactccctggctgtgtctctgggcgagagggccaccatcaagtgcaagtccagccagagtgttttatacagatccaacagtaagaaatacttaacttggtaccagcagaaaccaggacagcctcctaagctgttcatttattgggcatctacccggaaatccggggtccctgaccgattcagtggcagcgggtctgggacagatttcactctcaccatcagcaacctgcaggctgaagatgtggcagtttatttctgtcagcaatattttagtactccgtacaattttggccaggggaccaagagggagatcaaa

SEQ ID NO: 26224 - protein, 113 aa, Artificial Sequence
  Description of Artificial Sequence: Synthetic polypeptide
DIVMTQSPDSLAVSLGERATIKCKSSQSVLYRSNSKKYLTWYQQKPGQPPKLFIYWASTRKSGVPDRFSGSGSGTDFTLTISNLQAEDVAVYFCQQYFSTPYNFGQGTKREIK

SEQ ID NO: 26225 - DNA, 321 bp, Artificial Sequence
  Description of Artificial Sequence: Synthetic polynucleotide
gacatccagatgacccagtctccatcctccctgtctgcatctgtgggagacagagtcaccatctcttgccgggcaagtcagggcattggaaatgatttaggctggtatcagcagaaaccagggaaagcccctacgcgcctgatctatgctgcatccagtttgcaaagtggggtcccatcaaggttcagcggcagtggatctgggacagaattcactctcactatcagcagcctgcagcctgcagattttgcaacttattactgtctacaacattatagtttcccgtacagttttggccaggggaccaagctggagatcaaa

SEQ ID NO: 26226 - protein, 107 aa, Artificial Sequence
  Description of Artificial Sequence: Synthetic polypeptide
DIQMTQSPSSLSASVGDRVTISCRASQGIGNDLGWYQQKPGKAPTRLIYAASSLQSGVPSRFSGSGSGTEFTLTISSLQPADFATYYCLQHYSFPYSFGQGTKLEIK

SEQ ID NO: 26227 - DNA, 321 bp, Artificial Sequence
  Description of Artificial Sequence: Synthetic polynucleotide
gacatccagatgacccagtctccaggttccgtgtctgcatctgtaggagacagagtcaccataacttgtcgggcgagtcagggtattaacaactggttagcctggtatcagcagaaaccagggaaagcccctaagctcctgatctatgctgcatccagtttgcaaggtggggtcccatcaaggttcagcggcagtggatctgggacagatttcactctctccatcagcagcctgcagcctgaagattttgcaacttactattgtcaacagactgacagtttcccattcactttcggccctgggaccaaagtggatatcaaa

SEQ ID NO: 26228 - protein, 107 aa, Artificial Sequence
  Description of Artificial Sequence: Synthetic polypeptide
DIQMTQSPGSVSASVGDRVTITCRASQGINNWLAWYQQKPGKAPKLLIYAASSLQGGVPSRFSGSGSGTDFTLSISSLQPEDFATYYCQQTDSFPFTFGPGTKVDIK

SEQ ID NO: 26229 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagaatgttttatacagctcccacaataacaactacttagcttggtaccagcagaaaccagggcagcctcctaaactactcatttactgggcatctacccggaaatccggggtccctgaccgattcagtggcagcgggtctgggacagatttcactctcaccatcaccagcctgcaggctgaagatgtggcagtttattactgtcagcaatattatagtactccattcactttcggccctgggaccaaagtggatatcaaa

SEQ ID NO: 26230 - protein, 113 aa, Artificial Sequence
  Description of Artificial Sequence: Synthetic polypeptide
DIVMTQSPDSLAVSLGERATINCKSSQNVLYSSHNNNYLAWYQQKPGQPPKLLIYWASTRKSGVPDRFSGSGSGTDFTLTITSLQAEDVAVYYCQQYYSTPFTFGPGTKVDIK

SEQ ID NO: 26231 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccaatttgcaaagtggggtcccattaaggttcagcggcagtggatctgggacagacttcactctcacaatcagcagcctgcagcctgaagattttgcagcttattactgtctacagcataatagttacccgctcactttcggcggagggaccaaggtggagatcaaa

SEQ ID NO: 26232 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASNLQSGVPLRFSGSGSGTDFTLTISSLQPEDFAAYYCLQHNSYPLTFGGGTKVEIK

SEQ ID NO: 26233 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagccattatttagcctggtttcagcagaaaccagggaaagcccctaagtccctgatctatgttgcatccagtttgcaaaatggggtcccatcaaggttcagcggcagtggatctgggacagatttcactctcaccatcagcagcctgcagcctgaagattttgcaacttattactgccaacagtataataattacccgctcactttcggcggagggaccaaggtggagatcaaa

SEQ ID NO: 26234 - protein, 107 aa, Artificial Sequence
  Description of Artificial Sequence: Synthetic polypeptide
DIQMTQSPSSLSASVGDRVTITCRASQGISHYLAWFQQKPGKAPKSLIYVASSLQNGVPSRFSGSGSGTDFTLTISSLQPEDFATYYCQQYNNYPLTFGGGTKVEIK

SEQ ID NO: 26235 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcgtgcatggtgatggaaagacctatttgtattggtacctgcagaggccaggccagcctccacagctcctgatctatgaagtttccaaccggttctctggagtgccagataggttcagtggcagcgggtcagggacagatttcacattgaaaatcagccgggtggaggctgaggatgttggggtttattactgcatgcaaagtatacagcttccgtggacgttcggccaagggaccaaggtggaaatcaaa

SEQ ID NO: 26236 - protein, 112 aa, Artificial Sequence
  Description of Artificial Sequence: Synthetic polypeptide
DIVMTQTPLSLSVTPGQPASISCKSSQSLVHGDGKTYLYWYLQRPGQPPQLLIYEVSNRFSGVPDRFSGSGSGTDFTLKISRVEAEDVGVYYCMQSIQLPWTFGQGTKVEIK

SEQ ID NO: 26237 - DNA, 318 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatactgcatccagtttgcaaagtggggtcccatcaaggttcagtggcagtggatctgggacagatttcactctcaccatcagcagtctgcaacctgaagattttgcaacttactactgtcaacagagttacagtatttacactttcggcggagggtccaaggtggagatcaaa

SEQ ID NO: 26238 - protein, 106 aa, Artificial Sequence
  Description of Artificial Sequence: Synthetic polypeptide
DIQMTQSPSSLSASVGDRVTITCRASQSISSYLNWYQQKPGKAPKLLIYTASSLQSGVPSRFSGSGSGTDFTLTISSLQPEDFATYYCQQSYSIYTFGGGSKVEIK

SEQ ID NO: 26239 - DNA, 336 bp, Artificial Sequence
  Description of Artificial Sequence: Synthetic polynucleotide
gatattgtgatgacccagactccactctctctgtccgtcactcctggacagccggcctccatctcctgcaagtctagtcagagcctcctgcatagtgagggaaagacctatttgtattggtacctgcagaagccaggccagcctccacagctcctgatctatgaagtttcctaccggttctctggagtgccagataggttcagtggcagcgggtcagggacagatttcacactgaaaatcagccgggtggaggctgaggatgttggggtttattactgcatgcaaggtatacagcttccgctcactttcggcggagggaccaaggtggagatcaaa

SEQ ID NO: 26240 - protein, 112 aa, Artificial Sequence
  Description of Artificial Sequence: Synthetic polypeptide
DIVMTQTPLSLSVTPGQPASISCKSSQSLLHSEGKTYLYWYLQKPGQPPQLLIYEVSYRFSGVPDRFSGSGSGTDFTLKISRVEAEDVGVYYCMQGIQLPLTFGGGTKVEIK

SEQ ID NO: 26241 - DNA, 318 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcgactatttaaattggtatcagcagaaaccagggaaagcccctaaggtcctgatctatactacatccagtttgcaaagtggggtcccatcaaggttcagtggcagtggatctgggacagatttcactctcaccatcagcagtctgcagcctgaagattttgcaacttactactgtcaacagagtttcagtacccccactttcggcggagggaccaaggtggagatcaaa

SEQ ID NO: 26242 - protein, 106 aa, Artificial Sequence
  Description of Artificial Sequence: Synthetic polypeptide
DIQMTQSPSSLSASVGDRVTITCRASQSISDYLNWYQQKPGKAPKVLIYTTSSLQSGVPSRFSGSGSGTDFTLTISSLQPEDFATYYCQQSFSTPTFGGGTKVEIK

SEQ ID NO: 26243 - DNA, 324 bp, Artificial Sequence
  Description of Artificial Sequence: Synthetic polynucleotide
gaaatggtgatgacgcagtctccagccaccctgtctgtgtctccaggggaaagagtcaccctctcctgcagggccagtcagagtattaacatcaatatagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgactggcctccgtggacgttcggccaagggaccaaggtggaaatcaaa

SEQ ID NO: 26244 - protein, 108 aa, Artificial Sequence
  Description of Artificial Sequence: Synthetic polypeptide
EMVMTQSPATLSVSPGERVTLSCRASQSININIAWYQQKPGQAPRLLIYGASTRATGIPARFSGSGSGTEFTLTISSLQSEDFAVYYCQQYNDWPPWTFGQGTKVEIK

SEQ ID NO: 26245 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagcgcctcctgcatggtgatggaaagacctatttgtattggtacctgcagaagccaggccagcctccacagctcctgctctatgaagtttccaaccggttctctggagtgccagataggttcagtggcagcgggtcagggacagatttcacactgaaaatcagccgggtggaggctgaggatgttggggtttattactgcatgcaaagtatacaggttccgtggacgttcggccaagggaccaaggtggaaatcaaa

SEQ ID NO: 26246 - protein, 112 aa, Artificial Sequence
  Description of Artificial Sequence: Synthetic polypeptide
DIVMTQTPLSLSVTPGQPASISCKSSQRLLHGDGKTYLYWYLQKPGQPPQLLLYEVSNRFSGVPDRFSGSGSGTDFTLKISRVEAEDVGVYYCMQSIQVPWTFGQGTKVEIK

SEQ ID NO: 26247 - DNA, 318 bp, Artificial Sequence
  Description of Artificial Sequence: Synthetic polynucleotide
gacatacagatgacccagtctccatcctccctgtctgcgtctgtaggagacagagtcaccatcacttgccgggcaagtcagagcattagcaactttttaaattggtatcagcagaaaccagggaaagcccctaaggtcctgatctatactgcatccagtttggaaagtggggtcccatcaaggttcagtggcagtgaatctgggacagatttcactctcaccatcagcagtctgcaacctgaagattttgcaacttactactgtcaacagagttacagtacccccactttcggcggagggaccagggtggagatcaaa

SEQ ID NO: 26248 - protein, 106 aa, Artificial Sequence
  Description of Artificial Sequence: Synthetic polypeptide
DIQMTQSPSSLSASVGDRVTITCRASQSISNFLNWYQQKPGKAPKVLIYTASSLESGVPSRFSGSESGTDFTLTISSLQPEDFATYYCQQSYSTPTFGGGTRVEIK

SEQ ID NO: 26249 - DNA, 321 bp, Artificial Sequence
  Description of Artificial Sequence: Synthetic polynucleotide
gacatccagatgacccagtctccatcctcactgtctgcttctgtaggagacagagtcaccatcacttgtcgggcgagtcagggcattagcaagtatttagcctggtttcagcagaaaccagggaaagcccctaagtctctgatctatgatgcatccaggttgcaaagtggggtcccatcaaagttcagcggcagtggatctgggacagatttcactctcaccatcagcagcctgcagccagaagattttgcaagttattactgccatcagtataaacattacccgatcaccttcggccaagggacacgactggagattaaa

SEQ ID NO: 26250 - protein, 107 aa, Artificial Sequence
  Description of Artificial Sequence: Synthetic polypeptide
DIQMTQSPSSLSASVGDRVTITCRASQGISKYLAWFQQKPGKAPKSLIYDASRLQSGVPSKFSGSGSGTDFTLTISSLQPEDFASYYCHQYKHYPITFGQGTRLEIK

SEQ ID NO: 26251 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatggtgatggaaagacctatttgtattggtacctacagaagccaggccagcctccacagctcctgatctatgaagtttcccaccggttctctggagtgccagataggttcagtggcagcgggtcagggacagatttcacactgaaaatcagccgggtggaggctgaggatgttggggtttattactgcatgcaaagtatacagattccgtggacgttcggccaagggaccaaggtggaaatcaaa

SEQ ID NO: 26252 - protein, 112 aa, Artificial Sequence
  Description of Artificial Sequence: Synthetic polypeptide
DIVMTQTPLSLSVTPGQPASISCKSSQSLLHGDGKTYLYWYLQKPGQPPQLLIYEVSHRFSGVPDRFSGSGSGTDFTLKISRVEAEDVGVYYCMQSIQIPWTFGQGTKVEIK

SEQ ID NO: 26253 - DNA, 318 bp, Artificial Sequence
  Description of Artificial Sequence: Synthetic polynucleotide
gacatccagatgaccctgtctccatcctccctgtctgcatctgtaggagacagagtcaccatcacttgccgggcaagtcagagcattagcgactatttaaattggtatcagctgaaaccagggaaagcccctaaggtcttgatctatactacatccagtttgcaaagtggggtcccatcaaggttcagtggcagtggatctgggacagatttcactctcaccatcagcagtctgcaacctgaagattttgcaacttacttctgtcaacagagttacagtacccccactttcggcggagggaccaaggtggagatcaaa

SEQ ID NO: 26254 - protein, 106 aa, Artificial Sequence
  Description of Artificial Sequence: Synthetic polypeptide
DIQMTLSPSSLSASVGDRVTITCRASQSISDYLNWYQLKPGKAPKVLIYTTSSLQSGVPSRFSGSGSGTDFTLTISSLQPEDFATYFCQQSYSTPTFGGGTKVEIK

SEQ ID NO: 26255 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttacacagctccaacaattacaactacttagtttggtaccagcagaaaccaggacagtctcctaagcggctcatttactgggcatctacccgggaatccggggtccctgaccgattcagtggcagcgggtctgggacagatttctctctcaccatcagcagcctgcaggctgaagatgtggcagtttattactgtcagcaatattacagtactccattcactttcggccctgggaccaaagtggatatcaaa

SEQ ID NO: 26256 - protein, 113 aa, Artificial Sequence
  Description of Artificial Sequence: Synthetic polypeptide
DIVMTQSPDSLAVSLGERATINCKSSQSVLHSSNNYNYLVWYQQKPGQSPKRLIYWASTRESGVPDRFSGSGSGTDFSLTISSLQAEDVAVYYCQQYYSTPFTFGPGTKVDIK

SEQ ID NO: 26257 - DNA, 339 bp, Artificial Sequence
  Description of Artificial Sequence: Synthetic polynucleotide
gacatcgtgatgacccagtctccagactccctggctgtgtctctgggcgagaaggccaccatcaactgcaagtccagccagagtgttttgcacagctccaacaattacaactacttaacttggtaccagcagaaaccaggacagcctcctaaactgctcatttactgggcatctacccggaaatccggggtccctgaccgattcagtggcagcgggtctgggacagatttcactctcaccatcagcagcctgcaggctgaagatgtggcagtttattactgtcagcaatattatagtactccgtgcagttttggccaggggaccaagctggagatcaaa

SEQ ID NO: 26258 - protein, 113 aa, Artificial Sequence
  Description of Artificial Sequence: Synthetic polypeptide
DIVMTQSPDSLAVSLGEKATINCKSSQSVLHSSNNYNYLTWYQQKPGQPPKLLIYWASTRKSGVPDRFSGSGSGTDFTLTISSLQAEDVAVYYCQQYYSTPCSFGQGTKLEIK

SEQ ID NO: 26259 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaattacaactacttagcttggtaccagcagaaaccagggcagcctcctaaactgctcatttactgggcatctacccggaaatccggggtccctgaccgattcagtggcagcgggtctgggacagatttcactctcaccgtcagcagcctgcaggctgaagatgtggcagtttattactgtcagcaatattttaatactcctcccactttcggccctgggaccaaagtggatatcaaa

SEQ ID NO: 26260 - protein, 113 aa, Artificial Sequence
  Description of Artificial Sequence: Synthetic polypeptide
DIVMTQSPDSLAVSLGERATINCKSSQSVLYSSNNYNYLAWYQQKPGQPPKLLIYWASTRKSGVPDRFSGSGSGTDFTLTVSSLQAEDVAVYYCQQYFNTPPTFGPGTKVDIK

SEQ ID NO: 26261 - DNA, 318 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcgactatttaaattggtatcagcaaaaaccagggaaagcccctaaggtcctgatctatactacatccagtttgcaaagtggggtcccatcaaggttcagtggcagtggatctgggacagatttcactctcaccatcagcagtctgcaacctgaagattttgcaacttacttctgtcaacagagttacagtacccccactttcggcggagggaccaaggtggagatcaaa

SEQ ID NO: 26262 - protein, 106 aa, Artificial Sequence
  Description of Artificial Sequence: Synthetic polypeptide
DIQMTQSPSSLSASVGDRVTITCRASQSISDYLNWYQQKPGKAPKVLIYTTSSLQSGVPSRFSGSGSGTDFTLTISSLQPEDFATYFCQQSYSTPTFGGGTKVEIK

SEQ ID NO: 26263 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctccggcatggtgatggaaagacctatttgacttggtacctacagaggccaggccagcctccacaggtcctgatccatgaaatttccaagcggttcactggagtgccagataggttcagtggcagcgggtcagggacagatttcacactgaacatcagccgggtggaggctgaggatgttggcttttattactgcatgcaaagtatacaggttccgtggacgttcggccaagggaccaaggtggaaatcaaa

SEQ ID NO: 26264 - protein, 112 aa, Artificial Sequence
  Description of Artificial Sequence: Synthetic polypeptide
DIVMTQTPLSLSVTPGQPASISCKSSQSLRHGDGKTYLTWYLQRPGQPPQVLIHEISKRFTGVPDRFSGSGSGTDFTLNISRVEAEDVGFYYCMQSIQVPWTFGQGTKVEIK

SEQ ID NO: 26265 - DNA, 324 bp, Artificial Sequence
  Description of Artificial Sequence: Synthetic polynucleotide
gaaattgtgttgacgcagtctccaggcaccctgtctttgtttccaggggaaagagccaccctctcctgcagggccagtcagagtgttatcagcagctacttagcctggtaccagcagaaacctggccaggctcccaggctcctcatctttggtgtatctagtagggccactggcatcccagacaggttcagtggcagtgggtctgggacagacttcactctcaccatcagcagactggagcctgaagattttgcagtgtattactgtcaacaatatggtaggtcaccattcaatttcggccctgggaccaaagtggatatcaaa

SEQ ID NO: 26266 - protein, 108 aa, Artificial Sequence
  Description of Artificial Sequence: Synthetic polypeptide
EIVLTQSPGTLSLFPGERATLSCRASQSVISSYLAWYQQKPGQAPRLLIFGVSSRATGIPDRFSGSGSGTDFTLTISRLEPEDFAVYYCQQYGRSPFNFGPGTKVDIK

SEQ ID NO: 26267 - DNA, 321 bp, Artificial Sequence
  Description of Artificial Sequence: Synthetic polynucleotide
gacatccagatgacccagtctccatcctccctgtctgcatctgttggagacagagtcaccatcacttgccgggcaagtcagggcattagaaatgatttaggctggtatcagcagaaaccagggaaagcccctaagcgcctgatctatgctacatccagtttgcaaagtggggtcccatcaaggttcagcggcagtggatctgggacagaattcactctcacaatcagcagcctacagcctgaagattttgcaacttattactgtctacagcattataatttcccgtacagttttggccaggggaccaagctggagatcaaa

SEQ ID NO: 26268 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYATSSLQSGVPSRFSGSGSGTEFTLTISSLQPEDFATYYCLQHYNFPYSFGQGTKLEIK

SEQ ID NO: 26269 - DNA, 321 bp, Artificial Sequence
  Description of Artificial Sequence: Synthetic polynucleotide
gacatccagatgacccagtctccagcttccgtgtctgcatctgtgggagacagagtcaccataacttgtcgggcgagtcaggatattagcaactggttagcctggtatcagcagaaaccagggaaagcccctaaactcctgatctatgctgcatccagtttgcaaggtggggtcccatcaaggttcagcggcagtggatctgggacagatttcactctctccatcagcaccctgcagcctgaagattttgcaacttactattgtcaacagactgacagtttcccattcactttcggccctgggaccaaagtggatatcaaa

SEQ ID NO: 26270 - protein, 107 aa, Artificial Sequence
  Description of Artificial Sequence: Synthetic polypeptide
DIQMTQSPASVSASVGDRVTITCRASQDISNWLAWYQQKPGKAPKLLIYAASSLQGGVPSRFSGSGSGTDFTLSISTLQPEDFATYYCQQTDSFPFTFGPGTKVDIK

SEQ ID NO: 26271 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcaccggcagtggatctgggacagaattcactttcacaatcagcagcctgcagcctgaagattttgcaacttattactgtctacagcatagtaattacccgctcactttcggcggagggaccaaggtggagatcaaa

SEQ ID NO: 26272 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFTGSGSGTEFTFTISSLQPEDFATYYCLQHSNYPLTFGGGTKVEIK

SEQ ID NO: 26273 - DNA, 336 bp, Artificial Sequence
  Description of Artificial Sequence: Synthetic polynucleotide
ggcatcgtgatgacccagtctccagactccctggctgtgtctctgggcgcgagggccaccatcgactgcaagtccagccagagtgttttatacagctccaacaataagaactacttagcttggtaccagcagaaaccaggacagcctcctaagttgctcatttactgggcatctacccgggaatccggggtccctgaccgattcagtggcagcggatctgggacagatttcactctcaccatctacagcctgcaggctgaagatgtggcagtttattactgtcagcaatattatcgtagtcctagttttggccaggggaccaagctggagatcaaa

SEQ ID NO: 26274 - protein, 112 aa, Artificial Sequence
  Description of Artificial Sequence: Synthetic polypeptide
GIVMTQSPDSLAVSLGARATIDCKSSQSVLYSSNNKNYLAWYQQKPGQPPKLLIYWASTRESGVPDRFSGSGSGTDFTLTIYSLQAEDVAVYYCQQYYRSPSFGQGTKLEIK

SEQ ID NO: 26275 - DNA, 321 bp, Artificial Sequence
  Description of Artificial Sequence: Synthetic polynucleotide
gacatccagatgacccagtctccagcttccgtgtctgcatctgtaggagacagagtcaccataacttgtcgggcgagtcagggtattagcaactggttagcctggtatcagcagaaaccagggaaagcccctaagctcctgatctctgctgcatccagtttgcaaagtggggtcccatcaaggttcagcggcaatgaatctgggacagatttcactctctccatcagcagcctgcagcctgaagattttgcaacttactattgtcaacagactgacagtttcccattcactttcggccctgggaccaaagtggatgtcaaa

SEQ ID NO: 26276 - protein, 107 aa, Artificial Sequence
  Description of Artificial Sequence: Synthetic polypeptide
DIQMTQSPASVSASVGDRVTITCRASQGISNWLAWYQQKPGKAPKLLISAASSLQSGVPSRFSGNESGTDFTLSISSLQPEDFATYYCQQTDSFPFTFGPGTKVDVK

SEQ ID NO: 26277 - DNA, 318 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcgactatttaaattggtatcagcagaaaccagggaaagcccctaaggtcctgatctatactacatccagtttgcaaagtggggtcccatcaaggttcagtggcagtggatctgggacagatttcactctcaccatcagcagtctgcaacctgaagattttgcaacttacttctgtcaacagagttacagtacccccactttcggcggagggaccaaggtggagatcaaa

SEQ ID NO: 26278 - protein, 106 aa, Artificial Sequence; identical to SEQ ID NO: 26262
  Description of Artificial Sequence: Synthetic polypeptide

SEQ ID NO: 26279 - DNA, 336 bp, Artificial Sequence
  Description of Artificial Sequence: Synthetic polynucleotide
gatattgtgatgacccaggctccactctctctgtccgtcacccctggacagccggcctccatctcctgcaagtctagtcagagcctcctgcatggtgatggaaagacctatttatattggtacctgcagaagccaggccagcctccacagatcctgatctatgaagtttccaaccggttctctggagtgccagataggttcagtggcagcgggtcagggacagatttcacactgaacatcagccgggtggaggctgaggattttgggttttattactgcatgcaaagtatacagattccgtggacgttcggccaagggaccaaggtggacatcaaa

SEQ ID NO: 26280 - protein, 112 aa, Artificial Sequence
  Description of Artificial Sequence: Synthetic polypeptide
DIVMTQAPLSLSVTPGQPASISCKSSQSLLHGDGKTYLYWYLQKPGQPPQILIYEVSNRFSGVPDRFSGSGSGTDFTLNISRVEAEDFGFYYCMQSIQIPWTFGQGTKVDIK

SEQ ID NO: 26281 - DNA, 339 bp, Artificial Sequence
  Description of Artificial Sequence: Synthetic polynucleotide
gccgtcgtgatgacccagtctccagactccctggctgtgtctctgggcgagagggccaccatcaactgcacgtccagccagagtattttacacagctccaataattacaactacttagcttggtaccagcagaaaccaggacagcctcctaaattgctcatttactgggcatctacccgggaatccggggtccctgaccgattcagtggcagcgggtctgggacagatttcactctcaccatcagcagcctgcaggctgaagatgtggcagtttattactgtcaacaatattatagtggtccgtgcagttttggccaggggaccaagctggagatcaaa

SEQ ID NO: 26282 - protein, 113 aa, Artificial Sequence
  Description of Artificial Sequence: Synthetic polypeptide
AVVMTQSPDSLAVSLGERATINCTSSQSILHSSNNYNYLAWYQQKPGQPPKLLIYWASTRESGVPDRFSGSGSGTDFTLTISSLQAEDVAVYYCQQYYSGPCSFGQGTKLEIK

SEQ ID NO: 26283 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggtcattagcaattatttagcctggtttcagcagaaaccagggaaagcccctaagtccctgatctctgctgcatccagtttgcgaagtggggtcccatcaaacttcagcggcagtggatctgggacagatttcactctcaccatcagcagcctgcagcctgaagattttgcaacttattactgccaacagtatcatagttacccattcactttcggccctgggaccaaagtggatttcaaa

SEQ ID NO: 26284 - protein, 107 aa, Artificial Sequence
  Description of Artificial Sequence: Synthetic polypeptide
DIQMTQSPSSLSASVGDRVTITCRASQVISNYLAWFQQKPGKAPKSLISAASSLRSGVPSNFSGSGSGTDFTLTISSLQPEDFATYYCQQYHSYPFTFGPGTKVDFK

SEQ ID NO: 26285 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctccggcatggtgatggaaagacctatttgacttggtacctacagaggccaggccagcctccacaggtcctgatccatgaagtttccaagcggttcactggagtgccagataggttcagtggcagcgggtcagggacagatttcacactgaacatcagccgggtggaggctgaggatgttgggttttattactgcatgcaaagtatacaggttccgtggacgttcggccaagggaccaaggtggaaatcaaa

SEQ ID NO: 26286 - protein, 112 aa, Artificial Sequence
  Description of Artificial Sequence: Synthetic polypeptide
DIVMTQTPLSLSVTPGQPASISCKSSQSLRHGDGKTYLTWYLQRPGQPPQVLIHEVSKRFTGVPDRFSGSGSGTDFTLNISRVEAEDVGFYYCMQSIQVPWTFGQGTKVEIK

SEQ ID NO: 26287 - DNA, 324 bp, Artificial Sequence
  Description of Artificial Sequence: Synthetic polynucleotide
gaaattgtgttgacgcagtctccaggcaccctgtctttgtttccaggggaaagagcccccctctcctgcagggccagtcagagtgttatcagcagctacttagcctggtaccagcagaaacctggccaggctcccaggctcctcatctttggtgtatctagtagggccactggcatcccagacaggttcagtggcagtgggtctgggacagacttcactctcaccatcagcagactggagcctgaagattttgcagtgtattactgtcaacaatatggtaggtcaccattcaatttcggccctgggaccaaagtggatatcaaa

SEQ ID NO: 26288 - protein, 108 aa, Artificial Sequence
  Description of Artificial Sequence: Synthetic polypeptide
EIVLTQSPGTLSLFPGERAPLSCRASQSVISSYLAWYQQKPGQAPRLLIFGVSSRATGIPDRFSGSGSGTDFTLTISRLEPEDFAVYYCQQYGRSPFNFGPGTKVDIK

SEQ ID NO: 26289 - DNA, 336 bp, Artificial Sequence
  Description of Artificial Sequence: Synthetic polynucleotide
ggcatcgtgatgacccagtttccagattccctggctgtgtctctgggcgagagggccaccatcaactgcaagtccagccagagtgttttatacagctccaacaataagaactacttagcttggtaccagcagaaaccaggacagcctcataagttgctcatttactgggcatctacccgggaatttggggtccctgaccgattcagtggcagcgggtgtgggacagatttcactctcaccatctacagcgtgcaggctgaagatgtggcagtttattactgtcagcaatataatcgtagtcttagttttggccaggggaccaagctggagatcaaa

SEQ ID NO: 26290 - protein, 112 aa, Artificial Sequence
  Description of Artificial Sequence: Synthetic polypeptide
GIVMTQFPDSLAVSLGERATINCKSSQSVLYSSNNKNYLAWYQQKPGQPHKLLIYWASTREFGVPDRFSGSGCGTDFTLTIYSVQAEDVAVYYCQQYNRSLSFGQGTKLEIK

SEQ ID NO: 26291 - DNA, 336 bp, Artificial Sequence
  Description of Artificial Sequence: Synthetic polynucleotide
gatattgtgatgacccagactcccttctctctgtccgtcacccctggacagccggcctccatctcctgcaagtctagtcagagcctcctgcatagtgatggaaagacctatttgtattggtacctgcagaagccaggccagcctccacagttcctgatctatgaagtttccaaccggttctctggagtgccagataggttcagtggcagcgggtcagggacagatttcacactgaaaatcagccgggtggaggctgacgatgttggggtttattactgcatgcaaaatataaagtatccgctcactttcggcggagggaccaaggtggagatcaaa

SEQ ID NO: 26292 - protein, 112 aa, Artificial Sequence
  Description of Artificial Sequence: Synthetic polypeptide
DIVMTQTPFSLSVTPGQPASISCKSSQSLLHSDGKTYLYWYLQKPGQPPQFLIYEVSNRFSGVPDRFSGSGSGTDFTLKISRVEADDVGVYYCMQNIKYPLTFGGGTKVEIK

SEQ ID NO: 26293 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaattacaagtacttagcttggtaccagcagaaaccaggacagcctcctaacctgctcatttactgggcatctacccggaaatccggggtccctgaccgattcagtggcagcgggtctgggacagatttcactctcaccatcagcagcctgcaggctgaagatgtggcagtttattactgtcagcaatattatagtactccgtgcagttttggccaggggaccaagctggagatcaaa

SEQ ID NO: 26294 - protein, 113 aa, Artificial Sequence
  Description of Artificial Sequence: Synthetic polypeptide
DIVMTQSPDSLAVSLGERATINCKSSQSVLYSSNNYKYLAWYQQKPGQPPNLLIYWASTRKSGVPDRFSGSGSGTDFTLTISSLQAEDVAVYYCQQYYSTPCSFGQGTKLEIK

SEQ ID NO: 26295 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttacacagttccaacaattacaactatttagcttggtaccagcagaaaccaggacagcctcctaagctgctcatttactggacatctacccggaaatccggggtccctgaccgattcagtggcagcgggtctgggacacatttcactctctccatcagcagcctgcaggctgaagatgtggcagtttattactgtcagcattattatagtactccgtgcagttttggccaggggaccaagctggagatcaaa

SEQ ID NO: 26296 - protein, 113 aa, Artificial Sequence
  Description of Artificial Sequence: Synthetic polypeptide
DIVMTQSPDSLAVSLGERATINCKSSQSVLHSSNNYNYLAWYQQKPGQPPKLLIYWTSTRKSGVPDRFSGSGSGTHFTLSISSLQAEDVAVYYCQHYYSTPCSFGQGTKLEIK

SEQ ID NO: 26297 - DNA, 321 bp, Artificial Sequence
  Description of Artificial Sequence: Synthetic polynucleotide
gacattcagatgaccctgtctccatcctccgtgtatgcatctgtcggagacagagtcaccatcacttgtcgggcgagtcaggatattagcaactggttagcctggtatcagcagagaccagggaaagcccctaaggtccttatctatgctgcatccagtttgcaaagtggggtcccatcaagattcagcggcagtggatctgggacagatttcactctcaccatcagcagcgtgcagcctgaagattttgcaacttactattgtcaacagggtaacagtttcccgctcactttcggcggagggaccaaggtggacatcaaa

SEQ ID NO: 26298 - protein, 107 aa, Artificial Sequence
  Description of Artificial Sequence: Synthetic polypeptide
DIQMTLSPSSVYASVGDRVTITCRASQDISNWLAWYQQRPGKAPKVLIYAASSLQSGVPSRFSGSGSGTDFTLTISSVQPEDFATYYCQQGNSFPLTFGGGTKVDIK

SEQ ID NO: 26299 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaggtcaagccagagtgttttacacagctccaacaattataactacttagcttggtaccagcagaaaccaggacagcctcctaagctgctcatttactgggcatctaaacgggattccggggtccctgaccgattcagtggcagcgggtctgggacagatttcactctcaccatcagcagcctgcaggctgaggatgtggcagtttattactgtcagcaatattttagttctcctcggacgttcggccaagggaccaaggtggaaatcaag

SEQ ID NO: 26300 - protein, 113 aa, Artificial Sequence
  Description of Artificial Sequence: Synthetic polypeptide
DIVMTQSPDSLAVSLGERATINCRSSQSVLHSSNNYNYLAWYQQKPGQPPKLLIYWASKRDSGVPDRFSGSGSGTDFTLTISSLQAEDVAVYYCQQYFSSPRTFGQGTKVEIK

SEQ ID NO: 26301 - DNA, 321 bp, Artificial Sequence
  Description of Artificial Sequence: Synthetic polynucleotide
gacatccagatgacccagtctccagcttccgtgtctgcatctgtaggagacagagtcaccataacttgtcgggcgagtcagggtattagcaactggttagcctggtatcaccagaaaccagggaaagcccctaagctcctgatctatgctgcatccagtttgcaaggtggggtcccatcaaggttcagcggcagtggatctgggacagatttcactctctccatcagcagcctgcagcctgaagattttgcaacttactattgtcaccagactgacagtttcccattcactttcggccctgggaccaaagtggatatcaaa

SEQ ID NO: 26302 - protein, 107 aa, Artificial Sequence
  Description of Artificial Sequence: Synthetic polypeptide
DIQMTQSPASVSASVGDRVTITCRASQGISNWLAWYHQKPGKAPKLLIYAASSLQGGVPSRFSGSGSGTDFTLSISSLQPEDFATYYCHQTDSFPFTFGPGTKVDIK

SEQ ID NO: 26303 - DNA, 321 bp, Artificial Sequence
  Description of Artificial Sequence: Synthetic polynucleotide
gacatccagatgacccagtctccagcttccgtgtctgcatctgtaggagacagagtcaccataacttgtcgggcgagtcaggatattagcaactggttagcctggtatcagcagaaaccagggaaagcccctaagctcctgatctatgctgcatccagtttgcaaggtggggtcccatcaaggttcaacggcagtggatctgggacagatttcactctctccatcagcagcctgcagcctgaagattttgcaacttactattgtcaccagactgacagtttcccattcactttcggccctgggaccaaagtggatatcaaa

SEQ ID NO: 26304 - protein, 107 aa, Artificial Sequence
  Description of Artificial Sequence: Synthetic polypeptide
DIQMTQSPASVSASVGDRVTITCRASQDISNWLAWYQQKPGKAPKLLIYAASSLQGGVPSRFNGSGSGTDFTLSISSLQPEDFATYYCHQTDSFPFTFGPGTKVDIK

SEQ ID NO: 26305 - DNA, 318 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcagctatttaaattggtatcagcagaaaccagggaaagcccctaaggtcctgatctttactgcatccagtttgcaaagtggggtcccatcaagattcagtggcagtggatctgggacagatttcactctcaccatcagcagtctgcaacctgaagattttgcaacttactactgtcaacagagttacagtacccccactttcggcggagggaccagggtggagatcaaa

SEQ ID NO: 26306 - protein, 106 aa, Artificial Sequence
  Description of Artificial Sequence: Synthetic polypeptide
DIQMTQSPSSLSASVGDRVTITCRASQSISSYLNWYQQKPGKAPKVLIFTASSLQSGVPSRFSGSGSGTDFTLTISSLQPEDFATYYCQQSYSTPTFGGGTRVEIK

SEQ ID NO: 26307 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatggtgatggaaagacctatttgtattggtacctgcagaagccaggccagcctccacagctcctgatttatgaagtttccaatcggttctctggagtgccagataggttcagtggcagcggttcagggacagatttcacactgaaaatcagccgggtggaggctgaggatgttggattttattactgcatgcaaagtatacaggttccgtggacgttcggccaagggaccaaggtggaaatcaaa

SEQ ID NO: 26308 - protein, 112 aa, Artificial Sequence
  Description of Artificial Sequence: Synthetic polypeptide
DIVMTQTPLSLSVTPGQPASISCKSSQSLLHGDGKTYLYWYLQKPGQPPQLLIYEVSNRFSGVPDRFSGSGSGTDFTLKISRVEAEDVGFYYCMQSIQVPWTFGQGTKVEIK

SEQ ID NO: 26309 - DNA, 339 bp, Artificial Sequence
  Description of Artificial Sequence: Synthetic polynucleotide
gacatcgtgatgacccagtctccagactccctggctgtgtctctgggcgagcgggccaccatcaactgcaagtccagccagagtgttttatccagctccaacaataataattatttagcttggtaccagcagaaaccaggacagcctcctaagctgctcatttactgggcatctacccggaaatccggggtccctgaccgattcagtggcagcgggtctgggacagatttcactctcaccatcagcagcctgcaggctgaagatgtggcagtttattactgtcagcaatattatagtactccgtgcagttttggccaggggaccaagctggagatcaag

SEQ ID NO: 26310 - protein, 113 aa, Artificial Sequence
  Description of Artificial Sequence: Synthetic polypeptide
DIVMTQSPDSLAVSLGERATINCKSSQSVLSSSNNNNYLAWYQQKPGQPPKLLIYWASTRKSGVPDRFSGSGSGTDFTLTISSLQAEDVAVYYCQQYYSTPCSFGQGTKLEIK

SEQ ID NO: 26311 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttacacagctccaataattacaactacttagcttggtaccagcagaaaccaggacagccccctaaactgctcatttactggacatctacccgggaatccggggtccctgaccgattcagtggcagcgggtctgggacagatttcactctcaccatcagcagcctgcaggctgaagatgtggcagtttattactgtcaacaatattatagtactccgtgcagttttggccaggggaccaagttggagatcaaa

SEQ ID NO: 26312 - protein, 113 aa, Artificial Sequence
  Description of Artificial Sequence: Synthetic polypeptide
DIVMTQSPDSLAVSLGERATINCKSSQSVLHSSNNYNYLAWYQQKPGQPPKLLIYWTSTRESGVPDRFSGSGSGTDFTLTISSLQAEDVAVYYCQQYYSTPCSFGQGTKLEIK

SEQ ID NO: 26313 - DNA, 324 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagtagtaacttagcctggtaccagcagaaacctggccaggctcccagactcctcatctatggtgcatccaccagggccactggtatcccagccaggttcagtggcagtgggtctgggacagagttcactctcaccatcagcagcctgcagtctgaagattttgcagtttattactgtcagcagtatgatgactggcctccgtggacgttcggccaagggaccaaggtggaaatcaaa

SEQ ID NO: 26314 - protein, 108 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYDDWPPWTFGQGTKVEIK

SEQ ID NO: 26315 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactttcacaatcagcagcctgcagcctgaagattttgcaacttattactgtctacagcatagtaattacccgctcactttcggcggagggaccaaggtggagatcaaa

SEQ ID NO: 26316 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTFTISSLQPEDFATYYCLQHSNYPLTFGGGTKVEIK

SEQ ID NO: 26317 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaataacaactacttagcttggtaccagcagaaaccaggacagcctcctaagctgctcatttactgggcatctacccgggaatccggggtccctgcccgattcagtggcagcgggtctgggacagatttcactctcaccatcagcagcctgcaggctgaagatgtggcagtttattactgtcaccaatattatagtactccgtgcagttttggccaggggaccaagctggagatcaaa

SEQ ID NO: 26318 - protein, 113 aa, Artificial Sequence
  Description of Artificial Sequence: Synthetic polypeptide
DIVMTQSPDSLAVSLGERATINCKSSQSVLYSSNNNNYLAWYQQKPGQPPKLLIYWASTRESGVPARFSGSGSGTDFTLTISSLQAEDVAVYYCHQYYSTPCSFGQGTKLEIK

SEQ ID NO: 26319 - DNA, 318 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcagctatttaaattggtatcagcagaaaccagggaaagcccctaaggtcctgatctatactgcatccagtttgcaaagtggggtcccatcaaggttcagtggcagtggatctgggacagatttcactctcaccatcagcagtctgcaacctgaagattttgcaacttactactgtcaacagagttacagtgcccccactttcggcggagggaccaaggtggagatcaaa

SEQ ID NO: 26320 - protein, 106 aa, Artificial Sequence
  Description of Artificial Sequence: Synthetic polypeptide
DIQMTQSPSSLSASVGDRVTITCRASQSISSYLNWYQQKPGKAPKVLIYTASSLQSGVPSRFSGSGSGTDFTLTISSLQPEDFATYYCQQSYSAPTFGGGTKVEIK

SEQ ID NO: 26321 - DNA, 321 bp, Artificial Sequence
  Description of Artificial Sequence: Synthetic polynucleotide
gacatccagatgacccagtctccatcctcactgtctgcatctataggagacagaatcaccctcacttgtcgggcgagtcagggcattagcaattatttagcctggtttcagcagagaccagggaaagcccctaagtccctgatctatgctgcatccagtttgctaagtggggtcccatcaaagttcagcggcagtggatctgggacagatttcactctcaccatcagcagcctgcagcctgaagattttgcaacttattactgccaacagtataatagttttccattcactttcggcggagggaccaaggtggagctcaaa

SEQ ID NO: 26322 - protein, 107 aa, Artificial Sequence
  Description of Artificial Sequence: Synthetic polypeptide
DIQMTQSPSSLSASIGDRITLTCRASQGISNYLAWFQQRPGKAPKSLIYAASSLLSGVPSKFSGSGSGTDFTLTISSLQPEDFATYYCQQYNSFPFTFGGGTKVELK

SEQ ID NO: 26323 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattagcaattatttagtctggtttcagcagagaccagggaaagcccctaggtccctgatctatgctgcatccagtttgcaaagtggggtcccatctaagttcagcggcagtggatctgggacagatttcactctcaccatcagcagcctgcagcctgaagattttgcaacttattactgccaacaatatcatagttacccattcactttcggccctgggaccaaagtggatatcaaa

SEQ ID NO: 26324 - protein, 107 aa, Artificial Sequence
  Description of Artificial Sequence: Synthetic polypeptide
DIQMTQSPSSLSASVGDRVTITCRASQDISNYLVWFQQRPGKAPRSLIYAASSLQSGVPSKFSGSGSGTDFTLTISSLQPEDFATYYCQQYHSYPFTFGPGTKVDIK

SEQ ID NO: 26325 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctcatctatgctgcatccagtttgcaaagtggggtcccatcaaggttcagcggcagtggatctgggacagacttcactctcacaatcagcagcctgcagcctgatgactttgcaacttattactgtctacagcataatagttacccattcactttcggccctgggaccaaagtggatatcaaa

SEQ ID NO: 26326 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTDFTLTISSLQPDDFATYYCLQHNSYPFTFGPGTKVDIK

SEQ ID NO: 26327 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagaacattagcagttatttaaattggtatcagctgaaaccagggaaagcccctaaactcctgatctatactgcatccagtttgcaaagtggggtcccatcaaggttcagtggcagtggatctgggacagatttcactctcaccatcagcagtctgcaacctgaggattttgcaacttactactgtcaacagagttacaatacccccacgtggacgttcggccaagggaccaaggtggaaatcaaa

SEQ ID NO: 26328 - protein, 108 aa, Artificial Sequence
  Description of Artificial Sequence: Synthetic polypeptide
DIQMTQSPSSLSASVGDRVTITCRASQNISSYLNWYQLKPGKAPKLLIYTASSLQSGVPSRFSGSGSGTDFTLTISSLQPEDFATYYCQQSYNTPTWTFGQGTKVEIK

SEQ ID NO: 26329 - DNA, 321 bp, Artificial Sequence
  Description of Artificial Sequence: Synthetic polynucleotide
gacatccagatgacccagtctccatcctcactgtctgcatctgtaggagacagagtcaccttcacttgtcgggcgagtcagggcattagcaattatttagcctggtttcagcagaaaccagggagagcccctaagtccctgatctatgctgcatccagtttgcgaagtggggtcccatcacagttcagcggcagtggatctgggacagatttcactctcaccatcaacagcctgcagcctgaagattttgcaacttattactgccaacagtatcatagttatccattcactttcggccctgggaccaaagtggatatcaaa

SEQ ID NO: 26330 - protein, 107 aa, Artificial Sequence
  Description of Artificial Sequence: Synthetic polypeptide
DIQMTQSPSSLSASVGDRVTFTCRASQGISNYLAWFQQKPGRAPKSLIYAASSLRSGVPSQFSGSGSGTDFTLTINSLQPEDFATYYCQQYHSYPFTFGPGTKVDIK

SEQ ID NO: 26331 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatcctgcatccagtttacaaactggggtcccatcaaggttcagcggcagtggatctgggacagaattcactctcacaatcagcagcctgcagcctgaagattttgcaacttattactgtctacaggataatagttacccattcactttcggccctgggaccaaagtggatatcaaa

SEQ ID NO: 26332 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYPASSLQTGVPSRFSGSGSGTEFTLTISSLQPEDFATYYCLQDNSYPFTFGPGTKVDIK

SEQ ID NO: 26333 - DNA, 321 bp, Artificial Sequence
  Description of Artificial Sequence: Synthetic polynucleotide
gacatccagatgacccagtctccatcctcactgtctgcatctgtaggggacagagtcaccatcacttgtcgggcgagtcagggcattaacaattatttagcctggtttcagcagaaaccagggaaagcccctgagtccctgatctatgctgcatccagtttacaaagtggggtcccatcacagttcagcggcagtggatctgggacagatttcactctcaccatcagcagcctgcagcctgaagattttgcaacttattactgccaacagtataatagttatccattcactttcggccctgggaccaaagtggatatcaaa

SEQ ID NO: 26334 - protein, 107 aa, Artificial Sequence
  Description of Artificial Sequence: Synthetic polypeptide
DIQMTQSPSSLSASVGDRVTITCRASQGINNYLAWFQQKPGKAPESLIYAASSLQSGVPSQFSGSGSGTDFTLTISSLQPEDFATYYCQQYNSYPFTFGPGTKVDIK

SEQ ID NO: 26335 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagctttagcagctatttaaattggtatcagcagaaaccagggatagcccctaaactcctgatctatgctgcatccagtttgcaaagtggggtcccatcaaggttcagtggcagtggatctgggacagatttcactctcaccatcagcagtctgcaacctgaagattttgcaacttactactgtcaagagagttatagtatccgcttcgccttcggccaagggacacgactggagattaaa

SEQ ID NO: 26336 - protein, 107 aa, Artificial Sequence
  Description of Artificial Sequence: Synthetic polypeptide
DIQMTQSPSSLSASVGDRVTITCRASQSFSSYLNWYQQKPGIAPKLLIYAASSLQSGVPSRFSGSGSGTDFTLTISSLQPEDFATYYCQESYSIRFAFGQGTRLEIK

SEQ ID NO: 26337 - DNA, 321 bp, Artificial Sequence
  Description of Artificial Sequence: Synthetic polynucleotide
gacattcagatgactcagtctccatcctccctgtgtgcatcagtaggagacagagtcaccatcacttgccgggcaagtcagggcattagaaatgatttaggctggtatcagcagaaaccagggaaagcccctaagcgcttgatcaatgttgcatccagtttgcaaagtggggtcccatcaaggttcagcggcagtggatctgggacagaattcactctcacaatcagcagcgtgcagcgtgaagattttgcaacttattactgtatacaggataatagtcacccattcactttcggccctgggaccaaagtggaaatcaaa

SEQ ID NO: 26338 - protein, 107 aa, Artificial Sequence
  Description of Artificial Sequence: Synthetic polypeptide
DIQMTQSPSSLCASVGDRVTITCRASQGIRNDLGWYQQKPGKAPKRLINVASSLQSGVPSRFSGSGSGTEFTLTISSVQREDFATYYCIQDNSHPFTFGPGTKVEIK

SEQ ID NO: 26339 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattagcaattttttagcctggtttcagcagaaaccagggaaagcccctaagtccctggtctctactgcatccagtttgcaaagtggggtcccatcaaagttcagcggcagtggatctgggacagatttcactctcaccatcagcagcctgcagcctgaagattttgcaacttattactgccaacagtatcatagttacccgatcaccttcggccaagggacacgactggagattaaa

SEQ ID NO: 26340 - protein, 107 aa, Artificial Sequence
  Description of Artificial Sequence: Synthetic polypeptide
DIQMTQSPSSLSASVGDRVTITCRASQDISNFLAWFQQKPGKAPKSLVSTASSLQSGVPSKFSGSGSGTDFTLTISSLQPEDFATYYCQQYHSYPITFGQGTRLEIK

SEQ ID NO: 26341 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatggtgatggaaagacctatttatattggtacctgcagaagccaggccagtctccacaactcctgatctatgaaatttccaagcggttctctggagtgccagataggttcagtggcagcgggtcagggacagatttcacactgaaaatcagccgggtggaggctgaggatgttggggtttactactgcatgcaaagtatacaggttccgtggacgttcggccaagggaccaaggtggaaatcaaa

SEQ ID NO: 26342 - protein, 112 aa, Artificial Sequence
  Description of Artificial Sequence: Synthetic polypeptide
DIVMTQTPLSLSVTPGQPASISCKSSQSLLHGDGKTYLYWYLQKPGQSPQLLIYEISKRFSGVPDRFSGSGSGTDFTLKISRVEAEDVGVYYCMQSIQVPWTFGQGTKVEIK

SEQ ID NO: 26343 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagacttcactctcacaatcagcagcctgcagcctgatgactttgcaacttattactgtctacagcataatagttacccattcactttcggccctgggaccaaagtggatatcaaa

SEQ ID NO: 26344 - protein, 107 aa, Artificial Sequence; identical to SEQ ID NO: 26326
  Description of Artificial Sequence: Synthetic polypeptide

SEQ ID NO: 26345 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattaccaattatttagcctggtttcagcagaaaccagggaaagcccctaagtccctgatctatactgcatccaatttgcaaagtggggtcccatcaaagttcagcggcagtggatctgggacagatttcactctcaccatcagcagcctgcagcctgaagattttgcaacttattactgccaacagtatcatagttacccattcactttcggccctgggaccaaagtggatatcaaa

SEQ ID NO: 26346 - protein, 107 aa, Artificial Sequence
  Description of Artificial Sequence: Synthetic polypeptide
DIQMTQSPSSLSASVGDRVTITCRASQGITNYLAWFQQKPGKAPKSLIYTASNLQSGVPSKFSGSGSGTDFTLTISSLQPEDFATYYCQQYHSYPFTFGPGTKVDIK

SEQ ID NO: 26347 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgattttggctggtatcagcagagaccagggaaagcccctaagtgcctgattcatgctgcatccagtttacagagtggggtcccatcaaggttcagcggcagtggatctgggacagaattcactctcacaatcagcagcctgcagcctgaagattttgcaacttattactgtctacagcattatagttacccattcactttcggccctgggaccaaagtggatatcaaa

SEQ ID NO: 26348 - protein, 107 aa, Artificial Sequence
  Description of Artificial Sequence: Synthetic polypeptide
DIQMTQSPSSLSASVGDRVTITCRASQGIRNDFGWYQQRPGKAPKCLIHAASSLQSGVPSRFSGSGSGTEFTLTISSLQPEDFATYYCLQHYSYPFTFGPGTKVDIK

SEQ ID NO: 26349 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatactgcatccaatttgcaaagtggggtcccatcaaggttcagcggcagtggatgtgggacagaattcactctcacagtcagcagcctgcagcctgaagattttgcaacttattactgtctacagcataatagttacccgtggacgttcggccaagggaccaaggtggaaatcaaa

SEQ ID NO: 26350 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASNLQSGVPSRFSGSGCGTEFTLTVSSLQPEDFATYYCLQHNSYPWTFGQGTKVEIK

SEQ ID NO: 26351 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaaggatttaggctggtatcagcagaaaccagggaaagcccctaagcgcctgatctatgctgcatccagtttgcaaagtggggtcccatcaaggttcagcggcagtggatctgggacagaattcactctcacattcagcagcctgcagcctgaagattttgcaacttattactgtctacagcattatagttaccctcggacgttcggccaagggaccaaggtggaaatcaaa

SEQ ID NO: 26352 - protein, 107 aa, Artificial Sequence
  Description of Artificial Sequence: Synthetic polypeptide
DIQMTQSPSSLSASVGDRVTITCRASQDIRKDLGWYQQKPGKAPKRLIYAASSLQSGVPSRFSGSGSGTEFTLTFSSLQPEDFATYYCLQHYSYPRTFGQGTKVEIK

SEQ ID NO: 26353 - DNA, 321 bp, Artificial Sequence
  Description of Artificial Sequence: Synthetic polynucleotide
gacatccagatgacccagtctccatcctccctgcctgcatctgtaggagacagagtcaccatcacttgccgggcaagtcagaacattagaaagtatttacattggtatcagttcttaccagggaaagcccctaagctcctgatctatactgcatccactttacaaagtggggtcccatcaaggttcagtggcagcggatctgggacagatttcactctcaccatcagcagtctgcaacctgaagatttcgcaacttactactgtcaacagagttacaatatttcattcactttcggccctgggaccaaagtggatatcaaa

SEQ ID NO: 26354 - protein, 107 aa, Artificial Sequence
  Description of Artificial Sequence: Synthetic polypeptide
DIQMTQSPSSLPASVGDRVTITCRASQNIRKYLHWYQFLPGKAPKLLIYTASTLQSGVPSRFSGSGSGTDFTLTISSLQPEDFATYYCQQSYNISFTFGPGTKVDIK

SEQ ID NO: 26355 - DNA, 321 bp, Artificial Sequence
  Description of Artificial Sequence: Synthetic polynucleotide
gacattcagatgacccagtctccatcctccctgtctgcatctgtaggagacagagtcaccatcacttgccgggcaagtcagggcattagaaatgatttaggctggtatcagcagaaaccagggaaagcccctaagcgcctgatcaatgctgcatccagtttgcaaagtggggtcccatcaaggttcagcggcagtggatctgggacagaattcactctcacaatcagcagcctgcagcctgaagattttgcaacttattactgtctacaggataatagtcacccattcactttcggccctgggaccaaagtggaaatcaaa

SEQ ID NO: 26356 - protein, 107 aa, Artificial Sequence
  Description of Artificial Sequence: Synthetic polypeptide
DIQMTQSPSSLSASVGDRVTITCRASQGIRNDLGWYQQKPGKAPKRLINAASSLQSGVPSRFSGSGSGTEFTLTISSLQPEDFATYYCLQDNSHPFTFGPGTKVEIK

SEQ ID NO: 26357 - DNA, 321 bp, Artificial Sequence
  Description of Artificial Sequence: Synthetic polynucleotide
gacatccagatgatccagtctccatccttcctgtttgcatctgtaggagacagagttaccatcacttgccgggcaagtcagggcatgagaattgatttagggtggtatcagcagaaaccaggaaaagcccctaagcgcctgatttatcgtgcatccagtttgcaaagtggggtcccatcaaggttcagcggcagtggatgtgggacagaattcactctcacaatcagcagcgtgcagcgtgaagattttgcaagttattactgtgtacagcataatagttaccctctcactttcggcggagggaccaaggtggagatcaaa

SEQ ID NO: 26358 - protein, 107 aa, Artificial Sequence
  Description of Artificial Sequence: Synthetic polypeptide
DIQMIQSPSFLFASVGDRVTITCRASQGMRIDLGWYQQKPGKAPKRLIYRASSLQSGVPSRFSGSGCGTEFTLTISSVQREDFASYYCVQHNSYPLTFGGGTKVEIK

SEQ ID NO: 26359 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaagtgatttaggctggtatcagcagaaaccagggaaagcccctaagcgcctgatctatactgcatccagtttgcaaagtggggtcccatcaaggttcagcggcagtggatctgggacagaattcactctcacaatcagcagcctgcagcctgaagattttgcaacttattactgtctacagcataatagttacccattcactttcggccctgggaccaaagtggacatcaaa

SEQ ID NO: 26360 - protein, 107 aa, Artificial Sequence
  Description of Artificial Sequence: Synthetic polypeptide
DIQMTQSPSSLSASVGDRVTITCRASQGIRSDLGWYQQKPGKAPKRLIYTASSLQSGVPSRFSGSGSGTEFTLTISSLQPEDFATYYCLQHNSYPFTFGPGTKVDIK

SEQ ID NO: 26361 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatttaggctggtatcagcagaaaccagggaaagcccctaagcgcctgatgtatactgcatccagtttgcaaagtggggtcccatcaaggttcagcggcagtggatctgggacagaattcactctcacaatcagcagcctgcagcctgaagattttgcaacttattactgtctacagcataatagttacccattcactttcggccctgggaccaaagtggatatcaaa

SEQ ID NO: 26362 - protein, 107 aa, Artificial Sequence
  Description of Artificial Sequence: Synthetic polypeptide
DIQMTQSPSSLSASVGDRVTITCRASQDIRNDLGWYQQKPGKAPKRLMYTASSLQSGVPSRFSGSGSGTEFTLTISSLQPEDFATYYCLQHNSYPFTFGPGTKVDIK

SEQ ID NO: 26363 - DNA, 339 bp, Artificial Sequence
  Description of Artificial Sequence: Synthetic polynucleotide
gacatcgtgatgacccagtctccagactccccggctgtgtctctgggcgagagggccaccatcaactgcaagtccagccagaatgttttacacagctccaacaataacaactacttaacttggtaccagcagagaccaggacagcctcctaagttgctcatttactgggcatctacccgggaatccggggtccctgaccgattcagtggcagcgggtctgggacagaattcactctcaccatcagcagcctgcaggctgaagatgtggcagtttattactgtcagcaatattatagtactcctccgacgttcggccaagggaccaaggtggaaatcaaa

SEQ ID NO: 26364 - protein, 113 aa, Artificial Sequence
  Description of Artificial Sequence: Synthetic polypeptide
DIVMTQSPDSPAVSLGERATINCKSSQNVLHSSNNNNYLTWYQQRPGQPPKLLIYWASTRESGVPDRFSGSGSGTEFTLTISSLQAEDVAVYYCQQYYSTPPTFGQGTKVEIK

SEQ ID NO: 26365 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattaacaattatttagcctggtttcagcagaaaccagggaaagcccctaagtccctgatctctgctgcatccagtttacaaagtggggtcccatcaaagttcagcggcagtggatctgggacagatttcactctcagtatcagcagcctacagcctgaagattttgcaacttattactgtcaacagtatcatagttacccattcactttcggccctgggaccaaagtggatatcaaa

SEQ ID NO: 26366 - protein, 107 aa, Artificial Sequence
  Description of Artificial Sequence: Synthetic polypeptide
DIQMTQSPSSLSASVGDRVTITCRASQGINNYLAWFQQKPGKAPKSLISAASSLQSGVPSKFSGSGSGTDFTLSISSLQPEDFATYYCQQYHSYPFTFGPGTKVDIK

SEQ ID NO: 26367 - DNA, 321 bp, Artificial Sequence
  Description of Artificial Sequence: Synthetic polynucleotide
gacatccagatgacccagtctccatcctccctgtctgcatcggtaggagacagagtcaccatcacttgccgggcaagtcagcgcgtcagaaatgatttaggctggtatcagcagaaaccagcgaaagcccctaagcgcatcattttcgatgcatccaatttgcaaagtggggtcccatcaaggttcagcggcagtggatctgggacagaattcactctcacaatcagcagcctgcagcctgaagattttgcaacttattactgtctacagcatcatagtttcccgatcaccttcggccaagggacccgactggagattaaa

SEQ ID NO: 26368 - protein, 107 aa, Artificial Sequence
  Description of Artificial Sequence: Synthetic polypeptide
DIQMTQSPSSLSASVGDRVTITCRASQRVRNDLGWYQQKPAKAPKRIIFDASNLQSGVPSRFSGSGSGTEFTLTISSLQPEDFATYYCLQHHSFPITFGQGTRLEIK

SEQ ID NO: 26369 - DNA, 321 bp, Artificial Sequence
  Description of Artificial Sequence: Synthetic polynucleotide
gacatccagttgacccagtctccatcctccctgtctgcatctgtaggagacagagtcaccatcacttgccgggcaagtcagagcattagcaaatatttaaattggtatcagcagaaaccagggaaagcccctgaactcctgatctatgctacatccaatttgcaaagtggggtcccatcaaggttcagtggcagtggatctgggacagatttcactctcaccatcagcactctgcaacctgaagattttgtaacttactactgtcaacagagttacagtctcccggtcactttcggcggagggaccaaggtagagatcaaa

SEQ ID NO: 26370 - protein, 107 aa, Artificial Sequence
  Description of Artificial Sequence: Synthetic polypeptide
DIQLTQSPSSLSASVGDRVTITCRASQSISKYLNWYQQKPGKAPELLIYATSNLQSGVPSRFSGSGSGTDFTLTISTLQPEDFVTYYCQQSYSLPVTFGGGTKVEIK

SEQ ID NO: 26371 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattagcgactatttaaattggtatcaacagaaaccagggaaagcccctaaactcctgatctacgatgcctccactttggaaacaggggtcccatcaaggttcagtggaagtggatctgggacagattttactttcaccatcagcagcctgcagcctgaagatattgcaacatatttctgtcaacaatatgataatctcccgatcaccttcggccaagggacacgactggagattaaa

SEQ ID NO: 26372 - protein, 107 aa, Artificial Sequence
  Description of Artificial Sequence: Synthetic polypeptide
DIQMTQSPSSLSASVGDRVTITCQASQDISDYLNWYQQKPGKAPKLLIYDASTLETGVPSRFSGSGSGTDFTFTISSLQPEDIATYFCQQYDNLPITFGQGTRLEIK

SEQ ID NO: 26373 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcagggcattagaaatgatttaggctggtatcagcagaaaccagggaaagcccctaagcgcctgatctatgctgcatccagtttgcaaagtggggtcccatcaaggttcagcggcagtggatctgggacagacttcactctcacaatcatcagcctgcagcctgatgactttgcaacttattactgtctacagcataatagttatccattcactttcggccctgggaccaaagtggatatcaaa

SEQ ID NO: 26374 - protein, 107 aa, Artificial Sequence
  Description of Artificial Sequence: Synthetic polypeptide
DIQMTQSPSSLSASVGDRVTITCRTSQGIRNDLGWYQQKPGKAPKRLIYAASSLQSGVPSRFSGSGSGTDFTLTIISLQPDDFATYYCLQHNSYPFTFGPGTKVDIK

SEQ ID NO: 26375 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaaggatttagggtggtatcagcagaaaccagggaaagcccctaaccgcctgatctatgctgcatccagtttgcaaagtggggtcccatcaaggttcagcggcagtggatctgggacagaattcactctcacattcagcagcctgcagcctgaagattttgcaacttattactgtctacagcatcatagttatcctcggacgttcggccaagggaccaaggtggaaatcaaa

SEQ ID NO: 26376 - protein, 107 aa, Artificial Sequence
  Description of Artificial Sequence: Synthetic polypeptide
DIQMTQSPSSLSASVGDRVTITCRASQDIRKDLGWYQQKPGKAPNRLIYAASSLQSGVPSRFSGSGSGTEFTLTFSSLQPEDFATYYCLQHHSYPRTFGQGTKVEIK

SEQ ID NO: 26377 - DNA, 321 bp, Artificial Sequence
  Description of Artificial Sequence: Synthetic polynucleotide
gacatccagatgacccagtctccatcctccctgtctgcatctgttggagacagagtcaccatcacttgccgggcaagtcgggacattggaaatgatttaggctggtatcagcagaaaccagggaaagcccctaagcgcctgatctctgctgcatccagtttgcaaagtggggtcccatcaaggttcagcggcagtggatctgggacagaattcactctcacattcagcagcctgcagcctgaagattttgcaacttattactgtctacagcattatagttaccctcggacgttcggccaagggaccaaggtggaaatcaaa

SEQ ID NO: 26378 - protein, 107 aa, Artificial Sequence
  Description of Artificial Sequence: Synthetic polypeptide
DIQMTQSPSSLSASVGDRVTITCRASRDIGNDLGWYQQKPGKAPKRLISAASSLQSGVPSRFSGSGSGTEFTLTFSSLQPEDFATYYCLQHYSYPRTFGQGTKVEIK

SEQ ID NO: 26379 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaaatatttagtctggtttcagcagaaaccagggaaagcccctaagtccctgatctatgctgcatccagtctgcaaagtggggtcccatcaaagttcagcggcagtggatctgggacagatttcactctcaccatcagcaacctgcagcctgaagattttgcaacttattactgccaacagtataatagttacccattcactttcggccctgggaccaaagtggatatcaaa

SEQ ID NO: 26380 - protein, 107 aa, Artificial Sequence
  Description of Artificial Sequence: Synthetic polypeptide
DIQMTQSPSSLSASVGDRVTITCRASQGISKYLVWFQQKPGKAPKSLIYAASSLQSGVPSKFSGSGSGTDFTLTISNLQPEDFATYYCQQYNSYPFTFGPGTKVDIK

SEQ ID NO: 26381 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatggtgatgggaagacctatttctattggtacctgcagaagccaggccagcctccacaggtcctgatctatgaagtatccaagcggttctctggagtgtcagaaaggttcagtggcagcgggtcagggacagatttcacactgaaaatcagccgggtggaggctgaggatgttggggtttattactgcatgcaaagtatacagattccgtggacgttcggccaagggaccaaggtggaaatcaaa

SEQ ID NO: 26382 - protein, 112 aa, Artificial Sequence
  Description of Artificial Sequence: Synthetic polypeptide
DIVMTQTPLSLSVTPGQPASISCKSSQSLLHGDGKTYFYWYLQKPGQPPQVLIYEVSKRFSGVSERFSGSGSGTDFTLKISRVEAEDVGVYYCMQSIQIPWTFGQGTKVEIK

SEQ ID NO: 26383 - DNA, 321 bp, Artificial Sequence
  Description of Artificial Sequence: Synthetic polynucleotide
gacatccagatgacccagtctccatcctcgctgtctgcctctgtaggagacagagtcaccatcacttgtcgggcgagtcaggacattaacaattatttagcctggtttcagcagaaaccaggaaaagcccctacgtccctgatctatgcttcatccagtttgcaaagtggggtcccatcaaagttcagcggcagtggatctgggacagatttcactctcaccatcagcagcctgcagcctgaagattttgcaacttattactgccaacaatatcatagttacccattcactttcggccctgggaccaaagtggatatcaga

SEQ ID NO: 26384 - protein, 107 aa, Artificial Sequence
  Description of Artificial Sequence: Synthetic polypeptide
DIQMTQSPSSLSASVGDRVTITCRASQDINNYLAWFQQKPGKAPTSLIYASSSLQSGVPSKFSGSGSGTDFTLTISSLQPEDFATYYCQQYHSYPFTFGPGTKVDIR

SEQ ID NO: 26385 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatttaggctggtatcagcagaaaccagggaaagcccctaagcgcctgatctatgctgcatccagtttgcagaatggggtcccatcaaggttcagcggcagtggatctgggacagaattcactctcacaatcagcagcctgcagcctgaagattttacaacttattactgtctacagcataatagtttcccgtggacgttcggccaagggaccaaggtggaaatcaaa

SEQ ID NO: 26386 - protein, 107 aa, Artificial Sequence
  Description of Artificial Sequence: Synthetic polypeptide
DIQMTQSPSSLSASVGDRVTITCRASQDIRNDLGWYQQKPGKAPKRLIYAASSLQNGVPSRFSGSGSGTEFTLTISSLQPEDFTTYYCLQHNSFPWTFGQGTKVEIK

SEQ ID NO: 26387 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatactgcatccaatttgcaaagtggggtcccatcaaggttcagcggcagtggatctgggacagaattcactctcacagtcagcagcctgcagcctgaagattttgcaacttattactgtctacagcataatagttacccgtggacgttcggccaagggaccaaggtggaaatcaaa

SEQ ID NO: 26388 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASNLQSGVPSRFSGSGSGTEFTLTVSSLQPEDFATYYCLQHNSYPWTFGQGTKVEIK

SEQ ID NO: 26389 - DNA, 321 bp, Artificial Sequence
  Description of Artificial Sequence: Synthetic polynucleotide
gacatccagatgacccagtctccatcctcgctgtctgcctctgtaggagacagagtcaccatcacttgtcgggcgagtcaggacattaacaattatttagcctggtttcagcagagaccagggaaagcccctacgtccctgatctatgcttcatccagtttgcaaagtggggtcccatcaaagttcagcggcagtggatctgggacagatttcactctcaccatcagcagcctgcagcctgaagattttgcaacttattactgccaacaatatcatagttacccattcactttcggccctgggaccaaagtggatatcaaa

SEQ ID NO: 26390 - protein, 107 aa, Artificial Sequence
  Description of Artificial Sequence: Synthetic polypeptide
DIQMTQSPSSLSASVGDRVTITCRASQDINNYLAWFQQRPGKAPTSLIYASSSLQSGVPSKFSGSGSGTDFTLTISSLQPEDFATYYCQQYHSYPFTFGPGTKVDIK

SEQ ID NO: 26391 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatttatgctgcatccagtttgcaaagtggggtcccatcaaggttcagcggcagtggatctgggacagaattcactctcacaatcagcagcctgcagcctgaagattttgcaacttattactgtctacagcatagtaattacccgctcactttcggcggagggacccaggtggagagcaaa

SEQ ID NO: 26392 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHSNYPLTFGGGTQVESK

SEQ ID NO: 26393 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttacacagctccaacaataataactacttagcttggtaccagcagaaaccaggacagcctcctaagctactcatttactgggcatctacccgggaatccggggtccctgaccgattcagtggcagcgggtctgggacagatttcactctcaccatcagcagcctgcaggctgaagatgtggcagtttattactgtcagcaatattataatagtccgtgcagttttggccaggggaccaagctggagatcaaa

SEQ ID NO: 26394 - protein, 113 aa, Artificial Sequence
  Description of Artificial Sequence: Synthetic polypeptide
DIVMTQSPDSLAVSLGERATINCKSSQSVLHSSNNNNYLAWYQQKPGQPPKLLIYWASTRESGVPDRFSGSGSGTDFTLTISSLQAEDVAVYYCQQYYNSPCSFGQGTKLEIK

SEQ ID NO: 26395 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaaggatttagggtggtatcagcagaaaccagggaaagcccctaaccgcctgatctatgctgcatccagtttgcaaagtggggtcccatcaaggttcagcggcagtggatctgggacagaattcactctcacattcagcagcctgcagcctgaagattttgcaacttattactgtctacagcattatagttatcctcggacgttcggccaagggaccaaggtggaaatcaaa

SEQ ID NO: 26396 - protein, 107 aa, Artificial Sequence
  Description of Artificial Sequence: Synthetic polypeptide
DIQMTQSPSSLSASVGDRVTITCRASQDIRKDLGWYQQKPGKAPNRLIYAASSLQSGVPSRFSGSGSGTEFTLTFSSLQPEDFATYYCLQHYSYPRTFGQGTKVEIK

SEQ ID NO: 26397 - DNA, 321 bp, Artificial Sequence
  Description of Artificial Sequence: Synthetic polynucleotide
gacattcagatgacccagtctccatcctccccgtctgcatctgtaggagacagagtcaccatcacttgccgggcaagtcagggcattagaaatgatttaggctggtatcagcagaaaccagggaaagcccctaagcgcttgatcaatgttgcatccagtttgcaaagtggggtcccatcaaggttcagcggcagtggatctgggacagaattcactcttacaatcagcagcgtgcagcctgaagattttgcaacttattactgtatacaggataatagtcacccattcactttcggccctgggaccaaagtggaaatcaaa

SEQ ID NO: 26398 - protein, 107 aa, Artificial Sequence
  Description of Artificial Sequence: Synthetic polypeptide
DIQMTQSPSSPSASVGDRVTITCRASQGIRNDLGWYQQKPGKAPKRLINVASSLQSGVPSRFSGSGSGTEFTLTISSVQPEDFATYYCIQDNSHPFTFGPGTKVEIK

SEQ ID NO: 26399 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattagtaattatttagtctggtttcagcagaaattagggaaagcccctaagtccctgatctatgttgcatccagtttgcaaagtggggtcccatcaaggttcagcggcagtggatctgggacagatttcactctcaccatcagcagcctgcagcctgaagattttgcaacttattactgccaacagtataatagttaccctctcactttcggcggagggaccaaagtagagatcaaa

SEQ ID NO: 26400 - protein, 107 aa, Artificial Sequence
  Description of Artificial Sequence: Synthetic polypeptide
DIQMTQSPSSLSASVGDRVTITCRASQDISNYLVWFQQKLGKAPKSLIYVASSLQSGVPSRFSGSGSGTDFTLTISSLQPEDFATYYCQQYNSYPLTFGGGTKVEIK

SEQ ID NO: 26401 - DNA, 321 bp, Artificial Sequence
  Description of Artificial Sequence: Synthetic polynucleotide
gacatccagatgacccagtctccatcctccccgtctgcatctgtaggagacagagtcaccatcacttgccgggcaagtcagggcattagaaatgatttaggctggtatcagcagaaaccagggacagcccctaagcgccttatctatgctgcatccagtttgcaaagtggggtcccatcaaggttcagcggcagtggatctgggacagaattcactctcacaatcagcaacctgcagcctgaggattttgcaacttattactgtctacagcatagtagttacccgctcactttcggcggcgggaccaaggtggagatcaaa

SEQ ID NO: 26402 - protein, 107 aa, Artificial Sequence
  Description of Artificial Sequence: Synthetic polypeptide
DIQMTQSPSSPSASVGDRVTITCRASQGIRNDLGWYQQKPGTAPKRLIYAASSLQSGVPSRFSGSGSGTEFTLTISNLQPEDFATYYCLQHSSYPLTFGGGTKVEIK

SEQ ID NO: 26403 - DNA, 336 bp, Artificial Sequence
  Description of Artificial Sequence: Synthetic polynucleotide
gctattgtgatgacccagactccactctctctgtccgtcacccctggacagccggcctccatctcctgcaagtctagtcagagcctcctgcacggtgatggaaagacctatttgtattggtacctgcagaagccaggccagcctccacacctcctgatctatgaagtttccaaacggttctctggagtgccagataggttcagtggcagcgggtcagggacagatttcacactgaaaatcagccgggtggaggctgaggatgttgggctttattactgcatgcaaagtatacagcttccgtggacgtttgtccaagggaccaaggtggaaatcaca

SEQ ID NO: 26404 - protein, 112 aa, Artificial Sequence
  Description of Artificial Sequence: Synthetic polypeptide
AIVMTQTPLSLSVTPGQPASISCKSSQSLLHGDGKTYLYWYLQKPGQPPHLLIYEVSKRFSGVPDRFSGSGSGTDFTLKISRVEAEDVGLYYCMQSIQLPWTFVQGTKVEIT

SEQ ID NO: 26405 - DNA, 318 bp, Artificial Sequence
  Description of Artificial Sequence: Synthetic polynucleotide
gaaatagtgatgacgcagtctccagccaccctgtctgtgtctccaggggaaagagcctccctctcctgcaggtccagtcagagtgttaacagcaacttagcctggtaccagcagaggcctggccaggctctcaggctcctcatctatggtgcatccatcagggccactgatatcccagccaggttcaatggcagtgggtctgggacagagttcactctcaccatcagcagcctgcagtctgaagattttgcagtttatttctgtcagcagtataataactggtggacgttcggccaagggaccacggtggaaatcaaa

SEQ ID NO: 26406 - protein, 106 aa, Artificial Sequence
  Description of Artificial Sequence: Synthetic polypeptide
EIVMTQSPATLSVSPGERASLSCRSSQSVNSNLAWYQQRPGQALRLLIYGASIRATDIPARFNGSGSGTEFTLTISSLQSEDFAVYFCQQYNNWWTFGQGTTVEIK

SEQ ID NO: 26407 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacatttacaattatttaaattggtatcagcagaaaccagggaaagcccctaagctcctgatctacgatgcatccaatttggaaacaggggtcccatcaaggttcagtggaagtggatctgggacagattttactttcgccatcagcagcctgcagcctgaagatattgcaacatattactgtcaacagtatgatattctcccgatcaccttcggccaagggacacgactggagattaaa

SEQ ID NO: 26408 - protein, 107 aa, Artificial Sequence
  Description of Artificial Sequence: Synthetic polypeptide
DIQMTQSPSSLSASVGDRVTITCQASQDIYNYLNWYQQKPGKAPKLLIYDASNLETGVPSRFSGSGSGTDFTFAISSLQPEDIATYYCQQYDILPITFGQGTRLEIK

SEQ ID NO: 26409 - DNA, 321 bp, Artificial Sequence
  Description of Artificial Sequence: Synthetic polynucleotide
gacatccagatgacccagtctccatcctccctgtctgcatctgtaggcgacagagtcaccatcacttgccgggcaagtcagggcattagaaatgatttgggctggtatcagcagaaaccaggagaagcccctaagcgcctgatctatgctgcatccactttgcaaagtggggtcccatcgcggttcagcggcagtggatctggggcagaattcactgtcacaatcggcagcgtgcagcgtgaagattttgcaacttattacggtctactatatattcgttacccattcacttttggccgtgggaccaaagtggatatcaaa

SEQ ID NO: 26410 - protein, 107 aa, Artificial Sequence
  Description of Artificial Sequence: Synthetic polypeptide
DIQMTQSPSSLSASVGDRVTITCRASQGIRNDLGWYQQKPGEAPKRLIYAASTLQSGVPSRFSGSGSGAEFTVTIGSVQREDFATYYGLLYIRYPFTFGRGTKVDIK

SEQ ID NO: 26411 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacatttacaaccatttaagttggtatcagcagaaaccagggaaagcccctaagctcctgatctacgatgcatccaattgggaaacaggggtcccatccaggttcagtggaggtggatctgggacagattttactttcaccatcagcagcctgcagcctgaagattttgcaacatattactgtcaacagtatgaaaatctcccgctcaccttcggcggagggaccaaggtggagatcaaa

SEQ ID NO: 26412 - protein, 107 aa, Artificial Sequence
  Description of Artificial Sequence: Synthetic polypeptide
DIQMTQSPSSLSASVGDRVTITCQASQDIYNHLSWYQQKPGKAPKLLIYDASNWETGVPSRFSGGGSGTDFTFTISSLQPEDFATYYCQQYENLPLTFGGGTKVEIK

SEQ ID NO: 26413 - DNA, 321 bp, Artificial Sequence
  Description of Artificial Sequence: Synthetic polynucleotide
gacatccagatgacccagtctccatcctccctgtctgcatctgtaggcgacagagtcaccatcacttgccgggcaagtcagggcattagaaatgatttgggctggtatcagcagaaaccaggagaagcccctaagcgcctgatctatgctgcatccactttgcaaagtggggtcccatcgcggttcagcggcagtggatctggggcagaattcactctcacaatcggcagcgtgcagcgtgaagattttgcaacttattacggtctacaatataatcgttacccattcacttttggccgtgggaccaaagtggatatcaaa

SEQ ID NO: 26414 - protein, 107 aa, Artificial Sequence
  Description of Artificial Sequence: Synthetic polypeptide
DIQMTQSPSSLSASVGDRVTITCRASQGIRNDLGWYQQKPGEAPKRLIYAASTLQSGVPSRFSGSGSGAEFTLTIGSVQREDFATYYGLQYNRYPFTFGRGTKVDIK

SEQ ID NO: 26415 - DNA, 321 bp, Artificial Sequence
  Description of Artificial Sequence: Synthetic polynucleotide
gacatccagatgacccagtctccatcctcccggtctgcatctgtaggagacagagtcaccatcacttgccgggcaagtcaggacattagaaaggatttagggtggtatcagcagaaaccagggaaagcccctaaccgcctgatctatgctgcatccagtttgcaaagtggggtcccatcaaggttcagcggcagtggatctgggacagaattcactctcacattcagcagcctgcagcctgaagattttgcaacttattactgtctacagcatcatagttatcctcggacgttcggccaagggaccaaggtggaaatcaaa

SEQ ID NO: 26416 - protein, 107 aa, Artificial Sequence
  Description of Artificial Sequence: Synthetic polypeptide
DIQMTQSPSSRSASVGDRVTITCRASQDIRKDLGWYQQKPGKAPNRLIYAASSLQSGVPSRFSGSGSGTEFTLTFSSLQPEDFATYYCLQHHSYPRTFGQGTKVEIK

SEQ ID NO: 26417 - DNA, 321 bp, Artificial Sequence
  Description of Artificial Sequence: Synthetic polynucleotide
gacattcagatgacccagtctccatcctccctgtgtgcatctgtaggagacagagtcaccatcacttgccgggcaagtcagggcattagaaatgatttaggctggtatcagcagaaaccagggaaagcccctaagcgcttgatcaatgctgcatccagtttgcaaagtggggtcccatcaaggttcagcggcagtggatctgggacagaattcactctcacaatcagcagcgtgcagcctgaagattttgcaacttattactgtatacaggataatagtcacccattcactttcggccctgggaccaaagtggaaatcaaa

SEQ ID NO: 26418 - protein, 107 aa, Artificial Sequence
  Description of Artificial Sequence: Synthetic polypeptide
DIQMTQSPSSLCASVGDRVTITCRASQGIRNDLGWYQQKPGKAPKRLINAASSLQSGVPSRFSGSGSGTEFTLTISSVQPEDFATYYCIQDNSHPFTFGPGTKVEIK

SEQ ID NO: 26419 - DNA, 321 bp, Artificial Sequence
  Description of Artificial Sequence: Synthetic polynucleotide
gacattcagatgacccagtctccatcctccctgtctgcatctgtaggagacagagtcaccatcacttgccgggcaagtcagggcattagaaatgatttaggctggtatcagcagaaaccagggaaagcccctaagcgcttgatcaatgctgcatccagtttgcaaagtggggtcccatcaaggttcagcggcagtggatctgggacagaattcactctcacaatcagcagcctgcagcctgaagattttgcaacttattactgtctacaggataatagtcacccattcactttcggccctgggaccaaagtggaaatcaaa

SEQ ID NO: 26420 - protein, 107 aa, Artificial Sequence; identical to SEQ ID NO: 26356
  Description of Artificial Sequence: Synthetic polypeptide

SEQ ID NO: 26421 - DNA, 339 bp, Artificial Sequence
  Description of Artificial Sequence: Synthetic polynucleotide
gacattgtgatgacccagtctccagacttccgtaatgtgtctatgggcgagagggccatcatcaacttcaagtccaaccatagtgttttatacaggtccaacaataatcaatacttagcttggtaccagcggaaaccaggacagcctcctaagttgctcatttaccggacatctatccggaaatccggggtccctgaccgattcagtggcagcgggtgtgggacagatttcactctcaccatcgacagcctgcaggctgaagatgtggcagtttattactgtcagcaatattatagtactcctcccactttcggcggagggaccaaggtggagatcaaa

SEQ ID NO: 26422 - protein, 113 aa, Artificial Sequence
  Description of Artificial Sequence: Synthetic polypeptide
DIVMTQSPDFRNVSMGERAIINFKSNHSVLYRSNNNQYLAWYQRKPGQPPKLLIYRTSIRKSGVPDRFSGSGCGTDFTLTIDSLQAEDVAVYYCQQYYSTPPTFGGGTKVEIK

SEQ ID NO: 26423 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagaatgttttacacagctccaacaataacaactacttaacttggtaccagcagagaccaggacagcctcctaagttgctcatttactgggcatctacccgggaatccggggtccctgaccgattcagtggcagcgggtctgggacagaattcactctcaccatcagcagcctgcaggctgaagatgtggcagtttattactgtcagcaatattatagtactcctccgacgttcggccaagggaccaaggtggaaatcaaa

SEQ ID NO: 26424 - protein, 113 aa, Artificial Sequence
  Description of Artificial Sequence: Synthetic polypeptide
DIVMTQSPDSLAVSLGERATINCKSSQNVLHSSNNNNYLTWYQQRPGQPPKLLIYWASTRESGVPDRFSGSGSGTEFTLTISSLQAEDVAVYYCQQYYSTPPTFGQGTKVEIK

SEQ ID NO: 26425 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctactcagagcctcctgcatggtgatggaaagacctatttgtattggtacctgcagaagccaggccagcctccacaactcctgatctatgaagtttccaagcggttctctggagtgccagaaaggttcagtggcagcgggtcagggacagatttcacactgaaaatcagccgggtggaggctgaggatgttggggtttattactgcaagcaaagtatacagcttccgtggacgttcggccaagggaccaaggtggaaatcaaa

SEQ ID NO: 26426 - protein, 112 aa, Artificial Sequence
  Description of Artificial Sequence: Synthetic polypeptide
DIVMTQTPLSLSVTPGQPASISCKSTQSLLHGDGKTYLYWYLQKPGQPPQLLIYEVSKRFSGVPERFSGSGSGTDFTLKISRVEAEDVGVYYCKQSIQLPWTFGQGTKVEIK

SEQ ID NO: 26427 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcagcttattactgccaacagtataatagttacccattcactttcggccctgggacccaagtggatgcccaa

SEQ ID NO: 26428 - protein, 107 aa, Artificial Sequence
  Description of Artificial Sequence: Synthetic polypeptide
DIQMTQSPSSLSASVGDRVTITCRASQDISNYLAWFQQKPGKAPKSLIYAASSLQSGVPSKFSGSGSGTDFTLTISSLQPEDFAAYYCQQYNSYPFTFGPGTQVDAQ

SEQ ID NO: 26429 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatttaggctggtatcagcagaaaccagggaaagcccctacgcgcctgatctatcctgcatccagtttgcaaagtggggtcccatcaaggttcagcggcagtggatctgggacagaattcactctctcaatcagtagcctgcagcctgaagattttgcaacttattactgtctacagcataatagtcacccattcactttcggccctgggaccaaagtggatatcaaa

SEQ ID NO: 26430 - protein, 107 aa, Artificial Sequence
  Description of Artificial Sequence: Synthetic polypeptide
DIQMTQSPSSLSASVGDRVTITCRASQDIRNDLGWYQQKPGKAPTRLIYPASSLQSGVPSRFSGSGSGTEFTLSISSLQPEDFATYYCLQHNSHPFTFGPGTKVDIK

SEQ ID NO: 26431 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattagcaattatttagtctggtttcagcagaaaccagggaaagcccctaagtccctgatctatgctgcatccagtttgctaagtggggtcccttcaaagttcagcggcagtggatctgggacagatttcactctcaccatcagcagcctgcagcctgaagattttgcaacttattactgccaacagtatcatagttacccgctcactttcggcggagggaccaaggtggcgatcaaa

SEQ ID NO: 26432 - protein, 107 aa, Artificial Sequence
  Description of Artificial Sequence: Synthetic polypeptide
DIQMTQSPSSLSASVGDRVTITCRASQDISNYLVWFQQKPGKAPKSLIYAASSLLSGVPSKFSGSGSGTDFTLTISSLQPEDFATYYCQQYHSYPLTFGGGTKVAIK

SEQ ID NO: 26433 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagagatgatttaggctggtatcagcagaaaccagggaaagcccctaagcgcctgatctatcctgcatccagtttgcaaagtggggtcccatcaaggttcagcggcagtggatctgggacagaattcactctcacaatcagcagcctgcagcctgaagattttgcagcttattactgtctacaggataatagttacccattcactttcggccctgggaccaaagtggatatcaaa

SEQ ID NO: 26434 - protein, 107 aa, Artificial Sequence
  Description of Artificial Sequence: Synthetic polypeptide
DIQMTQSPSSLSASVGDRVTITCRASQDIRDDLGWYQQKPGKAPKRLIYPASSLQSGVPSRFSGSGSGTEFTLTISSLQPEDFAAYYCLQDNSYPFTFGPGTKVDIK

SEQ ID NO: 26435 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaataatttaggctggtatcagcagaaaccagggaaagcccctaagcgcctgatctatcctgcatccagtttgcaaagtggggtcccatcaaggttcagcggcagtggatctgggacagaattcactctcacaatcagcagcctgcagcctgaagattttgcaacttattactgtctacaggattatagttacccattcactttcggccctgggaccaaagtggatatcaaa

SEQ ID NO: 26436 - protein, 107 aa, Artificial Sequence
  Description of Artificial Sequence: Synthetic polypeptide
DIQMTQSPSSLSASVGDRVTITCRASQDIRNNLGWYQQKPGKAPKRLIYPASSLQSGVPSRFSGSGSGTEFTLTISSLQPEDFATYYCLQDYSYPFTFGPGTKVDIK

SEQ ID NO: 26437 - DNA, 339 bp, Artificial Sequence
  Description of Artificial Sequence: Synthetic polynucleotide
gacatcgtgatgacccagtctccagactccctgactgtgtctccgggcgagagggccaccatcaactgcaagtccagccagagtgttttacacagctccaacaataagaactacttaacttggtaccagcagaaaccaggacagcctcctaaactgctcatttactgggcatctacccgagaatccggggtccctgtccgattcagtggcagcgggtcggggacagatttcactgtccccatcagcagcatgcaggatgatgatgtggcagtttattaccgtcagcaatcttatagtattcctcccactttcggccccgggaccaacgtggatatcaaa

SEQ ID NO: 26438 - protein, 113 aa, Artificial Sequence
  Description of Artificial Sequence: Synthetic polypeptide
DIVMTQSPDSLTVSPGERATINCKSSQSVLHSSNNKNYLTWYQQKPGQPPKLLIYWASTRESGVPVRFSGSGSGTDFTVPISSMQDDDVAVYYRQQSYSIPPTFGPGTNVDIK

SEQ ID NO: 26439 - DNA, 321 bp, Artificial Sequence
  Description of Artificial Sequence: Synthetic polynucleotide
gacatccagatgacccagtctccatcctcactgtctacatctgtaggagacagagtcaccatcacttgtcgggcgagtcaggacattagccattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagtttcccgctcactttcggcggagggaccaaggtggagatcaca

SEQ ID NO: 26440 - protein, 107 aa, Artificial Sequence
  Description of Artificial Sequence: Synthetic polypeptide
DIQMTQSPSSLSTSVGDRVTITCRASQDISHYLAWFQQKPGKAPKSLIYAASSLQSGVPSKFSGSGSGTDFTLTISSLQPEDFATYYCQQYNSFPLTFGGGTKVEIT

SEQ ID NO: 26441 - DNA, 336 bp, Artificial Sequence
  Description of Artificial Sequence: Synthetic polynucleotide
gatattgtgatgacccagactccactctctctgtccgtcacccctggacagccggcctccatctcctgtaagtctagtcagagcctcctgcacggtgatgggaagacctatttgtattggtacctgcagaagccaggccagcctccacacctcctgatctatgaagtttccaaacggttctctggagtgccagataggttcagtggcagcgggtcagggacagatttcacactgaagatcagccgggtggaggctgaggatgttgggctttatcactgcatgcaaagcatacagcttccgtggacgttcggccaagggaccaaggtggaaatcaaa

SEQ ID NO: 26442 - protein, 112 aa, Artificial Sequence
  Description of Artificial Sequence: Synthetic polypeptide
DIVMTQTPLSLSVTPGQPASISCKSSQSLLHGDGKTYLYWYLQKPGQPPHLLIYEVSKRFSGVPDRFSGSGSGTDFTLKISRVEAEDVGLYHCMQSIQLPWTFGQGTKVEIK

SEQ ID NO: 26443 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcacggtgatggaaagacctatttgtattggtacctgcagaagccaggccagcctccacacctcctgatctatgaagtttccaaacggttctctggagtgccagataggttcagtggcagcgggtcagggacagatttcacactgaaaatcagccgggtggaggctgaggatgttgggctttatcactgcatgcaaagcatacagcttccgtggacgttcggccaagggaccaaggtggaaatcaaa

SEQ ID NO: 26444 - protein, 112 aa, Artificial Sequence; identical to SEQ ID NO: 26442
  Description of Artificial Sequence: Synthetic polypeptide

SEQ ID NO: 26445 - DNA, 321 bp, Artificial Sequence
  Description of Artificial Sequence: Synthetic polynucleotide
gacatccagatgacccagtctccatcctcactgtctgcatctgtaggggacagagtcaccatcacttgtcgggcgagtcagggcattaacaattatttagcctggtttcagcagaaaccagggaaagcccctgagtccctgatctatgctgcatccagtttgcaaagtggggtcccatcaaagttcagcggcagtggatctgggacagatttcactctcaccatcagcagcctgcagcctgaagattttgcaacttatttctgccaacagtataatagttatccattcactttcggccctgggaccaaagtggatatcaaa

SEQ ID NO: 26446 - protein, 107 aa, Artificial Sequence
  Description of Artificial Sequence: Synthetic polypeptide
DIQMTQSPSSLSASVGDRVTITCRASQGINNYLAWFQQKPGKAPESLIYAASSLQSGVPSKFSGSGSGTDFTLTISSLQPEDFATYFCQQYNSYPFTFGPGTKVDIK

SEQ ID NO: 26447 - DNA, 321 bp, Artificial Sequence
  Description of Artificial Sequence: Synthetic polynucleotide
gacatccagatgacccaatctccatcctccctgtctgcatctgtaggagacagagtcaccatcacttgccgggctagtcagggcattagaaatgatttaggctggtatcagcagaaaccagggaaagcccctaagcgcctgatcggtgctgaatccagtttgcaaagtggggtcccatcaaggttcagcggcagtggatctgggacagaattcactctcacaatcagcggcctgcagcctgaagattttgcaacttattactgtctacagcattatagttacccgctcactttcggcggagggaccaaagtggagatcaaa

SEQ ID NO: 26448 - protein, 107 aa, Artificial Sequence
  Description of Artificial Sequence: Synthetic polypeptide
DIQMTQSPSSLSASVGDRVTITCRASQGIRNDLGWYQQKPGKAPKRLIGAESSLQSGVPSRFSGSGSGTEFTLTISGLQPEDFATYYCLQHYSYPLTFGGGTKVEIK

SEQ ID NO: 26449 - DNA, 336 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacatctccaacaataaaaactacttagcttggtaccagcagaaaccaggacagcctcctaaactgctcatttactgggcatctacccgggaatccggggtccctgaccgattcagtggcagcgggtctgggacagatttcactctcaccatcagcagcctgcaggctgaagatgtggcagtttattactgtcagcaatattatcgtgctcccaccttcggccaagggacacgactggagattaaa

SEQ ID NO: 26450 - protein, 112 aa, Artificial Sequence
  Description of Artificial Sequence: Synthetic polypeptide
DIVMTQSPDSLAVSLGERATINCKSSQSVLYISNNKNYLAWYQQKPGQPPKLLIYWASTRESGVPDRFSGSGSGTDFTLTISSLQAEDVAVYYCQQYYRAPTFGQGTRLEIK

SEQ ID NO: 26451 - DNA, 336 bp, Artificial Sequence
  Description of Artificial Sequence: Synthetic polynucleotide
gacattgtgatgactcagtctccactctccctgcccgtcacccctggagagccggcctccatctcctgcaggtctagtcagagcctcctgcataataatggatacaagtatttggattggtacctgcagaagccagggcagtctccacagctcctgatctatttgggttctaatcgggcctccggggtccctgacaggttcagtgccagtggatcaggcacagattttacactgaaaatcagcagagtggaggctgaggatgttggggtttattactgcatgcaagttctacaaactccgtggacgttcggccaagggaccaaggtggaaatcaaa

SEQ ID NO: 26452 - protein, 112 aa, Artificial Sequence
  Description of Artificial Sequence: Synthetic polypeptide
DIVMTQSPLSLPVTPGEPASISCRSSQSLLHNNGYKYLDWYLQKPGQSPQLLIYLGSNRASGVPDRFSASGSGTDFTLKISRVEAEDVGVYYCMQVLQTPWTFGQGTKVEIK

SEQ ID NO: 26453 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctttgctgcatccagtttgcaaagtggggtcccatcaaggttcagcggcagtggatctgggacagaattcactctcacaatcagcagcctgcagcctgaagattttgcaacttattactgtctacagcattatagttacccgctcactttcggcggagggaccaaggtggagatcaaa

SEQ ID NO: 26454 - protein, 107 aa, Artificial Sequence
  Description of Artificial Sequence: Synthetic polypeptide
DIQMTQSPSSLSASVGDRVTITCRASQGIRNDLGWYQQKPGKAPKRLIFAASSLQSGVPSRFSGSGSGTEFTLTISSLQPEDFATYYCLQHYSYPLTFGGGTKVEIK

SEQ ID NO: 26455 - DNA, 336 bp, Artificial Sequence; identical to SEQ ID NO: 26449
  Description of Artificial Sequence: Synthetic polynucleotide

SEQ ID NO: 26456 - protein, 112 aa, Artificial Sequence; identical to SEQ ID NO: 26450
  Description of Artificial Sequence: Synthetic polypeptide

SEQ ID NO: 26457 - DNA, 336 bp, Artificial Sequence; identical to SEQ ID NO: 26451
  Description of Artificial Sequence: Synthetic polynucleotide

SEQ ID NO: 26458 - protein, 112 aa, Artificial Sequence; identical to SEQ ID NO: 26452
  Description of Artificial Sequence: Synthetic polypeptide

SEQ ID NO: 26459 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcatcatagttgcccgtggacgttcggccaagggaccaaggtggaaatcaaa

SEQ ID NO: 26460 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHHSCPWTFGQGTKVEIK

SEQ ID NO: 26461 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattagcaattatttagcctggtttcagcagaaaccagggaaagcccctaagtccctaatcttttctgcatccagtttgcaaagtggggtcccatcaaaattcagcggcagtggatctgggacagatttcaatctcaccatcagcagcctgcagcctgaagattttgcaacttattactgccaacaatctgatagttaccctctcactttcggcggagggaccaaggtggagatcaaa

SEQ ID NO: 26462 - protein, 107 aa, Artificial Sequence
  Description of Artificial Sequence: Synthetic polypeptide
DIQMTQSPSSLSASVGDRVTITCRASQDISNYLAWFQQKPGKAPKSLIFSASSLQSGVPSKFSGSGSGTDFNLTISSLQPEDFATYYCQQSDSYPLTFGGGTKVEIK

SEQ ID NO: 26463 - DNA, 321 bp, Artificial Sequence
  Description of Artificial Sequence: Synthetic polynucleotide
gacatccagatgacccagtctccatcttcactgtctgcatctgtaggagacagagtcaccatcacttgtcgggcgagtcaggacattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtatcatagttacccattcactttcggccctgggaccaaagtggatatcaaa

SEQ ID NO: 26464 - protein, 107 aa, Artificial Sequence
  Description of Artificial Sequence: Synthetic polypeptide
DIQMTQSPSSLSASVGDRVTITCRASQDISNYLAWFQQKPGKAPKSLIYAASSLQSGVPSKFSGSGSGTDFTLTISSLQPEDFATYYCQQYHSYPFTFGPGTKVDIK

SEQ ID NO: 26465 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagagatgatttaggctggtatcaacagaaaccagggaaagtccctaagcgcctgatatatgctgcatccagtttgcaaagtggggtcccatcaaggttcagcggcagtggatctgggacagaattcactctcacaatcagcagcctacagcctgaagattttgcaacttattactgtcttcagcattatagttaccctcggacgttcggccaagggaccaaggtggaaatcaaa

SEQ ID NO: 26466 - protein, 107 aa, Artificial Sequence
  Description of Artificial Sequence: Synthetic polypeptide
DIQMTQSPSSLSASVGDRVTITCRASQGIRDDLGWYQQKPGKVPKRLIYAASSLQSGVPSRFSGSGSGTEFTLTISSLQPEDFATYYCLQHYSYPRTFGQGTKVEIK

SEQ ID NO: 26467 - DNA, 336 bp, Artificial Sequence
  Description of Artificial Sequence: Synthetic polynucleotide
gagattgtgatgacccagactccactcttcctgtccgtcacccctggacagccggcctccatctcctgcaagtctagtcagagcctcctgcatggtgatggaaagacctatttgttttggtacctgcagaagccaggccagcctccacaggtcctgatctatgaagtttccaaccggttctctggagtgccagataggttcagtggcagcgggtcagggacagatttcacactgaaaatcagccgggtggaggctgaggatgttggggtttattactgcatgcaaagtattcagcttccgtggacgttcggccaagggaccaaggtggaaatcaaa

SEQ ID NO: 26468 - protein, 112 aa, Artificial Sequence
  Description of Artificial Sequence: Synthetic polypeptide
EIVMTQTPLFLSVTPGQPASISCKSSQSLLHGDGKTYLFWYLQKPGQPPQVLIYEVSNRFSGVPDRFSGSGSGTDFTLKISRVEAEDVGVYYCMQSIQLPWTFGQGTKVEIK

SEQ ID NO: 26469 - DNA, 321 bp, Artificial Sequence
  Description of Artificial Sequence: Synthetic polynucleotide
gacatccagatgacccagtctccatcctcactgtctgcatctgaaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtatcatagttacccattcactttcggccctgggaccaaagtggatatcaaa

SEQ ID NO: 26470 - protein, 107 aa, Artificial Sequence
  Description of Artificial Sequence: Synthetic polypeptide
DIQMTQSPSSLSASEGDRVTITCRASQGISNYLAWFQQKPGKAPKSLIYAASSLQSGVPSKFSGSGSGTDFTLTISSLQPEDFATYYCQQYHSYPFTFGPGTKVDIK

SEQ ID NO: 26471 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctacatccagtttgcaaagtggggtcccatcaaggttcagcggcagtggatctgggacagaattcactctcacaatcagcagcctgcagcctgaagattttgcaacttattattgtctacagcatagtagtaacccgtggacgttcggccaagggaccaaggtggaaagcaaa

SEQ ID NO: 26472 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYATSSLQSGVPSRFSGSGSGTEFTLTISSLQPEDFATYYCLQHSSNPWTFGQGTKVESK
